US012134655B2

(12) United States Patent
Biasci et al.

(10) Patent No.: US 12,134,655 B2
(45) Date of Patent: Nov. 5, 2024

(54) CANCER ASSOCIATED ANTIBODY COMPOSITIONS AND METHODS OF USE

(71) Applicant: Absci Corporation, Vancouver, WA (US)

(72) Inventors: Daniele Biasci, Poole (GB); Goran Rakocevic, Belgrade (RS); Berke Cagkan Toptas, Cambridge, MA (US); Ines De Santiago Domingos De Jesus, London (GB)

(73) Assignee: ABSCI CORPORATION, Vancouver, WA (US)

( * ) Notice: Subject to any disclaimer, the term of this patent is extended or adjusted under 35 U.S.C. 154(b) by 351 days.

(21) Appl. No.: 17/606,246

(22) PCT Filed: Apr. 29, 2020

(86) PCT No.: PCT/US2020/030534
§ 371 (c)(1),
(2) Date: Oct. 25, 2021

(87) PCT Pub. No.: WO2020/223392
PCT Pub. Date: Nov. 5, 2020

(65) Prior Publication Data
US 2022/0204643 A1   Jun. 30, 2022

Related U.S. Application Data

(60) Provisional application No. 62/840,638, filed on Apr. 30, 2019, provisional application No. 62/840,640, filed on Apr. 30, 2019, provisional application No. 62/840,644, filed on Apr. 30, 2019, provisional application No. 62/840,648, filed on Apr. 30, 2019, provisional application No. 62/840,855, filed on Apr. 30, 2019, provisional application No. 62/840,858, filed on Apr. 30, 2019, provisional application No. 62/840,860, filed on Apr. 30, 2019, provisional application No. 62/840,861, filed on Apr. 30, 2019, provisional application No. 62/840,864, filed on Apr. 30, 2019, provisional application No. 62/840,870, filed on Apr. 30, 2019, provisional application No. 62/840,875, filed on Apr. 30, 2019, provisional application No. 62/840,880, filed on Apr. 30, 2019, provisional application No. 62/840,893, filed on Apr. 30, 2019, provisional application No. 62/840,904, filed on Apr. 30, 2019, provisional application No. 62/840,909, filed on Apr. 30, 2019, provisional application No. 62/840,917, filed on Apr. 30, 2019, provisional application No. 62/840,938, filed on Apr. 30, 2019, provisional application No. 62/840,950, filed on Apr. 30, 2019, provisional application No. 62/840,957, filed on Apr. 30, 2019, provisional application No. 62/840,970, filed on Apr. 30, 2019, provisional application No. 62/841,036, filed on Apr. 30, 2019, provisional application No. 62/841,044, filed on Apr. 30, 2019, provisional application No. 62/841,047, filed on Apr. 30, 2019, provisional application No. 62/841,049, filed on Apr. 30, 2019.

(51) Int. Cl.
*C07K 16/00* (2006.01)
*C07K 16/30* (2006.01)
*C07K 16/32* (2006.01)

(52) U.S. Cl.
CPC .............. *C07K 16/32* (2013.01); *C07K 16/30* (2013.01); *C07K 2317/10* (2013.01)

(58) Field of Classification Search
CPC ..... C07K 16/32; C07K 16/30; C07K 2317/10
See application file for complete search history.

(56) References Cited

U.S. PATENT DOCUMENTS

| | | | |
|---|---|---|---|
| 2015/0044224 | A1 | 2/2015 | Soliman et al. |
| 2016/0122766 | A1 | 5/2016 | Wucherpfennig et al. |
| 2018/0265594 | A1* | 9/2018 | Horowitz ............... C07K 16/18 |
| 2019/0022245 | A1* | 1/2019 | Roffler ................... C07K 16/32 |
| 2019/0046611 | A1 | 2/2019 | Ali et al. |

FOREIGN PATENT DOCUMENTS

| | | | |
|---|---|---|---|
| CN | 103890587 | A | 6/2014 |
| JP | 2018-534236 | A | 11/2018 |
| WO | WO-2010/065944 | A1 | 6/2010 |
| WO | WO-2011/154705 | A1 | 12/2011 |
| WO | WO2017189964 | * | 11/2012 |
| WO | WO-2016/126488 | A1 | 8/2016 |
| WO | WO2016126488 | * | 8/2016 |
| WO | WO-2017/027685 | A2 | 2/2017 |
| WO | 2017/189964 | A2 | 11/2017 |
| WO | WO-2018/146230 | A1 | 8/2018 |
| WO | WO-2018/217940 | A2 | 11/2018 |
| WO | WO-2019/079762 | A1 | 4/2019 |

OTHER PUBLICATIONS

Bolotin et al., Antigen receptor repertoire profiling from RNA-seq data, Nature Biotechnology, 35(10):908-911 (2017).

(Continued)

*Primary Examiner* — Lei Yao
(74) *Attorney, Agent, or Firm* — MARSHALL, GERSTEIN & BORUN LLP

(57) ABSTRACT

The disclosure herein relates to novel cancer-associated antibodies and antigen-binding fragments that are used in the diagnosis of a cancer or a metastasis thereof. The disclosure herein relates to novel cancer-associated antibodies and antigen-binding fragments that are used in the treatment of a cancer or a metastasis thereof. The disclosure herein relates to novel chimeric antigen receptor or a T cell receptor fusion protein that comprise one or more cancer-associated antigen-binding domains that are useful for the treatment of a cancer.

9 Claims, 204 Drawing Sheets
Specification includes a Sequence Listing.

(56) References Cited

OTHER PUBLICATIONS

Bolotin et al., MIXCR: software for comprehensive adaptive immunity profiling, Nature Methods, 12(5):380-1 (2015).

Chao et al., Entropy and the species accumulation curve: a novel entropy estimator via discovery rates of new species, Methods in Ecology and Evolution, 4:1091-1100 (2013).

Heiden et al., pRESTO: a toolkit for processing high-throughput sequencing raw reads of lymphocyte receptor repertoires, Bioinformatics, 30(13):1930-1932 (2014).

MacArthur, Patterns of Species Diversity, Biological reviews, 40(4):510-533 (1965).

Safanova et al., IgRepertoireConstructor: a novel algorithm for antibody repertoire construction and immunoproteogenomics analysis, Bioinformatics, 31(12):i53-i61 (2015).

Shugay et al., VDJtools: Unifying Post-analysis of T Cell Receptor Repertoires, PLoS Computational Biology, 11(11):e1004503 (2015).

Stubbington et al., T cell fate and clonality inference from single cell transcriptomes, Nat Methods., 13(4):329-332, (2016).

Ye et al., IgBLAST: an immunoglobulin variable domain sequence analysis tool, Nucleic Acids Research, 41(Web Server issue):W34-40 (2013).

Gjerstoff et al., Restriction of GAGE protein expression to subpopulations of cancer cells is independent of genotype and may limit the use of GAGE proteins as targets for cancer immunotherapy, British J. Cancer, 94: 1864-1873, (2006).

Zhao et al., Abstract 3625: Tumor-specific human monoclonal antibodies isolated from cancer patients, Cancer Res., 74: 3625, (Oct. 2014).

Wake, Antibody medicine, J. Okayama Medical Assoc., 121(2): 119-122, (2009).

\* cited by examiner

SEQ ID NO: 4539 --IGHV2-5*00--
TGGACCCTGTGGACACAGCCACATATTACTGTGCACACAGAC
                ||||||||||||||||||||||||||
SEQ ID NO: 4540 TGGACCCTGTGGACACAGCCACATATTTTGTGCACACAAGAAGAACCTTCAGTATTCCGAATGGTTCGACCCCTGGGGCCAGGGCACCCTGG
                                              ||||||||||||||||||||||||||||||||||||||||||||||||||||||||||||
                                              ACAACTGGTTCGACTCCTGGGGCCAAGGAACCCTGGTCACCGTCTCCTCAG SEQ ID NO: 4541
                                                                                                --IGHJ5*00--

FIG. 7

| Name | Heavy V | Heavy D | Heavy J | Light V | Light J |
|---|---|---|---|---|---|
| TBLA1001 | 0.089 | 0.091 | 0.021 | 0.06 | 0 |
| TBLA1002 | 0.007 | 0 | 0.021 | 0.007 | 0 |
| TBLA1003 | 0.034 | 0 | 0 | 0.053 | 0.029 |
| TBLA1004 | 0 | 0 | 0 | 0.01 | 0 |
| TBLA1005 | 0.044 | 0 | 0.041 | 0.039 | 0.054 |
| TBLA1006 | 0.038 | 0 | 0.016 | 0.066 | 0 |
| TBLA1007 | 0.058 | 0 | 0.021 | 0.042 | 0 |
| TBLA1008 | 0.014 | 0 | 0 | 0.003 | 0 |
| TBLA1009 | 0.058 | 0.067 | 0 | 0.041 | 0.031 |
| TBLA1010 | 0.058 | 0 | 0.047 | 0.038 | 0.054 |
| TBLA1011 | 0.077 | 0 | 0.044 | 0.041 | 0.03 |
| TBLA1012 | 0.089 | 0 | 0 | 0.01 | 0.086 |
| TBLA1013 | 0.099 | 0 | 0.067 | 0.058 | 0.094 |
| TBRE1001 | 0.039 | 0.071 | 0.025 | 0.041 | 0.03 |
| TBRE1002 | 0.091 | 0 | 0.045 | 0.046 | 0.081 |
| TBRE1003 | 0.027 | 0 | 0.04 | 0.007 | 0 |
| TBRE1004 | 0.02 | 0.091 | 0 | 0.01 | 0.029 |
| TBRE1005 | 0.037 | 0 | 0.016 | 0 | 0 |
| TBRE1006 | 0.027 | 0.105 | 0.042 | 0.011 | 0 |
| TBRE1007 | 0.105 | 0.091 | 0 | 0.042 | 0 |
| TBRE1008 | 0.027 | 0 | 0.044 | 0.003 | 0 |
| TBRE1009 | 0.082 | 0 | 0 | 0.071 | 0.056 |
| TBRE1010 | 0.014 | 0 | 0.023 | 0.014 | 0 |
| TBRE1011 | 0.076 | 0 | 0 | 0.044 | 0 |

FIG. 10A

| Name | Heavy V | Heavy D | Heavy J | Light V | Light J |
|---|---|---|---|---|---|
| TBRE1012 | 0.054 | 0 | 0 | 0.046 | 0.054 |
| TBRE1013 | 0.071 | 0.091 | 0.024 | 0.07 | 0.029 |
| TBRE1014 | 0.065 | 0 | 0.021 | 0.023 | 0 |
| TBRE1015 | 0.02 | 0 | 0.022 | 0.017 | 0.027 |
| TBRE1016 | 0.048 | 0 | 0.06 | 0.035 | 0 |
| TBRE1017 | 0.062 | 0 | 0.061 | 0.07 | 0.028 |
| TBRE1018 | 0.074 | 0 | 0.022 | 0.037 | 0 |
| TBRE1019 | 0.047 | 0 | 0 | 0.027 | 0 |
| TBRE1020 | 0.027 | 0 | 0 | 0 | 0 |
| TBRE1021 | 0.023 | 0 | 0.057 | 0.011 | 0 |
| TBRE1022 | 0.075 | 0.1 | 0.024 | 0.044 | 0.057 |
| TBRE1023 | 0 | 0 | 0 | 0 | 0 |
| TBRE1024 | 0.034 | 0 | 0.047 | 0.027 | 0 |
| TBRE1025 | 0.034 | 0.067 | 0.02 | 0.02 | 0.027 |
| TBRE1026 | 0.055 | 0.042 | 0 | 0.027 | 0 |
| TBRE1027 | 0.01 | 0 | 0.023 | 0.014 | 0 |
| TBRE1028 | 0 | 0 | 0 | 0.003 | 0 |
| TBRE1029 | 0 | 0 | 0 | 0.003 | 0 |
| TBRE1030 | 0 | 0 | 0 | 0 | 0 |
| TBRE1031 | 0.034 | 0 | 0.04 | 0.049 | 0.056 |
| TBRE1032 | 0.031 | 0 | 0.023 | 0.021 | 0 |
| TBRE1033 | 0.034 | 0 | 0.02 | 0.056 | 0 |
| TBRE1034 | 0.068 | 0.111 | 0.048 | 0.049 | 0 |
| TBRE1035 | 0.062 | 0 | 0.07 | 0.038 | 0.029 |

FIG. 10B

| Name | Heavy V | Heavy D | Heavy J | Light V | Light J |
|---|---|---|---|---|---|
| TBRE1036 | 0.017 | 0 | 0 | 0.007 | 0 |
| TBRE1037 | 0.057 | 0 | 0.071 | 0.031 | 0.029 |
| TBRE1038 | 0.031 | 0 | 0 | 0.018 | 0 |
| TBRE1039 | 0 | 0 | 0 | 0.003 | 0 |
| TBRE1040 | 0.017 | 0 | 0 | 0.003 | 0.026 |
| TBRE1041 | 0.041 | 0 | 0.061 | 0.023 | 0 |
| TBRE1042 | 0.003 | 0 | 0 | 0 | 0 |
| TBRE1043 | 0.051 | 0.136 | 0.022 | 0.095 | 0.086 |
| TBRE1044 | 0.085 | 0 | 0 | 0.038 | 0 |
| TBRE1045 | 0.044 | 0 | 0 | 0.038 | 0 |
| TBRE1046 | 0.037 | 0 | 0.021 | 0.024 | 0 |
| TBRE1047 | 0.03 | 0 | 0 | 0.014 | 0 |
| TBRE1048 | 0.05 | 0.083 | 0.022 | 0.059 | 0.026 |
| TBRE1049 | 0.007 | 0 | 0 | 0 | 0 |
| TBRE1050 | 0.027 | 0 | 0 | 0.007 | 0 |
| TBRE1051 | 0.03 | 0 | 0.019 | 0.027 | 0 |
| TBRE1052 | 0.048 | 0 | 0 | 0.028 | 0 |
| TBRE1053 | 0 | 0 | 0 | 0.017 | 0 |
| TBRE1054 | 0.027 | 0 | 0 | 0.01 | 0 |
| TBRE1055 | 0.082 | 0 | 0 | 0.038 | 0.028 |
| TBRE1056 | 0.094 | 0 | 0.023 | 0.031 | 0.027 |
| TBRE1057 | 0.146 | 0 | 0.073 | 0.095 | 0.029 |
| TBRE1058 | 0.108 | 0 | 0.043 | 0.07 | 0.027 |
| TCER1001 | 0 | 0.1 | 0 | 0.003 | 0 |

FIG. 10C

| Name | Heavy V | Heavy D | Heavy J | Light V | Light J |
|---|---|---|---|---|---|
| TCER1002 | 0.103 | 0 | 0.064 | 0.085 | 0.053 |
| TCER1003 | 0.041 | 0 | 0 | 0.049 | 0.026 |
| TCER1004 | 0.048 | 0 | 0.022 | 0.011 | 0 |
| TCER1005 | 0.064 | 0.067 | 0 | 0.017 | 0 |
| TCER1006 | 0.02 | 0.077 | 0.059 | 0.014 | 0 |
| TCER1007 | 0.055 | 0 | 0 | 0.028 | 0 |
| TCHO1001 | 0.109 | 0.1 | 0.058 | 0.046 | 0.026 |
| TCOL1001 | 0.137 | 0 | 0.022 | 0.049 | 0 |
| TCOL1002 | 0.157 | 0 | 0.045 | 0.077 | 0.065 |
| TCOL1003 | 0.038 | 0.1 | 0.062 | 0.02 | 0.027 |
| TCOL1004 | 0.11 | 0.091 | 0.082 | 0.045 | 0 |
| TCOL1005 | 0.093 | 0 | 0 | 0.035 | 0.028 |
| TCOL1006 | 0.102 | 0 | 0.02 | 0.092 | 0.079 |
| TCOL1007 | 0.054 | | 0 | 0.013 | 0 |
| TCOL1008 | 0.01 | 0 | 0 | 0 | 0 |
| TCOL1009 | 0.089 | 0 | 0.041 | 0.067 | 0 |
| TESO1001 | 0.095 | 0 | 0.089 | 0.024 | 0 |
| TESO1002 | 0.003 | 0.091 | 0.042 | 0.007 | 0.026 |
| TESO1003 | 0.03 | 0 | 0.017 | 0.007 | 0.026 |
| TESO1004 | 0.074 | 0 | 0.023 | 0.027 | 0.026 |
| TESO1005 | 0.037 | 0 | 0 | 0.039 | 0 |
| TESO1006 | 0.064 | 0 | 0.045 | 0.048 | 0.029 |
| TESO1007 | 0.03 | 0 | 0.017 | 0.007 | 0.026 |
| THNS1001 | 0.112 | 0 | 0.068 | 0.084 | 0 |

FIG. 10D

| Name | Heavy V | Heavy D | Heavy J | Light V | Light J |
|---|---|---|---|---|---|
| THNS1002 | 0.091 | 0 | 0.073 | 0.027 | 0 |
| THNS1003 | 0.01 | 0 | 0 | 0 | 0 |
| THNS1004 | 0.02 | 0 | 0 | 0.014 | 0.026 |
| THNS1005 | 0 | 0 | 0 | 0.014 | 0 |
| THNS1006 | 0.017 | 0 | 0.021 | 0.003 | 0 |
| THNS1007 | 0.041 | 0 | 0 | 0.028 | 0.028 |
| THNS1008 | 0.044 | 0 | 0 | 0.018 | 0 |
| THNS1009 | 0.014 | 0 | 0 | 0.021 | 0 |
| THNS1010 | 0.072 | 0.143 | 0.023 | 0.043 | 0.026 |
| THNS1011 | 0.003 | 0 | 0 | 0.004 | 0 |
| THNS1012 | 0.003 | 0.143 | 0.02 | 0.023 | 0 |
| THNS1013 | 0.048 | 0.1 | 0.064 | 0.042 | 0 |
| THNS1014 | 0.066 | 0 | 0.028 | 0.061 | 0.053 |
| TKIC1001 | 0.036 | 0 | 0.024 | 0.037 | 0 |
| TKIC1002 | 0.014 | 0 | 0.022 | 0.021 | 0 |
| TKIC1003 | 0 | 0.167 | 0 | 0.007 | 0 |
| TKIC1004 | 0 | 0 | 0 | 0 | 0 |
| TKIC1005 | 0.062 | 0.1 | 0 | 0.024 | 0 |
| TKIC1006 | 0.041 | 0 | 0 | 0.034 | 0 |
| TKIC1007 | 0.058 | 0 | 0.042 | 0.047 | 0.029 |
| TKIC1008 | 0.061 | 0.071 | 0.019 | 0.055 | 0.026 |
| TKIC1009 | 0.047 | 0 | 0 | 0.038 | 0 |
| TKIC1010 | 0.071 | 0 | 0.02 | 0.075 | 0.057 |
| TKIC1011 | 0.078 | 0 | 0.048 | 0.084 | 0.029 |

FIG. 10E

| Name | Heavy V | Heavy D | Heavy J | Light V | Light J |
|---|---|---|---|---|---|
| TKIC1012 | 0.031 | 0 | 0.023 | 0.032 | 0.053 |
| TKIC1013 | 0.051 | 0 | 0.043 | 0.039 | 0 |
| TKIC1014 | 0.089 | 0 | 0.083 | 0.063 | 0.029 |
| TKIC1015 | 0.073 | 0.1 | 0.093 | 0.018 | 0 |
| TKIC1016 | 0.003 | 0 | 0 | 0.003 | 0 |
| TKIC1017 | 0.064 | 0 | 0.047 | 0.044 | 0.028 |
| TKIC1018 | 0.061 | 0 | 0 | 0.039 | 0 |
| TKIC1019 | 0.084 | 0 | 0.075 | 0.05 | 0.032 |
| TKIC1020 | 0.14 | 0 | 0.065 | 0.118 | 0.051 |
| TKIP1001 | 0.089 | 0.217 | 0.041 | 0.081 | 0 |
| TKIP1002 | 0 | 0 | 0 | 0.007 | 0 |
| TKIP1003 | 0.04 | 0.091 | 0 | 0.042 | 0 |
| TKIP1004 | 0.007 | 0 | 0 | 0.004 | 0.029 |
| TKIP1005 | 0.057 | 0 | 0 | 0.025 | 0.028 |
| TKIP1006 | 0.061 | 0 | 0.023 | 0.06 | 0 |
| TLGG1001 | 0.034 | 0 | 0.022 | 0.035 | 0 |
| TLIV1001 | 0.041 | 0 | 0 | 0.021 | 0.053 |
| TLIV1002 | 0.051 | 0 | 0.024 | 0.027 | 0.056 |
| TLIV1003 | 0.054 | 0 | 0 | 0.007 | 0.029 |
| TLIV1004 | 0.078 | 0 | 0.057 | 0.038 | 0 |
| TLUA1001 | 0.092 | 0 | 0.1 | 0.042 | 0 |
| TLUA1002 | 0.03 | 0 | 0.021 | 0.003 | 0 |
| TLUA1003 | 0.027 | 0 | 0.067 | 0.027 | 0 |
| TLUA1004 | 0.122 | 0.111 | 0.07 | 0.074 | 0.135 |

FIG. 10F

| Name | Heavy V | Heavy D | Heavy J | Light V | Light J |
|---|---|---|---|---|---|
| TLUA1005 | 0.099 | 0 | 0.047 | 0.035 | 0.029 |
| TLUA1006 | 0.114 |  | 0.062 | 0.043 | 0.028 |
| TLUA1007 | 0.059 | 0 | 0 | 0.062 | 0.056 |
| TLUA1008 | 0.047 | 0 | 0 | 0.038 | 0 |
| TLUA1009 | 0.079 | 0.1 | 0.031 | 0.033 | 0 |
| TLUA1010 | 0.105 | 0 | 0.051 | 0.07 | 0.027 |
| TLUA1011 | 0.041 |  | 0.053 | 0.02 | 0.057 |
| TLUA1012 | 0.03 | 0 | 0 | 0.007 | 0 |
| TLUA1013 | 0.095 | 0 | 0.089 | 0.063 | 0 |
| TLUA1014 | 0.061 | 0.077 | 0.048 | 0.045 | 0 |
| TLUA1015 | 0.092 | 0 | 0.021 | 0.003 | 0 |
| TLUA1016 | 0.068 | 0 | 0.021 | 0.037 | 0.057 |
| TLUA1017 | 0.088 | 0.077 | 0.083 | 0.092 | 0 |
| TLUA1018 | 0.109 | 0 | 0.083 | 0.116 | 0.028 |
| TLUS1001 | 0.01 | 0 | 0 | 0.007 | 0 |
| TLUS1002 | 0.034 | 0 | 0 | 0.017 | 0 |
| TLUS1003 | 0.099 | 0 | 0 | 0.057 | 0 |
| TLUS1004 | 0.043 | 0 | 0.022 | 0.031 | 0 |
| TLUS1005 | 0.061 | 0 | 0 | 0.032 | 0.028 |
| TLUS1006 | 0.078 | 0 | 0 | 0.066 | 0 |
| TLUS1007 | 0.075 | 0.143 | 0.065 | 0.069 | 0.053 |
| TLUS1008 | 0.067 | 0 | 0.023 | 0.043 | 0 |
| TLUS1009 | 0.08 | 0 | 0.045 | 0.063 | 0.053 |
| TLUS1010 | 0.068 | 0 | 0 | 0.041 | 0.028 |

FIG. 10G

| Name | Heavy V | Heavy D | Heavy J | Light V | Light J |
|---|---|---|---|---|---|
| TLUS1011 | 0.031 | 0 | 0 | 0.01 | 0 |
| TMEL1015 | 0.065 | 0 | 0.074 | 0.051 | 0 |
| TMEL1016 | 0.01 | 0 | 0 | 0.017 | 0 |
| TMEL1017 | 0.007 | 0 | 0 | 0 | 0 |
| TMEL1018 | 0.003 | 0 | 0 | 0 | 0 |
| TMEL1019 | 0.003 | 0.034 | 0 | 0.007 | 0 |
| TMEL1020 | 0.061 | 0 | 0.029 | 0.087 | 0 |
| TMEL1021 | 0.088 | 0.091 | 0.06 | 0.037 | 0.029 |
| TMEL1022 | 0.109 | 0 | 0.087 | 0.088 | 0 |
| TMEL1023 | 0.047 | 0.071 | 0 | 0.031 | 0 |
| TMEL1024 | 0.014 | | 0 | 0.014 | 0 |
| TMEL1025 | 0.102 | 0 | 0.027 | 0.04 | 0 |
| TMEL1026 | 0.007 | 0 | 0 | 0 | 0 |
| TMEL1027 | 0.014 | 0 | 0 | 0.003 | 0 |
| TMEL1028 | 0.003 | 0 | 0 | 0.004 | 0.029 |
| TMEL1029 | 0.066 | 0 | 0.022 | 0.045 | 0.029 |
| TMEL1030 | 0.034 | 0 | 0 | 0.025 | 0.029 |
| TMEL1031 | 0.014 | 0 | 0 | 0.004 | 0 |
| TMEL1032 | 0.068 | 0 | 0 | 0.017 | 0 |
| TMEL1033 | 0 | 0 | 0 | 0 | 0 |
| TMEL1034 | 0.043 | 0 | 0 | 0.011 | 0 |
| TMEL1035 | 0 | 0 | 0.023 | 0 | 0 |
| TMEL1036 | 0.044 | 0.071 | 0 | 0.013 | 0 |
| TMEL1037 | 0.01 | 0.091 | 0 | 0.013 | 0 |

FIG. 10H

| Name | Heavy V | Heavy D | Heavy J | Light V | Light J |
|---|---|---|---|---|---|
| TMEL1038 | 0.014 | 0.167 | 0 | 0.014 | 0 |
| TMEL1039 | 0.051 | 0 | 0.024 | 0.026 | 0.026 |
| TMEL1040 | 0.024 | 0 | 0.047 | 0 | 0 |
| TMEL1041 | 0.048 | 0.083 | 0 | 0.028 | 0 |
| TMES1001 | 0.007 | 0 | 0 | 0.004 | 0 |
| TMES1002 | 0.106 | 0.1 | 0.028 | 0.017 | 0 |
| TMES1003 | 0.024 | 0 | 0 | 0.017 | 0 |
| TMES1004 | 0.125 | 0 | 0.025 | 0.066 | 0.081 |
| TOVA1001 | 0.02 | | 0 | 0.01 | 0 |
| TOVA1002 | 0.027 | 0.071 | 0 | 0.017 | 0 |
| TOVA1003 | 0.092 | 0 | 0.047 | 0.095 | 0.074 |
| TOVA1004 | 0 | 0 | 0 | 0 | 0 |
| TOVA1005 | 0.034 | 0 | 0 | 0.031 | 0.026 |
| TOVA1006 | 0.033 | 0.077 | 0 | 0.007 | 0.054 |
| TOVA1007 | 0.057 | 0 | 0 | 0.014 | 0.027 |
| TOVA1008 | 0.014 | 0.037 | 0.019 | 0.024 | 0 |
| TPAN1001 | 0.061 | 0 | 0.036 | 0.045 | 0.026 |
| TPAN1002 | 0.081 | 0 | 0.023 | 0.031 | 0.083 |
| TPAN1003 | 0.085 | 0 | 0 | 0.066 | 0.053 |
| TPAN1004 | 0.081 | 0 | 0.087 | 0.031 | 0 |
| TPAN1005 | 0.092 | 0.062 | 0.042 | 0.071 | 0 |
| TPAN1006 | 0.044 | 0 | 0 | 0.047 | 0.053 |
| TPAN1007 | 0.059 | 0 | 0 | 0.034 | 0 |
| TPHE1001 | 0.086 | 0 | 0.024 | 0.056 | 0.027 |

FIG. 10I

| Name | Heavy V | Heavy D | Heavy J | Light V | Light J |
|---|---|---|---|---|---|
| TPRO1001 | 0.007 | 0 | 0 | 0.007 | 0.029 |
| TPRO1002 | 0.088 | 0 | 0 | 0.044 | 0 |
| TPRO1003 | 0.096 | 0 | 0.071 | 0.02 | 0 |
| TREC1001 | 0.081 | 0 | 0.036 | 0.038 | 0.056 |
| TREC1002 | 0.026 | 0.1 | 0.028 | 0.056 | 0 |
| TREC1003 | 0.156 | 0 | 0 | 0.047 | 0 |
| TSAR1001 | 0.139 | 0.111 | 0.094 | 0.077 | 0.028 |
| TSAR1002 | 0 | 0 | 0 | 0.003 | 0 |
| TSAR1003 | 0.043 | 0.067 | 0 | 0.045 | 0.028 |
| TSAR1004 | 0.083 | 0 | 0.028 | 0.056 | 0 |
| TSAR1005 | 0.054 | 0 | 0 | 0.023 | 0 |
| TSAR1006 | 0.091 | 0 | 0.022 | 0.06 | 0.027 |
| TSAR1007 | 0.003 | 0 | 0 | 0 | 0 |
| TSAR1008 | 0.027 | 0 | 0 | 0.024 | 0.056 |
| TSTO1001 | 0.069 | 0.133 | 0.043 | 0.042 | 0 |
| TSTO1002 | 0.023 | 0 | 0.025 | 0.017 | 0.029 |
| TSTO1003 | 0.089 | 0 | 0 | 0.069 | 0 |
| TSTO1004 | 0.128 | 0 | 0.023 | 0.114 | 0.029 |
| TSTO1005 | 0.092 | 0 | 0 | 0.03 | 0.059 |
| TSTO1006 | 0.03 | 0 | 0 | 0.025 | 0 |
| TSTO1007 | 0.12 | 0 | 0.071 | 0.113 | 0.027 |
| TSTO1008 | 0.048 | 0.083 | 0.045 | 0.048 | 0.105 |
| TSTO1009 | 0.033 | 0 | 0.041 | 0.064 | 0.03 |
| TSTO1010 | 0.078 | 0.083 | 0.068 | 0.023 | 0 |

FIG. 10J

| Name | Heavy V | Heavy D | Heavy J | Light V | Light J |
|---|---|---|---|---|---|
| TTES1001 | 0.089 | 0 | 0.085 | 0.023 | 0 |
| TTES1002 | 0.064 | 0 | 0.054 | 0.054 | 0.056 |
| TTES1003 | 0 | 0 | 0 | 0 | 0 |
| TTES1004 | 0.017 | 0 | 0.023 | 0 | 0 |
| TTES1005 | 0.074 | 0 | 0.022 | 0.024 | 0 |
| TTES1006 | 0.068 | 0 | 0.025 | 0.046 | 0 |
| TTES1007 | 0.017 | 0 | 0 | 0 | 0 |
| TTES1008 | 0.01 | 0 | 0.023 | 0.003 | 0 |
| TTES1009 | 0 | 0 | 0 | 0 | 0 |
| TTES1010 | 0 | 0 | 0 | 0 | 0 |
| TTES1011 | 0 | 0 | 0 | 0 | 0 |
| TTES1012 | 0.017 | 0 | 0 | 0.007 | 0 |
| TTHY1001 | 0.153 | 0 | 0.083 | 0.095 | 0.095 |
| TTHY1002 | 0.017 | 0 | 0 | 0.011 | 0 |
| TTHY1003 | 0.081 | 0 | 0 | 0.014 | 0 |
| TTHY1004 | 0.017 | 0 | 0 | 0.032 | 0.026 |
| TUCE1001 | 0.01 | 0 | 0 | 0.003 | 0 |
| TUCE1002 | 0.003 | 0 | 0 | 0.01 | 0 |
| TUCE1003 | 0.068 | 0 | 0 | 0.051 | 0 |
| TUCE1004 | 0.047 | 0 | 0 | 0.01 | 0 |
| TUCE1005 | 0.014 | 0 | 0.047 | 0 | 0 |
| TUCE1006 | 0.089 | 0 | 0.071 | 0.064 | 0.029 |
| TUCE1007 | 0.037 | 0 | 0 | 0.017 | 0 |
| TUCE1008 | 0.069 | 0 | 0 | 0.031 | 0.028 |

FIG. 10K

| Name | Heavy V | Heavy D | Heavy J | Light V | Light J |
|---|---|---|---|---|---|
| TUCE1009 | 0.003 | | | 0.003 | 0 |
| TUCE1010 | 0 | 0 | | 0 | 0 |
| TUCS1001 | 0.069 | 0.083 | 0.051 | 0.02 | 0 |
| TUCS1002 | 0.007 | 0 | 0 | 0.023 | 0 |
| TUCS1003 | 0.02 | 0.091 | 0.02 | 0.02 | 0 |
| TUVM1001 | 0.031 | 0.111 | 0 | 0.028 | 0.03 |
| TUVM1002 | 0.014 | 0 | 0 | 0 | 0 |

FIG. 10L

CANCER ASSOCIATED ANTIBODY COMPOSITIONS AND METHODS OF USE

CROSS-REFERENCE

This application claims the benefit of U.S. Provisional Application No. 62/840,638, filed Apr. 30, 2019, U.S. Provisional Application No. 62/840,640, filed Apr. 30, 2019, U.S. Provisional Application No. 62/840,644, filed Apr. 30, 2019, U.S. Provisional Application No. 62/840,648, filed Apr. 30, 2019, U.S. Provisional Application No. 62/840,855, filed Apr. 30, 2019, U.S. Provisional Application No. 62/840,858, filed Apr. 30, 2019, U.S. Provisional Application No. 62/840,860, filed Apr. 30, 2019, U.S. Provisional Application No. 62/840,861, filed Apr. 30, 2019, U.S. Provisional Application No. 62/840,864, filed Apr. 30, 2019, U.S. Provisional Application No. 62/840,870, filed Apr. 30, 2019, U.S. Provisional Application No. 62/840,875, filed Apr. 30, 2019, U.S. Provisional Application No. 62/840,880, filed Apr. 30, 2019, U.S. Provisional Application No. 62/840,893, filed Apr. 30, 2019, U.S. Provisional Application No. 62/840,904, filed Apr. 30, 2019, U.S. Provisional Application No. 62/840,909, filed Apr. 30, 2019, U.S. Provisional Application No. 62/840,917, filed Apr. 30, 2019, U.S. Provisional Application No. 62/840,938, filed Apr. 30, 2019, U.S. Provisional Application No. 62/840,950, filed Apr. 30, 2019, U.S. Provisional Application No. 62/840,957, filed Apr. 30, 2019, U.S. Provisional Application No. 62/840,970, filed Apr. 30, 2019, U.S. Provisional Application No. 62/841,036, filed Apr. 30, 2019, U.S. Provisional Application No. 62/841,044, filed Apr. 30, 2019, U.S. Provisional Application No. 62/841,047, filed Apr. 30, 2019, and U.S. Provisional Application No. 62/841,049, filed Apr. 30, 2019; each of which application is incorporated herein by reference in their entirety.

REFERENCE TO A SEQUENCE LISTING

The present application includes a Sequence Listing which has been submitted electronically in ASCII format and is hereby incorporated by reference in its entirety. Said ASCII copy, created on Jul. 3, 2024, is named 57299SubSeqListing.txt and is 4,392,996 bytes in size.

BACKGROUND OF THE INVENTION

While the role of cytotoxic T cells in mediating immune responses against cancer is well established, the role of B cells is less known. In particular, the effect of antibodies identified in cancer patients is still unclear: while some studies suggested that such antibodies might promote tumor progression, others have reported that they might stimulate anti-tumor immunity.

SUMMARY OF THE INVENTION

In one aspect, provided herein is an antibody or antigen-binding fragment thereof that comprises at least one of a variable heavy chain complementarity-determining region 1 (CDR-H1), a CDR-H2 and a CDR-H3, wherein: the CDR-H1 comprises a reconstructed polypeptide consensus sequence selected from any one of SEQ ID NOs: 543-813, the CDR-H2 comprises a reconstructed polypeptide consensus sequence selected from any one of SEQ ID NOs: 1085-1355, and the CDR-H3 comprises a reconstructed polypeptide consensus sequence selected from any one of SEQ ID NOs: 1627-1897.

In one aspect provided herein is an antibody or antigen-binding fragment thereof that comprises at least one of a variable light chain complementarity-determining region 1 (CDR-L1), a CDR-L2 and a CDR-L3, wherein: the CDR-L1 comprises a reconstructed polypeptide consensus sequence selected from any one of SEQ ID NOs: 814-1084, the CDR-L2 comprises a reconstructed polypeptide consensus sequence selected from any one of SEQ ID NOs: 1356-1626, and the CDR-L3 comprises a reconstructed polypeptide consensus sequence selected from any one of SEQ ID NOs: 1898-2168.

In one aspect provided herein is an antibody or antigen-binding fragment thereof that comprises: a variable heavy chain complementarity-determining region 1 (CDR-H1), a CDR-H2 and a CDR-H3, wherein: the CDR-H1 comprises a reconstructed polypeptide consensus sequence selected from any one of SEQ ID NOs: 543-813, the CDR-H2 comprises a reconstructed polypeptide consensus sequence selected from any one of SEQ ID NOs: 1085-1355, and the CDR-H3 comprises a reconstructed polypeptide consensus sequence selected from any one of SEQ ID NOs: 1627-1897; and a variable light chain complementarity-determining region 1 (CDR-L1), a CDR-L2, and a CDR-L3, wherein: the CDR-L1 comprises a reconstructed polypeptide consensus sequence selected from any one of SEQ ID NOs: 814-1084, the CDR-L2 comprises a reconstructed polypeptide consensus sequence selected from any one of SEQ ID NOs: 1356-1626, and the CDR-L3 comprises a reconstructed polypeptide consensus sequence selected from any one of SEQ ID NOs: 1898-2168.

In some embodiments, the antibody comprises an IgG, IgA, or IgM antibody. In some embodiments, the IgG comprises IgG1, IgG2, IgG3, IgG4, IgGA1, or IgGA2. In some embodiments, the antibody comprises a chimeric antibody, a humanized antibody, a human antibody, a monoclonal antibody, a deimmunized antibody, a bispecific antibody, a multispecific antibody, a multivalent antibody, or a combination thereof. In some embodiments, the antigen-binding fragment comprises a Fab, Fab', Fab'-SH, Fv, scFv, F(ab')2, a diabody, a linear antibody, a single domain antibodies (sdAb), a camelid VHH domain, or a multi-specific antibody formed from antibody fragments. In some embodiments, the antibody or antigen-binding fragment thereof is recombinant or synthetic. In some embodiments, the antibody or antigen-binding fragment thereof further comprises an enzyme, a substrate, cofactor, a fluorescent marker, a chemiluminescent marker, a peptide tag, a magnetic particle, a drug, a toxin, or a combination thereof. In some embodiments, the antibody or antigen-binding fragment thereof is cytolytic to a tumor cell or a cancer cell. In some embodiments, the antibody or antigen-binding fragment thereof inhibits tumor growth or cancer cell growth.

In some embodiments, the antibody or an antigen-binding fragment thereof is useful for treating a cancer. In some embodiments, the antibody or antigen-binding fragment thereof of aspect above is useful for treating a bladder cancer, (e.g., bladder urothelial carcinoma, squamous cell carcinoma of the bladder, adenocarcinoma of the bladder, or small cell carcinoma of the bladder), a brain cancer, (e.g., glioma, meningioma pituitary adenoma, vestibular schwannoma, nerve sheath tumor, primitive neuroectodermal tumor (medulloblastoma), ependymomas, astrocytomas, oligodendrogliomas, brainstem glioma, optic nerve glioma, mixed glioma (e.g., oligoastrocytoma), high-grade glioma, or low-grade glioma), a breast cancer or breast carcinoma, (e.g., invasive ductal carcinoma, ductal carcinoma in situ, invasive lobular carcinoma, lobular carcinoma in situ, inflammatory breast cancer, male breast cancer, phyllodes tumors of the breast, Paget's disease of the nipple, Angiosarcomas, or metastatic breast cancer), a cervical cancer (cervical squamous cell carcinoma, adenocarcinoma, adenosquamous carcinoma, small cell carcinoma, neuroendocrine tumor, glassy cell carcinoma, villoglandular adenocarcinoma, endocervical (NOS) type adenocarcinoma, mucinous adenocarcinoma, minimal deviation adenocarcinoma (mucinous and endometrioid types), enteric/GI type adenocarcinoma, endometrioid type adenocarcinoma, clear cell adenocarcinoma, serous adenocarcinoma, mesonephric adenocarcinoma, adenoid basal carcinoma, or adenoid cystic carcinoma), a cholangiocarcinoma (e.g., intrahepatic cholangiocarcinoma, hilar cholangiocarcinoma, or distal cholangiocarcinoma), a colon or rectal cancer (e.g., colon adenocarcinoma, rectal adenocarcinoma, gastrointestinal carcinoid tumors, primary colorectal lymphomas, gastrointestinal stromal tumors, leiomyosarcomas, melanoma, sarcoma, Turcot syndrome, Peutz-Jeghers syndrome, familial colorectal cancer, or juvenile polyposis coli), an esophageal cancer (e.g., esophageal cancer is squamous cell carcinoma, adenocarcinoma, choriocarcinoma, lymphoma, melanoma, or sarcoma), a head or neck squamous cell cancer (e.g., conventional type squamous cell carcinoma, verrucous carcinoma, basaloid squamous cell carcinoma, papillary squamous cell carcinoma, spindle cell carcinoma, acantholytic squamous cell carcinoma, adenosquamous carcinoma, carcinoma cuniculatum, nasopharyngeal carcinoma, lymphoepithelial carcinoma, laryngeal or hypopharyngeal cancer, nasal cavity or paranasal sinus cancer, nasopharyngeal cancer, oral and oropharyngeal cancer, salivary gland cancer, HPV-negative squamous cell carcinoma, or HPV-induced squamous cell carcinoma), a kidney cancer (e.g., renal cell carcinoma, renal pelvis carcinoma, transitional cell carcinoma, squamous cell carcinoma, juxtaglomerular cell tumor (reninoma), angiomyolipoma, bellini duct carcinoma, clear cell sarcoma of the kidney, mesoblastic nephroma, Wilms' tumor, mixed epithelial stromal tumor, clear cell adenocarcinoma, inverted papilloma, renal lymphoma, teratoma, carcinosarcoma, carcinoid tumor of the renal pelvis, kidney renal clear cell carcinoma, kidney renal papillary cell carcinoma sarcomotoid renal cell carcinoma, chromophobe renal cell carcinoma, renal medullary carcinoma, collecting duct renal cell carcinoma, unclassified renal cell carcinoma, renal oncocytoma, angiomyolipoma, or clear cell papillary carcinoma), a liver cancer (e.g., hepatocellular carcinoma, fibrolamellar hepatocellular carcinoma, cholangiocarcinoma, mucinous cystic neoplasm, intraductal papillary biliary neoplasm, hepatoblastoma, cholangiocellular cystadenocarcinoma, angiosarcoma, hemangioendothelioma, embryonal sarcoma, fibrosarcoma, leiomyosarcoma, rhabdomyosarcoma, carcinosarcomas, teratomas, yolk sac tumours, carcinoid tumours, lymphomas, or liver metastasis), a lung cancer (e.g., non-small cell lung carcinoma, small-cell lung carcinoma, lung adenocarcinoma, lung squamous cell carcinoma, large cell carcinoma, carcinoid tumors, bronchial gland carcinoma, carcinosarcoma, pulmonary blastoma, giant or spindle cell carcinoma, or sarcomatoid carcinoma), a mesothelioma (e.g., malignant mesothelioma, or malignant pleural mesothelioma), a cystadenocarcinoma (e.g., ovarian serous cystadenocarcinoma) an adenocarcinoma (e.g., pancreatic adenocarincoma), a pheochromocytoma or paraganglioma, a prostate adenocarcinoma, a sarcoma, a skin cutaneous melanoma, a stomach adenocarcinoma, a testicular germ cell cancer, a thyroid carcinoma, a uterine cancer (e.g., uterine carcinosarcoma, or uterine corpus endometrial carcinoma), a uveal melanoma.

In one aspect provided herein is an antibody or antigen-binding fragment thereof comprising: a variable heavy chain, wherein the variable heavy chain comprises a reconstructed polypeptide consensus sequence having at least 95% sequence identity to an amino acid sequence selected from any one of SEQ ID NOs: 1-271; and/or a variable light chain, wherein the variable light chain comprises a reconstructed polypeptide consensus sequence having at least 95% sequence identity to an amino acid sequence selected from any one of SEQ ID NOs: 272-542.

In one aspect provided herein is a hybridoma that produces the antibody or antigen-binding fragment thereof of any one of aspects above.

Provided herein is a fusion protein that comprises the antibody or antigen-binding fragment thereof of any one of aspects above.

Provided herein is a chimeric antigen receptor or a T cell receptor fusion protein that comprises: an antigen-binding fragment of any one of aspects above; a transmembrane domain; and an intracellular signaling domain.

Provided herein is a T cell receptor fusion protein that comprises: the antibody or antigen-binding fragment thereof of any one of aspects above; and a T cell receptor (TCR) subunit. In some embodiments, the antibody or antigen binding fragment thereof comprises a human or humanized anti-cancer antigen binding domain. In some embodiments, the TCR subunit comprises; at least a portion of a TCR extracellular domain, a transmembrane domain; and a TCR intracellular domain comprising a stimulatory domain from an intracellular signaling domain. In some embodiments, the extracellular, transmembrane, and intracellular signaling domains of the TCR subunit are either derived from only CD3 epsilon or only CD3 gamma. In some embodiments, the antibody or antigen-binding fragment thereof and the TCR extracellular domain are connected by a linker sequence. In some embodiments, the linker sequence comprises the sequence of (G4S)n, wherein G is glycine, S is serine, and n=1 to 4.

Provided herein is an isolated recombinant nucleic acid molecule encoding the T cell receptor fusion protein of any one of aspects above.

Provided herein is a vector that comprises the isolated recombinant nucleic acid molecule described above.

Provided herein is a host cell that comprises the isolated recombinant nucleic acid described above or the vector described above. In some embodiments, the host cell is a T cell.

Provided herein is a T cell expressing the T cell receptor fusion protein of any one of aspects above. In some embodiments, the T cell receptor fusion protein is functionally integrated with an endogenous T cell receptor. In some embodiments, the T cell is a CD8+ or CD4+ T-cell.

Provided herein is an immunoconjugate comprising the antibody or the antigen binding fragment thereof of any one of aspects above, and a therapeutic agent.

Provided herein is a pharmaceutical composition or a medicament that comprises the antibody or antigen-binding fragment thereof of any one of aspects above and a pharmaceutically acceptable carrier, excipient or diluent. In some embodiments, the pharmaceutical composition described above further comprises a second therapeutic agent. In some embodiments, the second therapeutic agent comprises a cancer chemotherapeutic agent, radiation therapy, a cytotoxic agent, another antibody, a NSAID, a corticosteroid, a dietary supplement such as an antioxidant, or a combination thereof. In some embodiments, the second therapeutic agent comprises a cancer chemotherapeutic agent. In some embodiments, the pharmaceutical composition of any one of aspects above is, formulated for administration via a subcutaneous, intravenous, intradermal, intraperitoneal, intramuscular, intracerebroventricular, intracranial, intracelial, or intracerebellar administration route. In some embodiments, the pharmaceutical composition of any one of aspects above is, in an aqueous or in a lyophilized form. In some embodiments, the pharmaceutical composition of any one of aspects above, contained in a delivery device selected from the group consisting of a syringe, a blunt tip syringe, a catheter, and an implantable pump.

Provided herein is a use of the antibody or antigen binding fragment of any one of aspects above for treating a cancer.

Provided herein is a use of the antibody or antigen binding fragment of any one of aspects above or immunoconjugate described above in the manufacture of a medicament. In some embodiments, the medicament is for treatment of a cancer.

Provided herein is a method for treating a subject suffering from a cancer, the method comprising administering to the subject a therapeutically effective amount of the antibody or antigen-binding fragment thereof of any one of aspects above. In some embodiments, the antibody or antigen-binding fragment thereof is cytolytic to a tumor cell. In some embodiments, the antibody or antigen-binding fragment thereof inhibits tumor growth.

In some embodiments, the cancer is a bladder cancer, (e.g., bladder urothelial carcinoma, squamous cell carcinoma of the bladder, adenocarcinoma of the bladder, or small cell carcinoma of the bladder), a brain cancer, (e.g., glioma, meningioma pituitary adenoma, vestibular schwannoma, nerve sheath tumor, primitive neuroectodermal tumor (medulloblastoma), ependymomas, astrocytomas, oligodendrogliomas, brainstem glioma, optic nerve glioma, mixed glioma (e.g., oligoastrocytoma), high-grade glioma, or low-grade glioma), a breast cancer or breast carcinoma, (e.g., invasive ductal carcinoma, ductal carcinoma in situ, invasive lobular carcinoma, lobular carcinoma in situ, inflammatory breast cancer, male breast cancer, phyllodes tumors of the breast, Paget's disease of the nipple, Angiosarcomas, or metastatic breast cancer), a cervical cancer (cervical squamous cell carcinoma, adenocarcinoma, adenosquamous carcinoma, small cell carcinoma, neuroendocrine tumor, glassy cell carcinoma, villoglandular adenocarcinoma, endocervical (NOS) type adenocarcinoma, mucinous adenocarcinoma, minimal deviation adenocarcinoma (mucinous and endometrioid types), enteric/GI type adenocarcinoma, endometrioid type adenocarcinoma, clear cell adenocarcinoma, serous adenocarcinoma, mesonephric adenocarcinoma, adenoid basal carcinoma, or adenoid cystic carcinoma), a cholangiocarcinoma (e.g., intrahepatic cholangiocarcinoma, hilar cholangiocarcinoma, or distal cholangiocarcinoma), a colon or rectal cancer (e.g., colon adenocarcinoma, rectal adenocarcinoma, gastrointestinal carcinoid tumors, primary colorectal lymphomas, gastrointestinal stromal tumors, leiomyosarcomas, melanoma, sarcoma, Turcot syndrome, Peutz-Jeghers syndrome, familial colorectal cancer, or juvenile polyposis coli), an esophageal cancer (e.g., esophageal cancer is squamous cell carcinoma, adenocarcinoma, choriocarcinoma, lymphoma, melanoma, or sarcoma), a head or neck squamous cell cancer (e.g., conventional type squamous cell carcinoma, verrucous carcinoma, basaloid squamous cell carcinoma, papillary squamous cell carcinoma, spindle cell carcinoma, acantholytic squamous cell carcinoma, adenosquamous carcinoma, carcinoma cuniculatum, nasopharyngeal carcinoma, lymphoepithelial carcinoma, laryngeal or hypopharyngeal cancer, nasal cavity or paranasal sinus cancer, nasopharyngeal cancer, oral and oropharyngeal cancer, salivary gland cancer, HPV-negative squamous cell carcinoma, or HPV-induced squamous cell carcinoma), a kidney cancer (e.g., renal cell carcinoma, renal pelvis carcinoma, transitional cell carcinoma, squamous cell carcinoma, juxtaglomerular cell tumor (reninoma), angiomyolipoma, bellini duct carcinoma, clear cell sarcoma of the kidney, mesoblastic nephroma, Wilms' tumor, mixed epithelial stromal tumor, clear cell adenocarcinoma, inverted papilloma, renal lymphoma, teratoma, carcinosarcoma, carcinoid tumor of the renal pelvis, kidney renal clear cell carcinoma, kidney renal papillary cell carcinoma sarcomotoid renal cell carcinoma, chromophobe renal cell carcinoma, renal medullary carcinoma, collecting duct renal cell carcinoma, unclassified renal cell carcinoma, renal oncocytoma, angiomyolipoma, or clear cell papillary carcinoma), a liver cancer (e.g., hepatocellular carcinoma, fibrolamellar hepatocellular carcinoma, cholangiocarcinoma, mucinous cystic neoplasm, intraductal papillary biliary neoplasm, hepatoblastoma, cholangiocellular cystadenocarcinoma, angiosarcoma, hemangioendothelioma, embryonal sarcoma, fibrosarcoma, leiomyosarcoma, rhabdomyosarcoma, carcinosarcomas, teratomas, yolk sac tumours, carcinoid tumours, lymphomas, or liver metastasis), a lung cancer (e.g., non-small cell lung carcinoma, small-cell lung carcinoma, lung adenocarcinoma, lung squamous cell carcinoma, large cell carcinoma, carcinoid tumors, bronchial gland carcinoma, carcinosarcoma, pulmonary blastoma, giant or spindle cell carcinoma, or sarcomatoid carcinoma), a mesothelioma (e.g., malignant mesothelioma, or malignant pleural mesothelioma), a cystadenocarcinoma (e.g., ovarian serous cystadenocarcinoma) an adenocarcinoma (e.g., pancreatic adenocarincoma), a pheochromocytoma or paraganglioma, a prostate adenocarcinoma, a sarcoma, a skin cutaneous melanoma, a stomach adenocarcinoma, a testicular germ cell cancer, a thyroid carcinoma, a uterine cancer (e.g., uterine carcinosarcoma, or uterine corpus endometrial carcinoma), a uveal melanoma.

In some embodiments, the antibody or antigen-binding fragment thereof is administered subcutaneously, intravenously, intradermally, intraperitoneally, orally, intramuscularly or intracranially. In some embodiments, the antibody or antigen-binding fragment thereof is administered to the subject in combination with a second therapeutic agent. In some embodiments, the second therapeutic agent comprises a cancer chemotherapeutic agent, radiation therapy, a cytotoxic agent, another antibody, a NSAID, a corticosteroid, a dietary supplement such as an antioxidant, or a combination thereof. In some embodiments, the anti-cancer agent is an anti-cancer antibody or a chemotherapeutic agent. In some embodiments, the second therapeutic agent is administered prior to, concurrently, or after administering the antibody or antigen binding fragment.

Provided herein is an isolated nucleic acid molecule comprising at least one of: a nucleic acid sequence encoding a CDR-H1, wherein the nucleic acid sequence is selected from SEQ ID NOs: 2711-2981; a nucleic acid sequence encoding a CDR-H2, wherein the nucleic acid sequence is selected from SEQ ID NOs: 3253-3523; a nucleic acid sequence encoding a CDR-H3, wherein the nucleic acid sequence is selected from SEQ ID NOs: 3795-4065; a nucleic acid sequence encoding a CDR-L1, wherein the nucleic acid sequence is selected from SEQ ID NOs: 2982-3252; a nucleic acid sequence encoding a CDR-L2, wherein the nucleic acid sequence is selected from SEQ ID NOs:

3524-3794; or a nucleic acid sequence encoding a CDR-L3, wherein the nucleic acid sequence is selected from SEQ ID NOs: 4066-4336.

In some embodiments, the nucleic acid sequence is selected from any one of SEQ ID NOs: 2169-2439.

Provided herein is an isolated nucleic acid molecule comprising a nucleic acid sequence encoding a light chain polypeptide of an antibody, wherein the nucleic acid sequence is selected from any one of SEQ ID NOs: 2440-2710.

Provided herein is a vector comprising the isolated nucleic acid molecule of any one of aspects above The vector described herein wherein the isolated nucleic acid is operably linked to a regulatory control sequence.

Provided herein is a host cell comprising the vector described above or the isolated nucleic acid molecule of any one of aspects above.

Provided herein is a method of producing an antibody or an antigen binding fragment thereof, the method comprising: culturing the host cell described above in a medium under conditions permitting expression of a polypeptide encoded by the isolated nucleic acid molecule and assembling of the antibody or an antigen binding fragment thereof; and purifying the antibody or antigen binding fragment thereof from the cultured cell or the medium of the cell.

Provided herein is a kit comprising a therapeutically effective amount of at least one of the antibody or antigen binding fragment thereof of any one of aspects above. In some embodiments, the kit further comprises a therapeutically effective amount of a second therapeutic agent. In some embodiments, the second therapeutic agent is an anti-cancer agent, radiation therapy, a cytotoxic agent, a NSAID, a corticosteroid, a dietary supplement such as an antioxidant, or a combination thereof. In some embodiments, the anti-cancer agent is an anti-cancer antibody or a chemotherapeutic agent. In some embodiments, the antibody or antigen binding fragment thereof is in a lyophilized or an aqueous form. In some embodiments, the kit further comprises a reconstitution solution or a diluent.

Provided herein is an antibody or an antigen binding fragment thereof that selectively binds to R-spondin 1, transcript variant 2 (RSPO1) or a variant thereof, comprising at least one of: a variable heavy chain region, wherein the variable heavy chain region comprises a complementarity-determining region heavy chain 1 (CDR-H1) of SEQ ID NO: 543, CDR-H2 of SEQ ID NO: 1085, and CDR-H3 of SEQ ID NO: 1627; and/or a variable light chain region, wherein the variable light chain region comprises a complementarity-determining region light chain 1 (CDR-L1) of SEQ ID NO: 814, CDR-L2 of SEQ ID NO: 1356, and CDR-L3 of SEQ ID NO: 1898. In some embodiments, the variable heavy chain comprises a polypeptide consensus sequence having at least 95% sequence identity to the amino acid sequence of SEQ ID NO: 1, and the variable light chain comprises a polypeptide consensus sequence having at least 95% sequence identity to the amino acid sequence of SEQ ID NO: 272. In some embodiments, the antibody or antigen binding fragment thereof binds a human RSPO1, mouse RSPO1, rat RSPO1, bovine RSPO1, or cynomolgus monkey RSPO1. In some embodiments, the human RSPO1 comprises a sequence of SEQ ID NO: 4337.

Provided herein is an antibody that competes with an antibody or antigen binding fragment for binding to RSPO1, wherein the antibody binds to human RSPO1 or mouse RSPO1.

Provided herein is an antibody or an antigen binding fragment thereof that selectively binds to zinc finger DI-MC-type containing 1, transcript variant 1 (ZDHHC1) or a variant thereof, comprising at least one of: a variable heavy chain region, wherein the variable heavy chain region comprises a complementarity-determining region heavy chain 1 (CDR-H1) of SEQ ID NO: 545, CDR-H2 of SEQ ID NO: 1087, and CDR-H3 of SEQ ID NO: 1629; and/or a variable light chain region, wherein the variable light chain region comprises a complementarity-determining region light chain 1 (CDR-L1) of SEQ ID NO: 816, CDR-L2 of SEQ ID NO: 1358, and CDR-L3 of SEQ ID NO: 1900. In some embodiments, the variable heavy chain comprises a polypeptide consensus sequence having at least 95% sequence identity to the amino acid sequence of SEQ ID NO: 3, and the variable light chain comprises a polypeptide consensus sequence having at least 95% sequence identity to the amino acid sequence of SEQ ID NO: 274. In some embodiments, the antibody or antigen binding fragment thereof binds a human ZDHHC1, mouse ZDHHC1, rat ZDHHC1, bovine ZDHHC1, or cynomolgus monkey ZDHHC1. In some embodiments, the human ZDHHC1 comprises a sequence of SEQ ID NO: 4338.

Provided herein is an antibody that competes with an antibody or antigen binding fragment for binding to ZDHHC1, wherein the antibody binds to human ZDHHC1 or mouse ZDHHC1.

Provided herein is an antibody or an antigen binding fragment thereof that selectively binds to retinoid X receptor alpha, transcript variant 1 (RXRA) or a variant thereof, comprising at least one of: a variable heavy chain region, wherein the variable heavy chain region comprises a complementarity-determining region heavy chain 1 (CDR-H1) of SEQ ID NO: 546, CDR-H2 of SEQ ID NO: 1088, and CDR-H3 of SEQ ID NO: 1630; and/or a variable light chain region, wherein the variable light chain region comprises a complementarity-determining region light chain 1 (CDR-L1) of SEQ ID NO: 817, CDR-L2 of SEQ ID NO: 1359, and CDR-L3 of SEQ ID NO: 1901. In some embodiments, the variable heavy chain comprises a polypeptide consensus sequence having at least 95% sequence identity to the amino acid sequence of SEQ ID NO: 4, and the variable light chain comprises a polypeptide consensus sequence having at least 95% sequence identity to the amino acid sequence of SEQ ID NO: 275. In some embodiments, the antibody or antigen binding fragment thereof binds a human RXRA, mouse RXRA, rat RXRA, bovine RXRA, or cynomolgus monkey RXRA. In some embodiments, the human RXRA comprises a sequence of SEQ ID NO: 4339.

Provided herein is an antibody that competes with an antibody or antigen binding fragment for binding to RXRA, wherein the antibody binds to human RXRA or mouse RXRA.

Provided herein is an antibody or an antigen binding fragment thereof that selectively binds to retinoid X receptor gamma, transcript variant 1 (RXRG) or a variant thereof, comprising at least one of: a variable heavy chain region, wherein the variable heavy chain region comprises a complementarity-determining region heavy chain 1 (CDR-H1) of SEQ ID NO: 546, CDR-H2 of SEQ ID NO: 1088, and CDR-H3 of SEQ ID NO: 1630; and/or a variable light chain region, wherein the variable light chain region comprises a complementarity-determining region light chain 1 (CDR-L1) of SEQ ID NO: 817, CDR-L2 of SEQ ID NO: 1359, and CDR-L3 of SEQ ID NO: 1901. In some embodiments, the variable heavy chain comprises a polypeptide consensus sequence having at least 95% sequence identity to the amino acid sequence of SEQ ID NO: 4, and the variable light chain comprises a polypeptide consensus sequence having at least 95% sequence identity to the amino acid sequence of SEQ ID NO: 275. In some embodiments, the antibody or antigen binding fragment thereof binds a human RXRG, mouse RXRG, rat RXRG, bovine RXRG, or cynomolgus monkey RXRG. In some embodiments, the human RXRG comprises a sequence of SEQ ID NO: 4340.

Provided herein is an antibody that competes with an antibody or antigen binding fragment for binding to RXRG, wherein the antibody binds to human RXRG or mouse RXRG.

Provided herein is an antibody or an antigen binding fragment thereof that selectively binds to transmembrane protein 154 (TMEM154) or a variant thereof, comprising at least one of: a variable heavy chain region, wherein the variable heavy chain region comprises a complementarity-determining region heavy chain 1 (CDR-H1) of SEQ ID NO: 547, CDR-H2 of SEQ ID NO: 1089, and CDR-H3 of SEQ ID NO: 1631; and/or a variable light chain region, wherein the variable light chain region comprises a complementarity-determining region light chain 1 (CDR-L1) of SEQ ID NO: 818, CDR-L2 of SEQ ID NO: 1360, and CDR-L3 of SEQ ID NO: 1902. In some embodiments, the variable heavy chain comprises a polypeptide consensus sequence having at least 95% sequence identity to the amino acid sequence of SEQ ID NO: 5, and the variable light chain comprises a polypeptide consensus sequence having at least 95% sequence identity to the amino acid sequence of SEQ ID NO: 276. In some embodiments, the antibody or antigen binding fragment thereof binds a human TMEM154, mouse TMEM154, rat TMEM154, bovine TMEM154, or cynomolgus monkey TMEM154. In some embodiments, the human TMEM154 comprises a sequence of SEQ ID NO: 4341.

Provided herein is an antibody that competes with an antibody or antigen binding fragment for binding to TMEM154, wherein the antibody binds to human TMEM154 or mouse TMEM154.

Provided herein is an antibody or an antigen binding fragment thereof that selectively binds to SNAP associated protein, transcript variant 1 (SNAPIN) or a variant thereof, comprising at least one of: a variable heavy chain region, wherein the variable heavy chain region comprises a complementarity-determining region heavy chain 1 (CDR-H1) of SEQ ID NO: 548, CDR-H2 of SEQ ID NO: 1090, and CDR-H3 of SEQ ID NO: 1632; and/or a variable light chain region, wherein the variable light chain region comprises a complementarity-determining region light chain 1 (CDR-L1) of SEQ ID NO: 819, CDR-L2 of SEQ ID NO: 1361, and CDR-L3 of SEQ ID NO: 1903. In some embodiments, the variable heavy chain comprises a polypeptide consensus sequence having at least 95% sequence identity to the amino acid sequence of SEQ ID NO: 6, and the variable light chain comprises a polypeptide consensus sequence having at least 95% sequence identity to the amino acid sequence of SEQ ID NO: 277. In some embodiments, the antibody or antigen binding fragment thereof binds a human SNAPIN, mouse SNAPIN, rat SNAPIN, bovine SNAPIN, or cynomolgus monkey SNAPIN. In some embodiments, the human SNAPIN comprises a sequence of SEQ ID NO: 4342.

Provided herein is an antibody that competes with an antibody or antigen binding fragment for binding to SNAPIN, wherein the antibody binds to human SNAPIN or mouse SNAPIN.

Provided herein is an antibody or an antigen binding fragment thereof that selectively binds to glycogen phosphorylase L, transcript variant 1 (PYGL) or a variant thereof, comprising at least one of: a variable heavy chain region, wherein the variable heavy chain region comprises a complementarity-determining region heavy chain 1 (CDR-H1) of SEQ ID NO: 549, CDR-H2 of SEQ ID NO: 1091, and CDR-H3 of SEQ ID NO: 1633; and/or a variable light chain region, wherein the variable light chain region comprises a complementarity-determining region light chain 1 (CDR-L1) of SEQ ID NO: 820, CDR-L2 of SEQ ID NO: 1362, and CDR-L3 of SEQ ID NO: 1904. In some embodiments, the variable heavy chain comprises a polypeptide consensus sequence having at least 95% sequence identity to the amino acid sequence of SEQ ID NO: 7, and the variable light chain comprises a polypeptide consensus sequence having at least 95% sequence identity to the amino acid sequence of SEQ ID NO: 278. In some embodiments, the antibody or antigen binding fragment thereof binds a human PYGL, mouse PYGL, rat PYGL, bovine PYGL, or cynomolgus monkey PYGL. In some embodiments, the human PYGL comprises a sequence of SEQ ID NO: 4343.

Provided herein is an antibody that competes with an antibody or antigen binding fragment for binding to PYGL, wherein the antibody binds to human PYGL or mouse PYGL.

Provided herein is an antibody or an antigen binding fragment thereof that selectively binds to Reticulocalbin 3 (RCN3) or a variant thereof, comprising at least one of: a variable heavy chain region, wherein the variable heavy chain region comprises a complementarity-determining region heavy chain 1 (CDR-H1) of SEQ ID NO: 549, CDR-H2 of SEQ ID NO: 1091, and CDR-H3 of SEQ ID NO: 1633; and/or a variable light chain region, wherein the variable light chain region comprises a complementarity-determining region light chain 1 (CDR-L1) of SEQ ID NO: 820, CDR-L2 of SEQ ID NO: 1362, and CDR-L3 of SEQ ID NO: 1904. In some embodiments, the variable heavy chain comprises a polypeptide consensus sequence having at least 95% sequence identity to the amino acid sequence of SEQ ID NO: 7, and the variable light chain comprises a polypeptide consensus sequence having at least 95% sequence identity to the amino acid sequence of SEQ ID NO: 278. In some embodiments, the antibody or antigen binding fragment thereof binds a human RCN3, mouse RCN3, rat RCN3, bovine RCN3, or cynomolgus monkey RCN3. In some embodiments, the human RCN3 comprises a sequence of SEQ ID NO: 4344.

Provided herein is an antibody that competes with an antibody or antigen binding fragment for binding to RCN3, wherein the antibody binds to human RCN3 or mouse RCN3.

Provided herein is an antibody or an antigen binding fragment thereof that selectively binds to synaptotagmin 12, transcript variant X4 (SYT12) or a variant thereof, comprising at least one of: a variable heavy chain region, wherein the variable heavy chain region comprises a complementarity-determining region heavy chain 1 (CDR-H1) of SEQ ID NO: 549, CDR-H2 of SEQ ID NO: 1091, and CDR-H3 of SEQ ID NO: 1633; and/or a variable light chain region, wherein the variable light chain region comprises a complementarity-determining region light chain 1 (CDR-L1) of SEQ ID NO: 820, CDR-L2 of SEQ ID NO: 1362, and CDR-L3 of SEQ ID NO: 1904. In some embodiments, the variable heavy chain comprises a polypeptide consensus sequence having at least 95% sequence identity to the amino acid sequence of SEQ ID NO: 7, and the variable light chain comprises a polypeptide consensus sequence having at least 95% sequence identity to the amino acid sequence of SEQ ID NO: 278. In some embodiments, the antibody or antigen binding fragment thereof binds a human SYT12, mouse SYT12, rat SYT12, bovine SYT12, or cynomolgus monkey SYT12. In some embodiments, the human SYT12 comprises a sequence of SEQ ID NO: 4345.

Provided herein is an antibody that competes with an antibody or antigen binding fragment for binding to SYT12, wherein the antibody binds to human SYT12 or mouse SYT12.

Provided herein is an antibody or an antigen binding fragment thereof that selectively binds to Nuclear receptor subfamily 2 group f member 6 (Nr2f6) or a variant thereof, comprising at least one of:
a variable heavy chain region, wherein the variable heavy chain region comprises a complementarity-determining region heavy chain 1 (CDR-H1) of SEQ ID NO: 550, CDR-H2 of SEQ ID NO: 1092, and CDR-H3 of SEQ ID NO: 1634; and/or a variable light chain region, wherein the variable light chain region comprises a complementarity-determining region light chain 1 (CDR-L1) of SEQ ID NO: 821, CDR-L2 of SEQ ID NO: 1363, and CDR-L3 of SEQ ID NO: 1905. In some embodiments, the variable heavy chain comprises a polypeptide consensus sequence having at least 95% sequence identity to the amino acid sequence of SEQ ID NO: 8, and the variable light chain comprises a polypeptide consensus sequence having at least 95% sequence identity to the amino acid sequence of SEQ ID NO: 279. In some embodiments, the antibody or antigen binding fragment thereof binds a human Nr2f6, mouse Nr2f6, rat Nr2f6, bovine Nr2f6, or cynomolgus monkey Nr2f6. In some embodiments, the human Nr2f6 comprises a sequence of SEQ ID NO: 4346.

Provided herein is an antibody that competes with an antibody or antigen binding fragment for binding to Nr2f6, wherein the antibody binds to human Nr2f6 or mouse Nr2f6.

Provided herein is an antibody or an antigen binding fragment thereof that selectively binds to protein phosphatase 1 regulatory subunit 13 like, transcript variant 2 (PPP1R13L) or a variant thereof, comprising at least one of: a variable heavy chain region, wherein the variable heavy chain region comprises a complementarity-determining region heavy chain 1 (CDR-H1) of SEQ ID NO: 550, CDR-H2 of SEQ ID NO: 1092, and CDR-H3 of SEQ ID NO: 1634; and/or a variable light chain region, wherein the variable light chain region comprises a complementarity-determining region light chain 1 (CDR-L1) of SEQ ID NO: 821, CDR-L2 of SEQ ID NO: 1363, and CDR-L3 of SEQ ID NO: 1905. In some embodiments, the variable heavy chain comprises a polypeptide consensus sequence having at least 95% sequence identity to the amino acid sequence of SEQ ID NO: 8, and the variable light chain comprises a polypeptide consensus sequence having at least 95% sequence identity to the amino acid sequence of SEQ ID NO: 279. In some embodiments, the antibody or antigen binding fragment thereof binds a human PPP1R13L, mouse PPP1R13L, rat PPP1R13L, bovine PPP1R13L, or cynomolgus monkey PPP1R13L. In some embodiments, the human PPP1R13L comprises a sequence of SEQ ID NO: 4347.

Provided herein is an antibody that competes with an antibody or antigen binding fragment for binding to PPP1R13L, wherein the antibody binds to human PPP1R13L or mouse PPP1R13L.

Provided herein is an antibody or an antigen binding fragment thereof that selectively binds to olfactory receptor family 6 subfamily Q member 1 (gene/pseudogene) (OR6Q1) or a variant thereof, comprising at least one of: a variable heavy chain region, wherein the variable heavy chain region comprises a complementarity-determining region heavy chain 1 (CDR-H1) of SEQ ID NO: 552, CDR-H2 of SEQ ID NO: 1094, and CDR-H3 of SEQ ID NO: 1636; and/or a variable light chain region, wherein the variable light chain region comprises a complementarity-determining region light chain 1 (CDR-L1) of SEQ ID NO: 823, CDR-L2 of SEQ ID NO: 1365, and CDR-L3 of SEQ ID NO: 1907. In some embodiments, the variable heavy chain comprises a polypeptide consensus sequence having at least 95% sequence identity to the amino acid sequence of SEQ ID NO: 10, and the variable light chain comprises a polypeptide consensus sequence having at least 95% sequence identity to the amino acid sequence of SEQ ID NO: 281. In some embodiments, the antibody or antigen binding fragment thereof binds a human OR6Q1, mouse OR6Q1, rat OR6Q1, bovine OR6Q1, or cynomolgus monkey OR6Q1. In some embodiments, the human OR6Q1 comprises a sequence of SEQ ID NO: 4348.

Provided herein is an antibody that competes with an antibody or antigen binding fragment for binding to OR6Q1, wherein the antibody binds to human OR6Q1 or mouse OR6Q1.

Provided herein is an antibody or an antigen binding fragment thereof that selectively binds to cancer/testis antigen 1A (CTAG1A) or a variant thereof, comprising at least one of: a variable heavy chain region, wherein the variable heavy chain region comprises a complementarity-determining region heavy chain 1 (CDR-H1) of SEQ ID NO: 553, CDR-H2 of SEQ ID NO: 1095, and CDR-H3 of SEQ ID NO: 1637; and/or a variable light chain region, wherein the variable light chain region comprises a complementarity-determining region light chain 1 (CDR-L1) of SEQ ID NO: 824, CDR-L2 of SEQ ID NO: 1366, and CDR-L3 of SEQ ID NO: 1908. In some embodiments, the variable heavy chain comprises a polypeptide consensus sequence having at least 95% sequence identity to the amino acid sequence of SEQ ID NO: 11, and the variable light chain comprises a polypeptide consensus sequence having at least 95% sequence identity to the amino acid sequence of SEQ ID NO: 282. In some embodiments, the antibody or antigen binding fragment thereof binds a human CTAG1A, mouse CTAG1A, rat CTAG1A, bovine CTAG1A, or cynomolgus monkey CTAG1A. In some embodiments, the human CTAG1A comprises a sequence of SEQ ID NO: 4349.

Provided herein is an antibody that competes with an antibody or antigen binding fragment for binding to CTAG1A, wherein the antibody binds to human CTAG1A or mouse CTAG1A.

Provided herein is an antibody or an antigen binding fragment thereof that selectively binds to cancer/testis antigen 1A (CTAG1A) or a variant thereof, comprising at least one of: a variable heavy chain region, wherein the variable heavy chain region comprises a complementarity-determining region heavy chain 1 (CDR-H1) of SEQ ID NO: 554, CDR-H2 of SEQ ID NO: 1096, and CDR-H3 of SEQ ID NO: 1638; and/or a variable light chain region, wherein the variable light chain region comprises a complementarity-determining region light chain 1 (CDR-L1) of SEQ ID NO: 825, CDR-L2 of SEQ ID NO: 1367, and CDR-L3 of SEQ ID NO: 1909. In some embodiments, the variable heavy chain comprises a polypeptide consensus sequence having at least 95% sequence identity to the amino acid sequence of SEQ ID NO: 12, and the variable light chain comprises a polypeptide consensus sequence having at least 95% sequence identity to the amino acid sequence of SEQ ID NO: 283. In some embodiments, the antibody or antigen binding fragment thereof binds a human CTAG1A, mouse CTAG1A, rat CTAG1A, bovine CTAG1A, or cynomolgus monkey CTAG1A. In some embodiments, the human CTAG1A comprises a sequence of SEQ ID NO: 4349.

Provided herein is an antibody that competes with an antibody or antigen binding fragment for binding to CTAG1A, wherein the antibody binds to human CTAG1A or mouse CTAG1A.

Provided herein is an antibody or an antigen binding fragment thereof that selectively binds to 5-hydroxytryptamine receptor 1E (HTR1E) or a variant thereof, comprising at least one of: a variable heavy chain region, wherein the variable heavy chain region comprises a complementarity-determining region heavy chain 1 (CDR-H1) of SEQ ID NO: 555, CDR-H2 of SEQ ID NO: 1097, and CDR-H3 of SEQ ID NO: 1639; and/or a variable light chain region, wherein the variable light chain region comprises a complementarity-determining region light chain 1 (CDR-L1) of SEQ ID NO: 826, CDR-L2 of SEQ ID NO: 1368, and CDR-L3 of SEQ ID NO: 1910. In some embodiments, the variable heavy chain comprises a polypeptide consensus sequence having at least 95% sequence identity to the amino acid sequence of SEQ ID NO: 13, and the variable light chain comprises a polypeptide consensus sequence having at least 95% sequence identity to the amino acid sequence of SEQ ID NO: 284. In some embodiments, the antibody or antigen binding fragment thereof binds a human HTR1E, mouse HTR1E, rat HTR1E, bovine HTR1E, or cynomolgus monkey HTR1E. In some embodiments, the human HTR1E comprises a sequence of SEQ ID NO: 4350.

Provided herein is an antibody that competes with an antibody or antigen binding fragment for binding to HTR1E, wherein the antibody binds to human HTR1E or mouse HTR1E.

Provided herein is an antibody or an antigen binding fragment thereof that selectively binds to microfibril associated protein 3, transcript variant 3 (MFAP3) or a variant thereof, comprising at least one of: a variable heavy chain region, wherein the variable heavy chain region comprises a complementarity-determining region heavy chain 1 (CDR-H1) of SEQ ID NO: 557, CDR-H2 of SEQ ID NO: 1099, and CDR-H3 of SEQ ID NO: 1641; and/or a variable light chain region, wherein the variable light chain region comprises a complementarity-determining region light chain 1 (CDR-L1) of SEQ ID NO: 828, CDR-L2 of SEQ ID NO: 1370, and CDR-L3 of SEQ ID NO: 1912. In some embodiments, the variable heavy chain comprises a polypeptide consensus sequence having at least 95% sequence identity to the amino acid sequence of SEQ ID NO: 15, and the variable light chain comprises a polypeptide consensus sequence having at least 95% sequence identity to the amino acid sequence of SEQ ID NO: 286. In some embodiments, the antibody or antigen binding fragment thereof binds a human MFAP3, mouse MFAP3, rat MFAP3, bovine MFAP3, or cynomolgus monkey MFAP3. In some embodiments, the human MFAP3 comprises a sequence of SEQ ID NO: 4351.

Provided herein is an antibody that competes with an antibody or antigen binding fragment for binding to MFAP3, wherein the antibody binds to human MFAP3 or mouse MFAP3.

Provided herein is an antibody or an antigen binding fragment thereof that selectively binds to hyaluronan binding protein 4 (HABP4) or a variant thereof, comprising at least one of: a variable heavy chain region, wherein the variable heavy chain region comprises a complementarity-determining region heavy chain 1 (CDR-H1) of SEQ ID NO: 559, CDR-H2 of SEQ ID NO: 1101, and CDR-H3 of SEQ ID NO: 1643; and/or a variable light chain region, wherein the variable light chain region comprises a complementarity-determining region light chain 1 (CDR-L1) of SEQ ID NO: 830, CDR-L2 of SEQ ID NO: 1372, and CDR-L3 of SEQ ID NO: 1914. In some embodiments, the variable heavy chain comprises a polypeptide consensus sequence having at least 95% sequence identity to the amino acid sequence of SEQ ID NO: 17, and the variable light chain comprises a polypeptide consensus sequence having at least 95% sequence identity to the amino acid sequence of SEQ ID NO: 288. In some embodiments, the antibody or antigen binding fragment thereof binds a human HABP4, mouse HABP4, rat HABP4, bovine HABP4, or cynomolgus monkey HABP4. In some embodiments, the human HABP4 comprises a sequence of SEQ ID NO: 4352.

Provided herein is an antibody that competes with an antibody or antigen binding fragment for binding to HABP4, wherein the antibody binds to human HABP4 or mouse HABP4.

Provided herein is an antibody or an antigen binding fragment thereof that selectively binds to glucuronidase, beta pseudogene (BC025996.2_frag) or a variant thereof, comprising at least one of: a variable heavy chain region, wherein the variable heavy chain region comprises a complementarity-determining region heavy chain 1 (CDR-H1) of SEQ ID NO: 561, CDR-H2 of SEQ ID NO: 1103, and CDR-H3 of SEQ ID NO: 1645; and/or a variable light chain region, wherein the variable light chain region comprises a complementarity-determining region light chain 1 (CDR-L1) of SEQ ID NO: 832, CDR-L2 of SEQ ID NO: 1374, and CDR-L3 of SEQ ID NO: 1916. In some embodiments, the variable heavy chain comprises a polypeptide consensus sequence having at least 95% sequence identity to the amino acid sequence of SEQ ID NO: 19, and the variable light chain comprises a polypeptide consensus sequence having at least 95% sequence identity to the amino acid sequence of SEQ ID NO: 290. In some embodiments, the antibody or antigen binding fragment thereof binds a human BC025996.2_frag, mouse BC025996.2_frag, rat BC025996.2_frag, bovine BC025996.2_frag, or cynomolgus monkey BC025996.2_frag. In some embodiments, the human BC025996.2_frag comprises a sequence of SEQ ID NO: 4353.

Provided herein is an antibody that competes with an antibody or antigen binding fragment for binding to BC025996.2_frag, wherein the antibody binds to human BC025996.2_frag or mouse BC025996.2_frag.

Provided herein is an antibody or an antigen binding fragment thereof that selectively binds to dual specificity phosphatase 12 (DUSP12) or a variant thereof, comprising at least one of: a variable heavy chain region, wherein the variable heavy chain region comprises a complementarity-determining region heavy chain 1 (CDR-H1) of SEQ ID NO: 562, CDR-H2 of SEQ ID NO: 1104, and CDR-H3 of SEQ ID NO: 1646; and/or a variable light chain region, wherein the variable light chain region comprises a complementarity-determining region light chain 1 (CDR-L1) of SEQ ID NO: 833, CDR-L2 of SEQ ID NO: 1375, and CDR-L3 of SEQ ID NO: 1917. In some embodiments, the variable heavy chain comprises a polypeptide consensus sequence having at least 95% sequence identity to the amino acid sequence of SEQ ID NO: 20, and the variable light chain comprises a polypeptide consensus sequence having at least 95% sequence identity to the amino acid sequence of SEQ ID NO: 291. In some embodiments, the antibody or antigen binding fragment thereof binds a human DUSP12, mouse DUSP12, rat DUSP12, bovine DUSP12, or cynomolgus monkey DUSP12. In some embodiments, the human DUSP12 comprises a sequence of SEQ ID NO: 4354.

Provided herein is an antibody that competes with an antibody or antigen binding fragment for binding to DUSP12, wherein the antibody binds to human DUSP12 or mouse DUSP12.

Provided herein is an antibody or an antigen binding fragment thereof that selectively binds to actinin alpha 1, transcript variant 2 (ACTN1) or a variant thereof, comprising at least one of: a variable heavy chain region, wherein the variable heavy chain region comprises a complementarity-determining region heavy chain 1 (CDR-H1) of SEQ ID NO: 562, CDR-H2 of SEQ ID NO: 1104, and CDR-H3 of SEQ ID NO: 1646; and/or a variable light chain region, wherein the variable light chain region comprises a complementarity-determining region light chain 1 (CDR-L1) of SEQ ID NO: 833, CDR-L2 of SEQ ID NO: 1375, and CDR-L3 of SEQ ID NO: 1917. In some embodiments, the variable heavy chain comprises a polypeptide consensus sequence having at least 95% sequence identity to the amino acid sequence of SEQ ID NO: 20, and the variable light chain comprises a polypeptide consensus sequence having at least 95% sequence identity to the amino acid sequence of SEQ ID NO: 291. In some embodiments, the antibody or antigen binding fragment thereof binds a human ACTN1, mouse ACTN1, rat ACTN1, bovine ACTN1, or cynomolgus monkey ACTN1. In some embodiments, the human ACTN1 comprises a sequence of SEQ ID NO: 4355.

Provided herein is an antibody that competes with an antibody or antigen binding fragment for binding to ACTN1, wherein the antibody binds to human ACTN1 or mouse ACTN1.

Provided herein is an antibody or an antigen binding fragment thereof that selectively binds to zinc finger with KRAB and SCAN domains 4, transcript variant X1 (ZKSCAN4) or a variant thereof, comprising at least one of: a variable heavy chain region, wherein the variable heavy chain region comprises a complementarity-determining region heavy chain 1 (CDR-H1) of SEQ ID NO: 564, CDR-H2 of SEQ ID NO: 1106, and CDR-H3 of SEQ ID NO: 1648; and/or a variable light chain region, wherein the variable light chain region comprises a complementarity-determining region light chain 1 (CDR-L1) of SEQ ID NO: 835, CDR-L2 of SEQ ID NO: 1377, and CDR-L3 of SEQ ID NO: 1919. In some embodiments, the variable heavy chain comprises a polypeptide consensus sequence having at least 95% sequence identity to the amino acid sequence of SEQ ID NO: 22, and the variable light chain comprises a polypeptide consensus sequence having at least 95% sequence identity to the amino acid sequence of SEQ ID NO: 293. In some embodiments, the antibody or antigen binding fragment thereof binds a human ZKSCAN4, mouse ZKSCAN4, rat ZKSCAN4, bovine ZKSCAN4, or cynomolgus monkey ZKSCAN4. In some embodiments, the human ZKSCAN4 comprises a sequence of SEQ ID NO: 4356.

Provided herein is an antibody that competes with an antibody or antigen binding fragment for binding to ZKSCAN4, wherein the antibody binds to human ZKSCAN4 or mouse ZKSCAN4.

Provided herein is an antibody or an antigen binding fragment thereof that selectively binds to PNMA family member 5, transcript variant 2 (PNMA5) or a variant thereof, comprising at least one of: a variable heavy chain region, wherein the variable heavy chain region comprises a complementarity-determining region heavy chain 1 (CDR-H1) of SEQ ID NO: 566, CDR-H2 of SEQ ID NO: 1108, and CDR-H3 of SEQ ID NO: 1650; and/or a variable light chain region, wherein the variable light chain region comprises a complementarity-determining region light chain 1 (CDR-L1) of SEQ ID NO: 837, CDR-L2 of SEQ ID NO: 1379, and CDR-L3 of SEQ ID NO: 1921. In some embodiments, the variable heavy chain comprises a polypeptide consensus sequence having at least 95% sequence identity to the amino acid sequence of SEQ ID NO: 24, and the variable light chain comprises a polypeptide consensus sequence having at least 95% sequence identity to the amino acid sequence of SEQ ID NO: 295. In some embodiments, the antibody or antigen binding fragment thereof binds a human PNMA5, mouse PNMA5, rat PNMA5, bovine PNMA5, or cynomolgus monkey PNMA5. In some embodiments, the human PNMA5 comprises a sequence of SEQ ID NO: 4357.

Provided herein is an antibody that competes with an antibody or antigen binding fragment for binding to PNMA5, wherein the antibody binds to human PNMA5 or mouse PNMA5.

Provided herein is an antibody or an antigen binding fragment thereof that selectively binds to kelch like family member 40 (KLHL40) or a variant thereof, comprising at least one of: a variable heavy chain region, wherein the variable heavy chain region comprises a complementarity-determining region heavy chain 1 (CDR-H1) of SEQ ID NO: 567, CDR-H2 of SEQ ID NO: 1109, and CDR-H3 of SEQ ID NO: 1651; and/or a variable light chain region, wherein the variable light chain region comprises a complementarity-determining region light chain 1 (CDR-L1) of SEQ ID NO: 838, CDR-L2 of SEQ ID NO: 1380, and CDR-L3 of SEQ ID NO: 1922. In some embodiments, the variable heavy chain comprises a polypeptide consensus sequence having at least 95% sequence identity to the amino acid sequence of SEQ ID NO: 25, and the variable light chain comprises a polypeptide consensus sequence having at least 95% sequence identity to the amino acid sequence of SEQ ID NO: 296. In some embodiments, the antibody or antigen binding fragment thereof binds a human KLHL40, mouse KLHL40, rat KLHL40, bovine KLHL40, or cynomolgus monkey KLHL40. In some embodiments, the human KLHL40 comprises a sequence of SEQ ID NO: 4358.

Provided herein is an antibody that competes with an antibody or antigen binding fragment for binding to KLHL40, wherein the antibody binds to human KLHL40 or mouse KLHL40.

Provided herein is an antibody or an antigen binding fragment thereof that selectively binds to membrane palmitoylated protein 2, transcript variant 3 (MPP2) or a variant thereof, comprising at least one of: a variable heavy chain region, wherein the variable heavy chain region comprises a complementarity-determining region heavy chain 1 (CDR-H1) of SEQ ID NO: 567, CDR-H2 of SEQ ID NO: 1109, and CDR-H3 of SEQ ID NO: 1651; and/or a variable light chain region, wherein the variable light chain region comprises a complementarity-determining region light chain 1 (CDR-L1) of SEQ ID NO: 838, CDR-L2 of SEQ ID NO: 1380, and CDR-L3 of SEQ ID NO: 1922. In some embodiments, the variable heavy chain comprises a polypeptide consensus sequence having at least 95% sequence identity to the amino acid sequence of SEQ ID NO: 25, and the variable light chain comprises a polypeptide consensus sequence having at least 95% sequence identity to the amino acid sequence of SEQ ID NO: 296. In some embodiments, the antibody or antigen binding fragment thereof binds a human MPP2, mouse MPP2, rat MPP2, bovine MPP2, or cynomolgus monkey MPP2. In some embodiments, the human MPP2 comprises a sequence of SEQ ID NO: 4359.

Provided herein is an antibody that competes with an antibody or antigen binding fragment for binding to MPP2, wherein the antibody binds to human MPP2 or mouse MPP2.

Provided herein is an antibody or an antigen binding fragment thereof that selectively binds to butyrophilin subfamily 1 member A1 (BTN1A1) or a variant thereof, comprising at least one of: a variable heavy chain region, wherein the variable heavy chain region comprises a complementarity-determining region heavy chain 1 (CDR-H1) of SEQ ID NO: 568, CDR-H2 of SEQ ID NO: 1110, and CDR-H3 of SEQ ID NO: 1652; and/or a variable light chain region, wherein the variable light chain region comprises a complementarity-determining region light chain 1 (CDR-L1) of SEQ ID NO: 839, CDR-L2 of SEQ ID NO: 1381, and CDR-L3 of SEQ ID NO: 1923. In some embodiments, the variable heavy chain comprises a polypeptide consensus sequence having at least 95% sequence identity to the amino acid sequence of SEQ ID NO: 26, and the variable light chain comprises a polypeptide consensus sequence having at least 95% sequence identity to the amino acid sequence of SEQ ID NO: 297. In some embodiments, the antibody or antigen binding fragment thereof binds a human BTN1A1, mouse BTN1A1, rat BTN1A1, bovine BTN1A1, or cynomolgus monkey BTN1A1. In some embodiments, the human BTN1A1 comprises a sequence of SEQ ID NO: 4360.

Provided herein is an antibody that competes with an antibody or antigen binding fragment for binding to BTN1A1, wherein the antibody binds to human BTN1A1 or mouse BTN1A1.

Provided herein is an antibody or an antigen binding fragment thereof that selectively binds to peroxisomal biogenesis factor 11 gamma, transcript variant 1 (PEX11G) or a variant thereof, comprising at least one of: a variable heavy chain region, wherein the variable heavy chain region comprises a complementarity-determining region heavy chain 1 (CDR-H1) of SEQ ID NO: 569, CDR-H2 of SEQ ID NO: 1111, and CDR-H3 of SEQ ID NO: 1653; and/or a variable light chain region, wherein the variable light chain region comprises a complementarity-determining region light chain 1 (CDR-L1) of SEQ ID NO: 840, CDR-L2 of SEQ ID NO: 1382, and CDR-L3 of SEQ ID NO: 1924. In some embodiments, the variable heavy chain comprises a polypeptide consensus sequence having at least 95% sequence identity to the amino acid sequence of SEQ ID NO: 27, and the variable light chain comprises a polypeptide consensus sequence having at least 95% sequence identity to the amino acid sequence of SEQ ID NO: 298. In some embodiments, the antibody or antigen binding fragment thereof binds a human PEX11G, mouse PEX11G, rat PEX11G, bovine PEX11G, or cynomolgus monkey PEX11G. In some embodiments, the human PEX11G comprises a sequence of SEQ ID NO: 4361.

Provided herein is an antibody that competes with an antibody or antigen binding fragment for binding to PEX11G, wherein the antibody binds to human PEX11G or mouse PEX11G.

Provided herein is an antibody or an antigen binding fragment thereof that selectively binds to zinc finger protein 8 (ZNF8) or a variant thereof, comprising at least one of: a variable heavy chain region, wherein the variable heavy chain region comprises a complementarity-determining region heavy chain 1 (CDR-H1) of SEQ ID NO: 572, CDR-H2 of SEQ ID NO: 1114, and CDR-H3 of SEQ ID NO: 1656; and/or a variable light chain region, wherein the variable light chain region comprises a complementarity-determining region light chain 1 (CDR-L1) of SEQ ID NO: 843, CDR-L2 of SEQ ID NO: 1385, and CDR-L3 of SEQ ID NO: 1927. In some embodiments, the variable heavy chain comprises a polypeptide consensus sequence having at least 95% sequence identity to the amino acid sequence of SEQ ID NO: 30, and the variable light chain comprises a polypeptide consensus sequence having at least 95% sequence identity to the amino acid sequence of SEQ ID NO: 301. In some embodiments, the antibody or antigen binding fragment thereof binds a human ZNF8, mouse ZNF8, rat ZNF8, bovine ZNF8, or cynomolgus monkey ZNF8. In some embodiments, the human ZNF8 comprises a sequence of SEQ ID NO: 4362.

Provided herein is an antibody that competes with an antibody or antigen binding fragment for binding to ZNF8, wherein the antibody binds to human ZNF8 or mouse ZNF8.

Provided herein is an antibody or an antigen binding fragment thereof that selectively binds to SATB homeobox 2, transcript variant 2 (SATB2) or a variant thereof, comprising at least one of: a variable heavy chain region, wherein the variable heavy chain region comprises a complementarity-determining region heavy chain 1 (CDR-H1) of SEQ ID NO: 572, CDR-H2 of SEQ ID NO: 1114, and CDR-H3 of SEQ ID NO: 1656; and/or a variable light chain region, wherein the variable light chain region comprises a complementarity-determining region light chain 1 (CDR-L1) of SEQ ID NO: 843, CDR-L2 of SEQ ID NO: 1385, and CDR-L3 of SEQ ID NO: 1927. In some embodiments, the variable heavy chain comprises a polypeptide consensus sequence having at least 95% sequence identity to the amino acid sequence of SEQ ID NO: 30, and the variable light chain comprises a polypeptide consensus sequence having at least 95% sequence identity to the amino acid sequence of SEQ ID NO: 301. In some embodiments, the antibody or antigen binding fragment thereof binds a human SATB2, mouse SATB2, rat SATB2, bovine SATB2, or cynomolgus monkey SATB2. In some embodiments, the human SATB2 comprises a sequence of SEQ ID NO: 4363.

Provided herein is an antibody that competes with an antibody or antigen binding fragment for binding to SATB2, wherein the antibody binds to human SATB2 or mouse SATB2.

Provided herein is an antibody or an antigen binding fragment thereof that selectively binds to ganglioside induced differentiation associated protein 1, transcript variant 2 (GDAP1) or a variant thereof, comprising at least one of: a variable heavy chain region, wherein the variable heavy chain region comprises a complementarity-determining region heavy chain 1 (CDR-H1) of SEQ ID NO: 572, CDR-H2 of SEQ ID NO: 1114, and CDR-H3 of SEQ ID NO: 1656; and/or a variable light chain region, wherein the variable light chain region comprises a complementarity-determining region light chain 1 (CDR-L1) of SEQ ID NO: 843, CDR-L2 of SEQ ID NO: 1385, and CDR-L3 of SEQ ID NO: 1927. In some embodiments, the variable heavy chain comprises a polypeptide consensus sequence having at least 95% sequence identity to the amino acid sequence of SEQ ID NO: 30, and the variable light chain comprises a polypeptide consensus sequence having at least 95% sequence identity to the amino acid sequence of SEQ ID NO: 301. In some embodiments, the antibody or antigen binding fragment thereof binds a human GDAP1, mouse GDAP1, rat GDAP1, bovine GDAP1, or cynomolgus monkey GDAP1. In some embodiments, the human GDAP1 comprises a sequence of SEQ ID NO: 4364.

Provided herein is an antibody that competes with an antibody or antigen binding fragment for binding to GDAP1, wherein the antibody binds to human GDAP1 or mouse GDAP1.

Provided herein is an antibody or an antigen binding fragment thereof that selectively binds to catenin alpha like 1, transcript variant 1 (CTNNAL1) or a variant thereof, comprising at least one of: a variable heavy chain region, wherein the variable heavy chain region comprises a complementarity-determining region heavy chain 1 (CDR-H1) of SEQ ID NO: 578, CDR-H2 of SEQ ID NO: 1120, and CDR-H3 of SEQ ID NO: 1662; and/or a variable light chain region, wherein the variable light chain region comprises a complementarity-determining region light chain 1 (CDR-L1) of SEQ ID NO: 849, CDR-L2 of SEQ ID NO: 1391, and CDR-L3 of SEQ ID NO: 1933. In some embodiments, the variable heavy chain comprises a polypeptide consensus sequence having at least 95% sequence identity to the amino acid sequence of SEQ ID NO: 36, and the variable light chain comprises a polypeptide consensus sequence having at least 95% sequence identity to the amino acid sequence of SEQ ID NO: 307. In some embodiments, the antibody or antigen binding fragment thereof binds a human CTNNAL1, mouse CTNNAL1, rat CTNNAL1, bovine CTNNAL1, or cynomolgus monkey CTNNAL1. In some embodiments, the human CTNNAL1 comprises a sequence of SEQ ID NO: 4365.

Provided herein is an antibody that competes with an antibody or antigen binding fragment for binding to CTNNAL1, wherein the antibody binds to human CTNNAL1 or mouse CTNNAL1.

Provided herein is an antibody or an antigen binding fragment thereof that selectively binds to FA complementation group G (FANCG) or a variant thereof, comprising at least one of: a variable heavy chain region, wherein the variable heavy chain region comprises a complementarity-determining region heavy chain 1 (CDR-H1) of SEQ ID NO: 579, CDR-H2 of SEQ ID NO: 1121, and CDR-H3 of SEQ ID NO: 1663; and/or a variable light chain region, wherein the variable light chain region comprises a complementarity-determining region light chain 1 (CDR-L1) of SEQ ID NO: 850, CDR-L2 of SEQ ID NO: 1392, and CDR-L3 of SEQ ID NO: 1934. In some embodiments, the variable heavy chain comprises a polypeptide consensus sequence having at least 95% sequence identity to the amino acid sequence of SEQ ID NO: 37, and the variable light chain comprises a polypeptide consensus sequence having at least 95% sequence identity to the amino acid sequence of SEQ ID NO: 308. In some embodiments, the antibody or antigen binding fragment thereof binds a human FANCG, mouse FANCG, rat FANCG, bovine FANCG, or cynomolgus monkey FANCG. In some embodiments, the human FANCG comprises a sequence of SEQ ID NO: 4366.

Provided herein is an antibody that competes with an antibody or antigen binding fragment for binding to FANCG, wherein the antibody binds to human FANCG or mouse FANCG.

Provided herein is an antibody or an antigen binding fragment thereof that selectively binds to DEAD-box helicase 18 (DDX18) or a variant thereof, comprising at least one of: a variable heavy chain region, wherein the variable heavy chain region comprises a complementarity-determining region heavy chain 1 (CDR-H1) of SEQ ID NO: 582, CDR-H2 of SEQ ID NO: 1124, and CDR-H3 of SEQ ID NO: 1666; and/or a variable light chain region, wherein the variable light chain region comprises a complementarity-determining region light chain 1 (CDR-L1) of SEQ ID NO: 853, CDR-L2 of SEQ ID NO: 1395, and CDR-L3 of SEQ ID NO: 1937. In some embodiments, the variable heavy chain comprises a polypeptide consensus sequence having at least 95% sequence identity to the amino acid sequence of SEQ ID NO: 40, and the variable light chain comprises a polypeptide consensus sequence having at least 95% sequence identity to the amino acid sequence of SEQ ID NO: 311. In some embodiments, the antibody or antigen binding fragment thereof binds a human DDX18, mouse DDX18, rat DDX18, bovine DDX18, or cynomolgus monkey DDX18. In some embodiments, the human DDX18 comprises a sequence of SEQ ID NO: 4367.

Provided herein is an antibody that competes with an antibody or antigen binding fragment for binding to DDX18, wherein the antibody binds to human DDX18 or mouse DDX18.

Provided herein is an antibody or an antigen binding fragment thereof that selectively binds to syntaxin 1A, transcript variant 1 (STX1A) or a variant thereof, comprising at least one of: a variable heavy chain region, wherein the variable heavy chain region comprises a complementarity-determining region heavy chain 1 (CDR-H1) of SEQ ID NO: 582, CDR-H2 of SEQ ID NO: 1124, and CDR-H3 of SEQ ID NO: 1666; and/or a variable light chain region, wherein the variable light chain region comprises a complementarity-determining region light chain 1 (CDR-L1) of SEQ ID NO: 853, CDR-L2 of SEQ ID NO: 1395, and CDR-L3 of SEQ ID NO: 1937. In some embodiments, the variable heavy chain comprises a polypeptide consensus sequence having at least 95% sequence identity to the amino acid sequence of SEQ ID NO: 40, and the variable light chain comprises a polypeptide consensus sequence having at least 95% sequence identity to the amino acid sequence of SEQ ID NO: 311. In some embodiments, the antibody or antigen binding fragment thereof binds a human STX1A, mouse STX1A, rat STX1A, bovine STX1A, or cynomolgus monkey STX1A. In some embodiments, the human STX1A comprises a sequence of SEQ ID NO: 4368.

Provided herein is an antibody that competes with an antibody or antigen binding fragment for binding to STX1A, wherein the antibody binds to human STX1A or mouse STX1A.

Provided herein is an antibody or an antigen binding fragment thereof that selectively binds to geminin DNA replication inhibitor, transcript variant 1 (GMNN) or a variant thereof, comprising at least one of: a variable heavy chain region, wherein the variable heavy chain region comprises a complementarity-determining region heavy chain 1 (CDR-H1) of SEQ ID NO: 582, CDR-H2 of SEQ ID NO: 1124, and CDR-H3 of SEQ ID NO: 1666; and/or a variable light chain region, wherein the variable light chain region comprises a complementarity-determining region light chain 1 (CDR-L1) of SEQ ID NO: 853, CDR-L2 of SEQ ID NO: 1395, and CDR-L3 of SEQ ID NO: 1937. In some embodiments, the variable heavy chain comprises a polypeptide consensus sequence having at least 95% sequence identity to the amino acid sequence of SEQ ID NO: 40, and the variable light chain comprises a polypeptide consensus sequence having at least 95% sequence identity to the amino acid sequence of SEQ ID NO: 311. In some embodiments, the antibody or antigen binding fragment thereof binds a human GMNN, mouse GMNN, rat GMNN, bovine GMNN, or cynomolgus monkey GMNN. In some embodiments, the human GMNN comprises a sequence of SEQ ID NO: 4369.

Provided herein is an antibody that competes with an antibody or antigen binding fragment for binding to GMNN, wherein the antibody binds to human GMNN or mouse GMNN.

Provided herein is an antibody or an antigen binding fragment thereof that selectively binds to ubiquilin 1, transcript variant 2 (UBQLN1) or a variant thereof, comprising at least one of: a variable heavy chain region, wherein the variable heavy chain region comprises a complementarity-determining region heavy chain 1 (CDR-H1) of SEQ ID NO: 585, CDR-H2 of SEQ ID NO: 1127, and CDR-H3 of SEQ ID NO: 1669; and/or a variable light chain region, wherein the variable light chain region comprises a complementarity-determining region light chain 1 (CDR-L1) of SEQ ID NO: 856, CDR-L2 of SEQ ID NO: 1398, and CDR-L3 of SEQ ID NO: 1940. In some embodiments, the variable heavy chain comprises a polypeptide consensus sequence having at least 95% sequence identity to the amino acid sequence of SEQ ID NO: 43, and the variable light chain comprises a polypeptide consensus sequence having at least 95% sequence identity to the amino acid sequence of SEQ ID NO: 314. In some embodiments, the antibody or antigen binding fragment thereof binds a human UBQLN1, mouse UBQLN1, rat UBQLN1, bovine UBQLN1, or cynomolgus monkey UBQLN1. In some embodiments, the human UBQLN1 comprises a sequence of SEQ ID NO: 4370.

Provided herein is an antibody that competes with an antibody or antigen binding fragment for binding to UBQLN1, wherein the antibody binds to human UBQLN1 or mouse UBQLN1.

Provided herein is an antibody or an antigen binding fragment thereof that selectively binds to carnosine dipeptidase 2, transcript variant 1 (CNDP2) or a variant thereof, comprising at least one of: a variable heavy chain region, wherein the variable heavy chain region comprises a complementarity-determining region heavy chain 1 (CDR-H1) of SEQ ID NO: 585, CDR-H2 of SEQ ID NO: 1127, and CDR-H3 of SEQ ID NO: 1669; and/or a variable light chain region, wherein the variable light chain region comprises a complementarity-determining region light chain 1 (CDR-L1) of SEQ ID NO: 856, CDR-L2 of SEQ ID NO: 1398, and CDR-L3 of SEQ ID NO: 1940. In some embodiments, the variable heavy chain comprises a polypeptide consensus sequence having at least 95% sequence identity to the amino acid sequence of SEQ ID NO: 43, and the variable light chain comprises a polypeptide consensus sequence having at least 95% sequence identity to the amino acid sequence of SEQ ID NO: 314. In some embodiments, the antibody or antigen binding fragment thereof binds a human CNDP2, mouse CNDP2, rat CNDP2, bovine CNDP2, or cynomolgus monkey CNDP2. In some embodiments, the human CNDP2 comprises a sequence of SEQ ID NO: 4371.

Provided herein is an antibody that competes with an antibody or antigen binding fragment for binding to CNDP2, wherein the antibody binds to human CNDP2 or mouse CNDP2.

Provided herein is an antibody or an antigen binding fragment thereof that selectively binds to X-linked inhibitor of apoptosis, transcript variant 2 (XIAP) or a variant thereof, comprising at least one of: a variable heavy chain region, wherein the variable heavy chain region comprises a complementarity-determining region heavy chain 1 (CDR-H1) of SEQ ID NO: 587, CDR-H2 of SEQ ID NO: 1129, and CDR-H3 of SEQ ID NO: 1671; and/or a variable light chain region, wherein the variable light chain region comprises a complementarity-determining region light chain 1 (CDR-L1) of SEQ ID NO: 858, CDR-L2 of SEQ ID NO: 1400, and CDR-L3 of SEQ ID NO: 1942. In some embodiments, the variable heavy chain comprises a polypeptide consensus sequence having at least 95% sequence identity to the amino acid sequence of SEQ ID NO: 45, and the variable light chain comprises a polypeptide consensus sequence having at least 95% sequence identity to the amino acid sequence of SEQ ID NO: 316. In some embodiments, the antibody or antigen binding fragment thereof binds a human XIAP, mouse XIAP, rat XIAP, bovine XIAP, or cynomolgus monkey XIAP. In some embodiments, the human XIAP comprises a sequence of SEQ ID NO: 4372.

Provided herein is an antibody that competes with an antibody or antigen binding fragment for binding to XIAP, wherein the antibody binds to human XIAP or mouse XIAP.

Provided herein an antibody or an antigen binding fragment thereof that selectively binds to hyaluronan binding protein 4 (HABP4) or a variant thereof, comprising at least one of: a variable heavy chain region, wherein the variable heavy chain region comprises a complementarity-determining region heavy chain 1 (CDR-H1) of SEQ ID NO: 587, CDR-H2 of SEQ ID NO: 1129, and CDR-H3 of SEQ ID NO: 1671; and/or a variable light chain region, wherein the variable light chain region comprises a complementarity-determining region light chain 1 (CDR-L1) of SEQ ID NO: 858, CDR-L2 of SEQ ID NO: 1400, and CDR-L3 of SEQ ID NO: 1942. In some embodiments, the variable heavy chain comprises a polypeptide consensus sequence having at least 95% sequence identity to the amino acid sequence of SEQ ID NO: 45, and the variable light chain comprises a polypeptide consensus sequence having at least 95% sequence identity to the amino acid sequence of SEQ ID NO: 316. In some embodiments, the antibody or antigen binding fragment thereof binds a human HABP4, mouse HABP4, rat HABP4, bovine HABP4, or cynomolgus monkey HABP4. In some embodiments, the human HABP4 comprises a sequence of SEQ ID NO: 4352.

Provided herein is an antibody that competes with an antibody or antigen binding fragment for binding to HABP4, wherein the antibody binds to human HABP4 or mouse HABP4.

Provided herein is an antibody or an antigen binding fragment thereof that selectively binds to endosome associated trafficking regulator 1, transcript variant 2 (SDCCAG3) or a variant thereof, comprising at least one of: a variable heavy chain region, wherein the variable heavy chain region comprises a complementarity-determining region heavy chain 1 (CDR-H1) of SEQ ID NO: 589, CDR-H2 of SEQ ID NO: 1131, and CDR-H3 of SEQ ID NO: 1673; and/or a variable light chain region, wherein the variable light chain region comprises a complementarity-determining region light chain 1 (CDR-L1) of SEQ ID NO: 860, CDR-L2 of SEQ ID NO: 1402, and CDR-L3 of SEQ ID NO: 1944. In some embodiments, the variable heavy chain comprises a polypeptide consensus sequence having at least 95% sequence identity to the amino acid sequence of SEQ ID NO: 47, and the variable light chain comprises a polypeptide consensus sequence having at least 95% sequence identity to the amino acid sequence of SEQ ID NO: 318. In some embodiments, the antibody or antigen binding fragment thereof binds a human SDCCAG3, mouse SDCCAG3, rat SDCCAG3, bovine SDCCAG3, or cynomolgus monkey SDCCAG3. In some embodiments, the human SDCCAG3 comprises a sequence of SEQ ID NO: 4373.

Provided herein is an antibody that competes with an antibody or antigen binding fragment for binding to SDCCAG3, wherein the antibody binds to human SDCCAG3 or mouse SDCCAG3.

Provided herein is an antibody or an antigen binding fragment thereof that selectively binds to charged multivesicular body protein 4B (CHMP4B) or a variant thereof, comprising at least one of: a variable heavy chain region, wherein the variable heavy chain region comprises a complementarity-determining region heavy chain 1 (CDR-H1) of SEQ ID NO: 589, CDR-H2 of SEQ ID NO: 1131, and CDR-H3 of SEQ ID NO: 1673; and/or a variable light chain region, wherein the variable light chain region comprises a complementarity-determining region light chain 1 (CDR-L1) of SEQ ID NO: 860, CDR-L2 of SEQ ID NO: 1402, and CDR-L3 of SEQ ID NO: 1944. In some embodiments, the variable heavy chain comprises a polypeptide consensus sequence having at least 95% sequence identity to the amino acid sequence of SEQ ID NO: 47, and the variable light chain comprises a polypeptide consensus sequence having at least 95% sequence identity to the amino acid sequence of SEQ ID NO: 318. In some embodiments, the antibody or antigen binding fragment thereof binds a human CHMP4B, mouse CHMP4B, rat CHMP4B, bovine CHMP4B, or cynomolgus monkey CHMP4B. In some embodiments, the human CHMP4B comprises a sequence of SEQ ID NO: 4374.

Provided herein is an antibody that competes with an antibody or antigen binding fragment for binding to CHMP4B, wherein the antibody binds to human CHMP4B or mouse CHMP4B.

Provided herein is an antibody or an antigen binding fragment thereof that selectively binds to glycogenin 2, transcript variant 2 (GYG2) or a variant thereof, comprising at least one of: a variable heavy chain region, wherein the variable heavy chain region comprises a complementarity-determining region heavy chain 1 (CDR-H1) of SEQ ID NO: 590, CDR-H2 of SEQ ID NO: 1132, and CDR-H3 of SEQ ID NO: 1674; and/or a variable light chain region, wherein the variable light chain region comprises a complementarity-determining region light chain 1 (CDR-L1) of SEQ ID NO: 861, CDR-L2 of SEQ ID NO: 1403, and CDR-L3 of SEQ ID NO: 1945. In some embodiments, the variable heavy chain comprises a polypeptide consensus sequence having at least 95% sequence identity to the amino acid sequence of SEQ ID NO: 48, and the variable light chain comprises a polypeptide consensus sequence having at least 95% sequence identity to the amino acid sequence of SEQ ID NO: 319. In some embodiments, the antibody or antigen binding fragment thereof binds a human GYG2, mouse GYG2, rat GYG2, bovine GYG2, or cynomolgus monkey GYG2. In some embodiments, the human GYG2 comprises a sequence of SEQ ID NO: 4375.

Provided herein is an antibody that competes with an antibody or antigen binding fragment for binding to GYG2, wherein the antibody binds to human GYG2 or mouse GYG2.

Provided herein is an antibody or an antigen binding fragment thereof that selectively binds to Egf like and emi domain containing 1, pseudogene (EGFEM1P) or a variant thereof, comprising at least one of: a variable heavy chain region, wherein the variable heavy chain region comprises a complementarity-determining region heavy chain 1 (CDR-H1) of SEQ ID NO: 591, CDR-H2 of SEQ ID NO: 1133, and CDR-H3 of SEQ ID NO: 1675; and/or a variable light chain region, wherein the variable light chain region comprises a complementarity-determining region light chain 1 (CDR-L1) of SEQ ID NO: 862, CDR-L2 of SEQ ID NO: 1404, and CDR-L3 of SEQ ID NO: 1946. In some embodiments, the variable heavy chain comprises a polypeptide consensus sequence having at least 95% sequence identity to the amino acid sequence of SEQ ID NO: 49, and the variable light chain comprises a polypeptide consensus sequence having at least 95% sequence identity to the amino acid sequence of SEQ ID NO: 320. In some embodiments, the antibody or antigen binding fragment thereof binds a human EGFEM1P, mouse EGFEM1P, rat EGFEM1P, bovine EGFEM1P, or cynomolgus monkey EGFEM1P. In some embodiments, the human EGFEM1P comprises a sequence of SEQ ID NO: 4376.

Provided herein is an antibody that competes with an antibody or antigen binding fragment for binding to EGFEM1P, wherein the antibody binds to human EGFEM1P or mouse EGFEM1P.

Provided herein is an antibody or an antigen binding fragment thereof that selectively binds to actinin alpha 4, transcript variant 1 (ACTN4) or a variant thereof, comprising at least one of: a variable heavy chain region, wherein the variable heavy chain region comprises a complementarity-determining region heavy chain 1 (CDR-H1) of SEQ ID NO: 593, CDR-H2 of SEQ ID NO: 1135, and CDR-H3 of SEQ ID NO: 1677; and/or a variable light chain region, wherein the variable light chain region comprises a complementarity-determining region light chain 1 (CDR-L1) of SEQ ID NO: 864, CDR-L2 of SEQ ID NO: 1406, and CDR-L3 of SEQ ID NO: 1948. In some embodiments, the variable heavy chain comprises a polypeptide consensus sequence having at least 95% sequence identity to the amino acid sequence of SEQ ID NO: 51, and the variable light chain comprises a polypeptide consensus sequence having at least 95% sequence identity to the amino acid sequence of SEQ ID NO: 322. In some embodiments, the antibody or antigen binding fragment thereof binds a human ACTN4, mouse ACTN4, rat ACTN4, bovine ACTN4, or cynomolgus monkey ACTN4. In some embodiments, the human ACTN4 comprises a sequence of SEQ ID NO: 4377.

Provided herein is an antibody that competes with an antibody or antigen binding fragment for binding to ACTN4, wherein the antibody binds to human ACTN4 or mouse ACTN4.

Provided herein is an antibody or an antigen binding fragment thereof that selectively binds to PNMA family member 5, transcript variant 2 (PNMA5) or a variant thereof, comprising at least one of: a variable heavy chain region, wherein the variable heavy chain region comprises a complementarity-determining region heavy chain 1 (CDR-H1) of SEQ ID NO: 594, CDR-H2 of SEQ ID NO: 1136, and CDR-H3 of SEQ ID NO: 1678; and/or a variable light chain region, wherein the variable light chain region comprises a complementarity-determining region light chain 1 (CDR-L1) of SEQ ID NO: 865, CDR-L2 of SEQ ID NO: 1407, and CDR-L3 of SEQ ID NO: 1949. In some embodiments, the variable heavy chain comprises a polypeptide consensus sequence having at least 95% sequence identity to the amino acid sequence of SEQ ID NO: 52, and the variable light chain comprises a polypeptide consensus sequence having at least 95% sequence identity to the amino acid sequence of SEQ ID NO: 323. In some embodiments, the antibody or antigen binding fragment thereof binds a human PNMA5, mouse PNMA5, rat PNMA5, bovine PNMA5, or cynomolgus monkey PNMA5. In some embodiments, the human PNMA5 comprises a sequence of SEQ ID NO: 4357.

Provided herein is an antibody that competes with an antibody or antigen binding fragment for binding to PNMA5, wherein the antibody binds to human PNMA5 or mouse PNMA5.

Provided herein is an antibody or an antigen binding fragment thereof that selectively binds to phospholipase C delta 1, transcript variant 2 (PLCD1) or a variant thereof, comprising at least one of: a variable heavy chain region, wherein the variable heavy chain region comprises a complementarity-determining region heavy chain 1 (CDR-H1) of SEQ ID NO: 594, CDR-H2 of SEQ ID NO: 1136, and CDR-H3 of SEQ ID NO: 1678; and/or a variable light chain region, wherein the variable light chain region comprises a complementarity-determining region light chain 1 (CDR-L1) of SEQ ID NO: 865, CDR-L2 of SEQ ID NO: 1407, and CDR-L3 of SEQ ID NO: 1949. In some embodiments, the variable heavy chain comprises a polypeptide consensus sequence having at least 95% sequence identity to the amino acid sequence of SEQ ID NO: 52; and the variable light chain comprises a polypeptide consensus sequence having at least 95% sequence identity to the amino acid sequence of SEQ ID NO: 323. In some embodiments, the antibody or antigen binding fragment thereof binds a human PLCD1, mouse PLCD1, rat PLCD1, bovine PLCD1, or cynomolgus monkey PLCD1. In some embodiments, the human PLCD1 comprises a sequence of SEQ ID NO: 4378.

Provided herein is an antibody that competes with an antibody or antigen binding fragment for binding to PLCD1, wherein the antibody binds to human PLCD1 or mouse PLCD1.

Provided herein is an antibody or an antigen binding fragment thereof that selectively binds to zinc finger protein 326, transcript variant 1 (ZNF326) or a variant thereof, comprising at least one of: a variable heavy chain region, wherein the variable heavy chain region comprises a complementarity-determining region heavy chain 1 (CDR-H1) of SEQ ID NO: 594, CDR-H2 of SEQ ID NO: 1136, and CDR-H3 of SEQ ID NO: 1678; and/or a variable light chain region, wherein the variable light chain region comprises a complementarity-determining region light chain 1 (CDR-L1) of SEQ ID NO: 865, CDR-L2 of SEQ ID NO: 1407, and CDR-L3 of SEQ ID NO: 1949. In some embodiments, the variable heavy chain comprises a polypeptide consensus sequence having at least 95% sequence identity to the amino acid sequence of SEQ ID NO: 52, and the variable light chain comprises a polypeptide consensus sequence having at least 95% sequence identity to the amino acid sequence of SEQ ID NO: 323. In some embodiments, the antibody or antigen binding fragment thereof binds a human ZNF326, mouse ZNF326, rat ZNF326, bovine ZNF326, or cynomolgus monkey ZNF326. In some embodiments, the human ZNF326 comprises a sequence of SEQ ID NO: 4379.

Provided herein is an antibody that competes with an antibody or antigen binding fragment for binding to ZNF326, wherein the antibody binds to human ZNF326 or mouse ZNF326.

Provided herein is an antibody or an antigen binding fragment thereof that selectively binds to— (LN608403.1_frag) or a variant thereof, comprising at least one of: a variable heavy chain region, wherein the variable heavy chain region comprises a complementarity-determining region heavy chain 1 (CDR-H1) of SEQ ID NO: 600, CDR-H2 of SEQ ID NO: 1142, and CDR-H3 of SEQ ID NO: 1684; and/or a variable light chain region, wherein the variable light chain region comprises a complementarity-determining region light chain 1 (CDR-L1) of SEQ ID NO: 871, CDR-L2 of SEQ ID NO: 1413, and CDR-L3 of SEQ ID NO: 1955. In some embodiments, the variable heavy chain comprises a polypeptide consensus sequence having at least 95% sequence identity to the amino acid sequence of SEQ ID NO: 58, and the variable light chain comprises a polypeptide consensus sequence having at least 95% sequence identity to the amino acid sequence of SEQ ID NO: 329. In some embodiments, the antibody or antigen binding fragment thereof binds a human LN608403.1_frag, mouse LN608403.1_frag, rat LN608403.1_frag, bovine LN608403.1_frag, or cynomolgus monkey LN608403.1_frag. In some embodiments, the human LN608403.1_frag comprises a sequence of SEQ ID NO: 4380.

Provided herein is an antibody that competes with an antibody or antigen binding fragment for binding to LN608403.1 frag, wherein the antibody binds to human LN608403.1_frag or mouse LN608403.1_frag.

Provided herein is an antibody or an antigen binding fragment thereof that selectively binds to JPX transcript, XIST activator (JPX_frag) or a variant thereof, comprising at least one of: a variable heavy chain region, wherein the variable heavy chain region comprises a complementarity-determining region heavy chain 1 (CDR-H1) of SEQ ID NO: 600, CDR-H2 of SEQ ID NO: 1142, and CDR-H3 of SEQ ID NO: 1684; and/or a variable light chain region, wherein the variable light chain region comprises a complementarity-determining region light chain 1 (CDR-L1) of SEQ ID NO: 871, CDR-L2 of SEQ ID NO: 1413, and CDR-L3 of SEQ ID NO: 1955. In some embodiments, the variable heavy chain comprises a polypeptide consensus sequence having at least 95% sequence identity to the amino acid sequence of SEQ ID NO: 58, and the variable light chain comprises a polypeptide consensus sequence having at least 95% sequence identity to the amino acid sequence of SEQ ID NO: 329. In some embodiments, the antibody or antigen binding fragment thereof binds a human JPX_frag, mouse JPX_frag, rat JPX_frag, bovine JPX_frag, or cynomolgus monkey JPX_frag. In some embodiments, the human JPX_frag comprises a sequence of SEQ ID NO: 4381.

Provided herein is an antibody that competes with an antibody or antigen binding fragment for binding to JPX_frag, wherein the antibody binds to human JPX_frag or mouse JPX_frag.

Provided herein is an antibody or an antigen binding fragment thereof that selectively binds to odorant binding protein 2A, transcript variant alpha (OBP2A) or a variant thereof, comprising at least one of: a variable heavy chain region, wherein the variable heavy chain region comprises a complementarity-determining region heavy chain 1 (CDR-H1) of SEQ ID NO: 600, CDR-H2 of SEQ ID NO: 1142, and CDR-H3 of SEQ ID NO: 1684; and/or a variable light chain region, wherein the variable light chain region comprises a complementarity-determining region light chain 1 (CDR-L1) of SEQ ID NO: 871, CDR-L2 of SEQ ID NO: 1413, and CDR-L3 of SEQ ID NO: 1955. In some embodiments, the variable heavy chain comprises a polypeptide consensus sequence having at least 95% sequence identity to the amino acid sequence of SEQ ID NO: 58, and the variable light chain comprises a polypeptide consensus sequence having at least 95% sequence identity to the amino acid sequence of SEQ ID NO: 329. In some embodiments, the antibody or antigen binding fragment thereof binds a human OBP2A, mouse OBP2A, rat OBP2A, bovine OBP2A, or cynomolgus monkey OBP2A. In some embodiments, the human OBP2A comprises a sequence of SEQ ID NO: 4382.

Provided herein is an antibody that competes with an antibody or antigen binding fragment for binding to OBP2A, wherein the antibody binds to human OBP2A or mouse OBP2A.

Provided herein is an antibody or an antigen binding fragment thereof that selectively binds to myelin transcription factor 1 like, transcript variant 2 (MYT1L) or a variant thereof, comprising at least one of: a variable heavy chain region, wherein the variable heavy chain region comprises a complementarity-determining region heavy chain 1 (CDR-H1) of SEQ ID NO: 604, CDR-H2 of SEQ ID NO: 1146, and CDR-H3 of SEQ ID NO: 1688; and/or a variable light chain region, wherein the variable light chain region comprises a complementarity-determining region light chain 1 (CDR-L1) of SEQ ID NO: 875, CDR-L2 of SEQ ID NO: 1417, and CDR-L3 of SEQ ID NO: 1959. In some embodiments, the variable heavy chain comprises a polypeptide consensus sequence having at least 95% sequence identity to the amino acid sequence of SEQ ID NO: 62, and the variable light chain comprises a polypeptide consensus sequence having at least 95% sequence identity to the amino acid sequence of SEQ ID NO: 333. In some embodiments, the antibody or antigen binding fragment thereof binds a human MYT1L, mouse MYT1L, rat MYT1L, bovine MYT1L, or cynomolgus monkey MYT1L. In some embodiments, the human MYT1L comprises a sequence of SEQ ID NO: 4383.

Provided herein is an antibody that competes with an antibody or antigen binding fragment for binding to MYT1L, wherein the antibody binds to human MYT1L or mouse MYT1L.

Provided herein is an antibody or an antigen binding fragment thereof that selectively binds to heat shock protein family E (Hsp10) member 1 (HSPE1) or a variant thereof, comprising at least one of: a variable heavy chain region, wherein the variable heavy chain region comprises a complementarity-determining region heavy chain 1 (CDR-H1) of SEQ ID NO: 604, CDR-H2 of SEQ ID NO: 1146, and CDR-H3 of SEQ ID NO: 1688; and/or a variable light chain region, wherein the variable light chain region comprises a complementarity-determining region light chain 1 (CDR-L1) of SEQ ID NO: 875, CDR-L2 of SEQ ID NO: 1417, and CDR-L3 of SEQ ID NO: 1959. In some embodiments, the variable heavy chain comprises a polypeptide consensus sequence having at least 95% sequence identity to the amino acid sequence of SEQ ID NO: 62, and the variable light chain comprises a polypeptide consensus sequence having at least 95% sequence identity to the amino acid sequence of SEQ ID NO: 333. In some embodiments, the antibody or antigen binding fragment thereof binds a human HSPE1, mouse HSPE1, rat HSPE1, bovine HSPE1, or cynomolgus monkey HSPE1. In some embodiments, the human HSPE1 comprises a sequence of SEQ ID NO: 4384.

Provided herein is an antibody that competes with an antibody or antigen binding fragment for binding to HSPE1, wherein the antibody binds to human HSPE1 or mouse HSPE1.

Provided herein is an antibody or an antigen binding fragment thereof that selectively binds to kelch like ECH associated protein 1, transcript variant 1 (KEAP1) or a variant thereof, comprising at least one of: a variable heavy chain region, wherein the variable heavy chain region comprises a complementarity-determining region heavy chain 1 (CDR-H1) of SEQ ID NO: 607, CDR-H2 of SEQ ID NO: 1149, and CDR-H3 of SEQ ID NO: 1691; and/or a variable light chain region, wherein the variable light chain region comprises a complementarity-determining region light chain 1 (CDR-L1) of SEQ ID NO: 878, CDR-L2 of SEQ ID NO: 1420, and CDR-L3 of SEQ ID NO: 1962. In some embodiments, the variable heavy chain comprises a polypeptide consensus sequence having at least 95% sequence identity to the amino acid sequence of SEQ ID NO: 65, and the variable light chain comprises a polypeptide consensus sequence having at least 95% sequence identity to the amino acid sequence of SEQ ID NO: 336. In some embodiments, the antibody or antigen binding fragment thereof binds a human KEAP1, mouse KEAP1, rat KEAP1, bovine KEAP1, or cynomolgus monkey KEAP1. In some embodiments, the human KEAP1 comprises a sequence of SEQ ID NO: 4385.

Provided herein is an antibody that competes with an antibody or antigen binding fragment for binding to KEAP1, wherein the antibody binds to human KEAP1 or mouse KEAP1.

Provided herein is an antibody or an antigen binding fragment thereof that selectively binds to nucleosome assembly protein 1 like 1, transcript variant 1 (NAP1L1) or a variant thereof, comprising at least one of: a variable heavy chain region, wherein the variable heavy chain region comprises a complementarity-determining region heavy chain 1 (CDR-H1) of SEQ ID NO: 614, CDR-H2 of SEQ ID NO: 1156, and CDR-H3 of SEQ ID NO: 1698; and/or a variable light chain region, wherein the variable light chain region comprises a complementarity-determining region light chain 1 (CDR-L1) of SEQ ID NO: 885, CDR-L2 of SEQ ID NO: 1427, and CDR-L3 of SEQ ID NO: 1969. In some embodiments, the variable heavy chain comprises a polypeptide consensus sequence having at least 95% sequence identity to the amino acid sequence of SEQ ID NO: 72, and the variable light chain comprises a polypeptide consensus sequence having at least 95% sequence identity to the amino acid sequence of SEQ ID NO: 343. In some embodiments, the antibody or antigen binding fragment thereof binds a human NAP1L1, mouse NAP1L1, rat NAP1L1, bovine NAP1L1, or cynomolgus monkey NAP1L1. In some embodiments, the human NAP1L1 comprises a sequence of SEQ ID NO: 4386.

Provided herein is an antibody that competes with an antibody or antigen binding fragment for binding to NAP1L1, wherein the antibody binds to human NAP1L1 or mouse NAP1L1.

Provided herein is an antibody or an antigen binding fragment thereof that selectively binds to nudE neurodevelopment protein 1, transcript variant 1 (NDE1) or a variant thereof, comprising at least one of: a variable heavy chain region, wherein the variable heavy chain region comprises a complementarity-determining region heavy chain 1 (CDR-H1) of SEQ ID NO: 615, CDR-H2 of SEQ ID NO: 1157, and CDR-H3 of SEQ ID NO: 1699; and/or a variable light chain region, wherein the variable light chain region comprises a complementarity-determining region light chain 1 (CDR-L1) of SEQ ID NO: 886, CDR-L2 of SEQ ID NO: 1428, and CDR-L3 of SEQ ID NO: 1970. In some embodiments, the variable heavy chain comprises a polypeptide consensus sequence having at least 95% sequence identity to the amino acid sequence of SEQ ID NO: 73, and the variable light chain comprises a polypeptide consensus sequence having at least 95% sequence identity to the amino acid sequence of SEQ ID NO: 344. In some embodiments, the antibody or antigen binding fragment thereof binds a human NDE1, mouse NDE1, rat NDE1, bovine NDE1, or cynomolgus monkey NDE1. In some embodiments, the human NDE1 comprises a sequence of SEQ ID NO: 4387.

Provided herein is an antibody that competes with an antibody or antigen binding fragment for binding to NDE1, wherein the antibody binds to human NDE1 or mouse NDE.

Provided herein is an antibody or an antigen binding fragment thereof that selectively binds to TruB pseudouridine synthase family member 1 (TRUB1) or a variant thereof, comprising at least one of: a variable heavy chain region, wherein the variable heavy chain region comprises a complementarity-determining region heavy chain 1 (CDR-H1) of SEQ ID NO: 616, CDR-H2 of SEQ ID NO: 1158, and CDR-H3 of SEQ ID NO: 1700; and/or a variable light chain region, wherein the variable light chain region comprises a complementarity-determining region light chain 1 (CDR-L1) of SEQ ID NO: 887, CDR-L2 of SEQ ID NO: 1429, and CDR-L3 of SEQ ID NO: 1971. In some embodiments, the variable heavy chain comprises a polypeptide consensus sequence having at least 95% sequence identity to the amino acid sequence of SEQ ID NO: 74, and the variable light chain comprises a polypeptide consensus sequence having at least 95% sequence identity to the amino acid sequence of SEQ ID NO: 345. In some embodiments, the antibody or antigen binding fragment thereof binds a human TRUB1, mouse TRUB1, rat TRUB1, bovine TRUB1, or cynomolgus monkey TRUB1. In some embodiments, the human TRUB1 comprises a sequence of SEQ ID NO: 4388.

Provided herein is an antibody that competes with an antibody or antigen binding fragment for binding to TRUB1, wherein the antibody binds to human TRUB1 or mouse TRUB1.

Provided herein is an antibody or an antigen binding fragment thereof that selectively binds to inosine monophosphate dehydrogenase 2 (IMPDH2) or a variant thereof, comprising at least one of: a variable heavy chain region, wherein the variable heavy chain region comprises a complementarity-determining region heavy chain 1 (CDR-H1) of SEQ ID NO: 616, CDR-H2 of SEQ ID NO: 1158, and CDR-H3 of SEQ ID NO: 1700; and/or a variable light chain region, wherein the variable light chain region comprises a complementarity-determining region light chain 1 (CDR-L1) of SEQ ID NO: 887, CDR-L2 of SEQ ID NO: 1429, and CDR-L3 of SEQ ID NO: 1971. In some embodiments, the variable heavy chain comprises a polypeptide consensus sequence having at least 95% sequence identity to the amino acid sequence of SEQ ID NO: 74; and the variable light chain comprises a polypeptide consensus sequence having at least 95% sequence identity to the amino acid sequence of SEQ ID NO: 345. In some embodiments, the antibody or antigen binding fragment thereof binds a human IMPDH2, mouse IMPDH2, rat IMPDH2, bovine IMPDH2, or cynomolgus monkey IMPDH2. In some embodiments, the human IMPDH2 comprises a sequence of SEQ ID NO: 4389.

Provided herein is an antibody that competes with an antibody or antigen binding fragment for binding to IMPDH2, wherein the antibody binds to human IMPDH2 or mouse IMPDH2.

Provided herein is an antibody or an antigen binding fragment thereof that selectively binds to phospholipid scramblase 4, transcript variant X4 (PLSCR4) or a variant thereof, comprising at least one of: a variable heavy chain region, wherein the variable heavy chain region comprises a complementarity-determining region heavy chain 1 (CDR-H1) of SEQ ID NO: 616, CDR-H2 of SEQ ID NO: 1158, and CDR-H3 of SEQ ID NO: 1700; and/or a variable light chain region, wherein the variable light chain region comprises a complementarity-determining region light chain 1 (CDR-L1) of SEQ ID NO: 887, CDR-L2 of SEQ ID NO: 1429, and CDR-L3 of SEQ ID NO: 1971. In some embodiments, the variable heavy chain comprises a polypeptide consensus sequence having at least 95% sequence identity to the amino acid sequence of SEQ ID NO: 74, and the variable light chain comprises a polypeptide consensus sequence having at least 95% sequence identity to the amino acid sequence of SEQ ID NO: 345. In some embodiments, the antibody or antigen binding fragment thereof binds a human PLSCR4, mouse PLSCR4, rat PLSCR4, bovine PLSCR4, or cynomolgus monkey PLSCR4. In some embodiments, the human PLSCR4 comprises a sequence of SEQ ID NO: 4390.

Provided herein is an antibody that competes with an antibody or antigen binding fragment for binding to PLSCR4, wherein the antibody binds to human PLSCR4 or mouse PLSCR4.

Provided herein is an antibody or an antigen binding fragment thereof that selectively binds to influenza virus NS1A binding protein (IVNS1ABP) or a variant thereof, comprising at least one of: a variable heavy chain region, wherein the variable heavy chain region comprises a complementarity-determining region heavy chain 1 (CDR-H1) of SEQ ID NO: 617, CDR-H2 of SEQ ID NO: 1159, and CDR-H3 of SEQ ID NO: 1701; and/or
a variable light chain region, wherein the variable light chain region comprises a complementarity-determining region light chain 1 (CDR-L1) of SEQ ID NO: 888, CDR-L2 of SEQ ID NO: 1430, and CDR-L3 of SEQ ID NO: 1972. In some embodiments, the variable heavy chain comprises a polypeptide consensus sequence having at least 95% sequence identity to the amino acid sequence of SEQ ID NO: 75, and the variable light chain comprises a polypeptide consensus sequence having at least 95% sequence identity to the amino acid sequence of SEQ ID NO: 346. In some embodiments, the antibody or antigen binding fragment thereof binds a human IVNS1ABP, mouse IVNS1ABP, rat IVNS1ABP, bovine IVNS1ABP, or cynomolgus monkey IVNS1ABP. In some embodiments, the human IVNS1ABP comprises a sequence of SEQ ID NO: 4391.

Provided herein is an antibody that competes with an antibody or antigen binding fragment for binding to IVNS1ABP, wherein the antibody binds to human IVNS1ABP or mouse IVNS1ABP.

Provided herein is an antibody or an antigen binding fragment thereof that selectively binds to disheveled segment polarity protein 3 (DVL3) or a variant thereof, comprising at least one of: a variable heavy chain region, wherein the variable heavy chain region comprises a complementarity-determining region heavy chain 1 (CDR-H1) of SEQ ID NO: 618, CDR-H2 of SEQ ID NO: 1160, and CDR-H3 of SEQ ID NO: 1702; and/or a variable light chain region, wherein the variable light chain region comprises a complementarity-determining region light chain 1 (CDR-L1) of SEQ ID NO: 889, CDR-L2 of SEQ ID NO: 1431, and CDR-L3 of SEQ ID NO: 1973. In some embodiments, the variable heavy chain comprises a polypeptide consensus sequence having at least 95% sequence identity to the amino acid sequence of SEQ ID NO: 76, and the variable light chain comprises a polypeptide consensus sequence having at least 95% sequence identity to the amino acid sequence of SEQ ID NO: 347. In some embodiments, the antibody or antigen binding fragment thereof binds a human DVL3, mouse DVL3, rat DVL3, bovine DVL3, or cynomolgus monkey DVL3. In some embodiments, the human DVL3 comprises a sequence of SEQ ID NO: 4392.

Provided herein is an antibody that competes with an antibody or antigen binding fragment for binding to DVL3, wherein the antibody binds to human DVL3 or mouse DVL3.

Provided herein is an antibody or an antigen binding fragment thereof that selectively binds to Zinc finger protein 260 (ZNF260) or a variant thereof, comprising at least one of: a variable heavy chain region, wherein the variable heavy chain region comprises a complementarity-determining region heavy chain 1 (CDR-H1) of SEQ ID NO: 618, CDR-H2 of SEQ ID NO: 1160, and CDR-H3 of SEQ ID NO: 1702; and/or a variable light chain region, wherein the variable light chain region comprises a complementarity-determining region light chain 1 (CDR-L1) of SEQ ID NO: 889, CDR-L2 of SEQ ID NO: 1431, and CDR-L3 of SEQ ID NO: 1973. In some embodiments, the variable heavy chain comprises a polypeptide consensus sequence having at least 95% sequence identity to the amino acid sequence of SEQ ID NO: 76, and the variable light chain comprises a polypeptide consensus sequence having at least 95% sequence identity to the amino acid sequence of SEQ ID NO: 347. In some embodiments, the antibody or antigen binding fragment thereof binds a human ZNF260, mouse ZNF260, rat ZNF260, bovine ZNF260, or cynomolgus monkey ZNF260. In some embodiments, the human ZNF260 comprises a sequence of SEQ ID NO: 4393.

Provided herein is an antibody that competes with an antibody or antigen binding fragment for binding to ZNF260, wherein the antibody binds to human ZNF260 or mouse ZNF260.

Provided herein is an antibody or an antigen binding fragment thereof that selectively binds to sorting nexin 33, transcript variant 1 (SNX33) or a variant thereof, comprising at least one of: a variable heavy chain region, wherein the variable heavy chain region comprises a complementarity-determining region heavy chain 1 (CDR-H1) of SEQ ID NO: 619, CDR-H2 of SEQ ID NO: 1161, and CDR-H3 of SEQ ID NO: 1703; and/or a variable light chain region, wherein the variable light chain region comprises a complementarity-determining region light chain 1 (CDR-L1) of SEQ ID NO: 890, CDR-L2 of SEQ ID NO: 1432, and CDR-L3 of SEQ ID NO: 1974. In some embodiments, the variable heavy chain comprises a polypeptide consensus sequence having at least 95% sequence identity to the amino acid sequence of SEQ ID NO: 77, and the variable light chain comprises a polypeptide consensus sequence having at least 95% sequence identity to the amino acid sequence of SEQ ID NO: 348. In some embodiments, the antibody or antigen binding fragment thereof binds a human SNX33, mouse SNX33, rat SNX33, bovine SNX33, or cynomolgus monkey SNX33. In some embodiments, the human SNX33 comprises a sequence of SEQ ID NO: 4394.

Provided herein is an antibody that competes with an antibody or antigen binding fragment for binding to SNX33, wherein the antibody binds to human SNX33 or mouse SNX33.

Provided herein is an antibody or an antigen binding fragment thereof that selectively binds to Jupiter microtubule associated homolog 2 (HN1L) or a variant thereof, comprising at least one of: a variable heavy chain region, wherein the variable heavy chain region comprises a complementarity-determining region heavy chain 1 (CDR-H1) of SEQ ID NO: 620, CDR-H2 of SEQ ID NO: 1162, and CDR-H3 of SEQ ID NO: 1704; and/or a variable light chain region, wherein the variable light chain region comprises a complementarity-determining region light chain 1 (CDR-L1) of SEQ ID NO: 891, CDR-L2 of SEQ ID NO: 1433, and CDR-L3 of SEQ ID NO: 1975. In some embodiments, the variable heavy chain comprises a polypeptide consensus sequence having at least 95% sequence identity to the amino acid sequence of SEQ ID NO: 78, and the variable light chain comprises a polypeptide consensus sequence having at least 95% sequence identity to the amino acid sequence of SEQ ID NO: 349. In some embodiments, the antibody or antigen binding fragment thereof binds a human HN1L, mouse HN1L, rat HN1L, bovine HN1L, or cynomolgus monkey HN1L. In some embodiments, the human HN1L comprises a sequence of SEQ ID NO: 4395.

Provided herein is an antibody that competes with an antibody or antigen binding fragment for binding to HN1L, wherein the antibody binds to human HN1L or mouse HN1L.

Provided herein is an antibody or an antigen binding fragment thereof that selectively binds to thioesterase superfamily member 6, transcript variant 1 (THEM6) or a variant thereof, comprising at least one of:
a variable heavy chain region, wherein the variable heavy chain region comprises a complementarity-determining region heavy chain 1 (CDR-H1) of SEQ ID NO: 620, CDR-H2 of SEQ ID NO: 1162, and CDR-H3 of SEQ ID NO: 1704; and/or a variable light chain region, wherein the variable light chain region comprises a complementarity-determining region light chain 1 (CDR-L1) of SEQ ID NO: 891, CDR-L2 of SEQ ID NO: 1433, and CDR-L3 of SEQ ID NO: 1975. In some embodiments, the variable heavy chain comprises a polypeptide consensus sequence having at least 95% sequence identity to the amino acid sequence of SEQ ID NO: 78, and the variable light chain comprises a polypeptide consensus sequence having at least 95% sequence identity to the amino acid sequence of SEQ ID NO: 349. In some embodiments, the antibody or antigen binding fragment thereof binds a human THEM6, mouse THEM6, rat THEM6, bovine THEM6, or cynomolgus monkey THEM6. In some embodiments, the human THEM6 comprises a sequence of SEQ ID NO: 4396.

Provided herein is an antibody that competes with an antibody or antigen binding fragment for binding to THEM6, wherein the antibody binds to human THEM6 or mouse THEM6.

Provided herein is an antibody or an antigen binding fragment thereof that selectively binds to KH RNA binding domain containing, signal transduction associated 2, transcript variant 2 (KHDRBS2) or a variant thereof, comprising at least one of: a variable heavy chain region, wherein the variable heavy chain region comprises a complementarity-determining region heavy chain 1 (CDR-H1) of SEQ ID NO: 621, CDR-H2 of SEQ ID NO: 1163, and CDR-H3 of SEQ ID NO: 1705; and/or a variable light chain region, wherein the variable light chain region comprises a complementarity-determining region light chain 1 (CDR-L1) of SEQ ID NO: 892, CDR-L2 of SEQ ID NO: 1434, and CDR-L3 of SEQ ID NO: 1976. In some embodiments, the variable heavy chain comprises a polypeptide consensus sequence having at least 95% sequence identity to the amino acid sequence of SEQ ID NO: 79, and the variable light chain comprises a polypeptide consensus sequence having at least 95% sequence identity to the amino acid sequence of SEQ ID NO: 350. In some embodiments, the antibody or antigen binding fragment thereof binds a human KHDRBS2, mouse KHDRBS2, rat KHDRBS2, bovine KHDRBS2, or cynomolgus monkey KHDRBS2. In some embodiments, the human KHDRBS2 comprises a sequence of SEQ ID NO: 4397.

Provided herein is an antibody that competes with an antibody or antigen binding fragment for binding to KHDRBS2, wherein the antibody binds to human KHDRBS2 or mouse KHDRBS2.

Provided herein is an antibody or an antigen binding fragment thereof that selectively binds to complement C1q like 3 (C1QL3) or a variant thereof, comprising at least one of: a variable heavy chain region, wherein the variable heavy chain region comprises a complementarity-determining region heavy chain 1 (CDR-H1) of SEQ ID NO: 622, CDR-H2 of SEQ ID NO: 1164, and CDR-H3 of SEQ ID NO: 1706; and/or a variable light chain region, wherein the variable light chain region comprises a complementarity-determining region light chain 1 (CDR-L1) of SEQ ID NO: 893, CDR-L2 of SEQ ID NO: 1435, and CDR-L3 of SEQ ID NO: 1977. In some embodiments, the variable heavy chain comprises a polypeptide consensus sequence having at least 95% sequence identity to the amino acid sequence of SEQ ID NO: 80, and the variable light chain comprises a polypeptide consensus sequence having at least 95% sequence identity to the amino acid sequence of SEQ ID NO: 351. In some embodiments, the antibody or antigen binding fragment thereof binds a human C1QL3, mouse C1QL3, rat C1QL3, bovine C1QL3, or cynomolgus monkey C1QL3. In some embodiments, the human C1QL3 comprises a sequence of SEQ ID NO: 4398.

Provided herein is an antibody that competes with an antibody or antigen binding fragment for binding to C1QL3, wherein the antibody binds to human C1QL3 or mouse C1QL3.

Provided herein is an antibody or an antigen binding fragment thereof that selectively binds to protein phosphatase 1 regulatory subunit 27 (PPP1R27) or a variant thereof, comprising at least one of: a variable heavy chain region, wherein the variable heavy chain region comprises a complementarity-determining region heavy chain 1 (CDR-H1) of SEQ ID NO: 623, CDR-H2 of SEQ ID NO: 1165, and CDR-H3 of SEQ ID NO: 1707; and/or a variable light chain region, wherein the variable light chain region comprises a complementarity-determining region light chain 1 (CDR-L1) of SEQ ID NO: 894, CDR-L2 of SEQ ID NO: 1436, and CDR-L3 of SEQ ID NO: 1978. In some embodiments, the variable heavy chain comprises a polypeptide consensus sequence having at least 95% sequence identity to the amino acid sequence of SEQ ID NO: 81, and the variable light chain comprises a polypeptide consensus sequence having at least 95% sequence identity to the amino acid sequence of SEQ ID NO: 352. In some embodiments, the antibody or antigen binding fragment thereof binds a human PPP1R27, mouse PPP1R27, rat PPP1R27, bovine PPP1R27, or cynomolgus monkey PPP1R27. In some embodiments, the human PPP1R27 comprises a sequence of SEQ ID NO: 4399.

Provided herein is an antibody that competes with an antibody or antigen binding fragment for binding to PPP1R27, wherein the antibody binds to human PPP1R27 or mouse PPP1R27.

Provided herein is an antibody or an antigen binding fragment thereof that selectively binds to deoxyribonuclease 1 like 2, transcript variant 1 (DNASE1L2) or a variant thereof, comprising at least one of: a variable heavy chain region, wherein the variable heavy chain region comprises a complementarity-determining region heavy chain 1 (CDR-H1) of SEQ ID NO: 624, CDR-H2 of SEQ ID NO: 1166, and CDR-H3 of SEQ ID NO: 1708; and/or a variable light chain region, wherein the variable light chain region comprises a complementarity-determining region light chain 1 (CDR-L1) of SEQ ID NO: 895, CDR-L2 of SEQ ID NO: 1437, and CDR-L3 of SEQ ID NO: 1979. In some embodiments, the variable heavy chain comprises a polypeptide consensus sequence having at least 95% sequence identity to the amino acid sequence of SEQ ID NO: 82, and the variable light chain comprises a polypeptide consensus sequence having at least 95% sequence identity to the amino acid sequence of SEQ ID NO: 353. In some embodiments, the antibody or antigen binding fragment thereof binds a human DNASE1L2, mouse DNASE1L2, rat DNASE1L2, bovine DNASE1L2, or cynomolgus monkey DNASE1L2. In some embodiments, the human DNASE1L2 comprises a sequence of SEQ ID NO: 4400.

Provided herein is an antibody that competes with an antibody or antigen binding fragment for binding to DNASE1L2, wherein the antibody binds to human DNASE1L2 or mouse DNASE1L2.

Provided herein is an antibody or an antigen binding fragment thereof that selectively binds to extended synaptotagmin 2 (ESYT2_frag) or a variant thereof, comprising at least one of: a variable heavy chain region, wherein the variable heavy chain region comprises a complementarity-determining region heavy chain 1 (CDR-H1) of SEQ ID NO: 625, CDR-H2 of SEQ ID NO: 1167, and CDR-H3 of SEQ ID NO: 1709; and/or a variable light chain region, wherein the variable light chain region comprises a complementarity-determining region light chain 1 (CDR-L1) of SEQ ID NO: 896, CDR-L2 of SEQ ID NO: 1438, and CDR-L3 of SEQ ID NO: 1980. In some embodiments, the variable heavy chain comprises a polypeptide consensus sequence having at least 95% sequence identity to the amino acid sequence of SEQ ID NO: 83, and the variable light chain comprises a polypeptide consensus sequence having at least 95% sequence identity to the amino acid sequence of SEQ ID NO: 354. In some embodiments, the antibody or antigen binding fragment thereof binds a human ESYT2_frag, mouse ESYT2_frag, rat ESYT2_frag, bovine ESYT2_frag, or cynomolgus monkey ESYT2_frag. In some embodiments, the human ESYT2_frag comprises a sequence of SEQ ID NO: 4401.

Provided herein is an antibody that competes with an antibody or antigen binding fragment for binding to ESYT2_frag, wherein the antibody binds to human ESYT2_frag or mouse ESYT2_frag.

Provided herein is an antibody or an antigen binding fragment thereof that selectively binds to C-C motif chemokine ligand 18 (CCL18) or a variant thereof, comprising at least one of: a variable heavy chain region, wherein the variable heavy chain region comprises a complementarity-determining region heavy chain 1 (CDR-H1) of SEQ ID NO: 626, CDR-H2 of SEQ ID NO: 1168, and CDR-H3 of SEQ ID NO: 1710; and/or a variable light chain region, wherein the variable light chain region comprises a complementarity-determining region light chain 1 (CDR-L1) of SEQ ID NO: 897, CDR-L2 of SEQ ID NO: 1439, and CDR-L3 of SEQ ID NO: 1981. In some embodiments, the variable heavy chain comprises a polypeptide consensus sequence having at least 95% sequence identity to the amino acid sequence of SEQ ID NO: 84, and the variable light chain comprises a polypeptide consensus sequence having at least 95% sequence identity to the amino acid sequence of SEQ ID NO: 355. In some embodiments, the antibody or antigen binding fragment thereof binds a human CCL18, mouse CCL18, rat CCL18, bovine CCL18, or cynomolgus monkey CCL18. In some embodiments, the human CCL18 comprises a sequence of SEQ ID NO: 4402.

Provided herein is an antibody that competes with an antibody or antigen binding fragment for binding to CCL18, wherein the antibody binds to human CCL18 or mouse CCL18.

Provided herein is an antibody or an antigen binding fragment thereof that selectively binds to homeobox and leucine zipper encoding (HOMEZ) or a variant thereof, comprising at least one of: a variable heavy chain region, wherein the variable heavy chain region comprises a complementarity-determining region heavy chain 1 (CDR-H1) of SEQ ID NO: 627, CDR-H2 of SEQ ID NO: 1169, and CDR-H3 of SEQ ID NO: 1711; and/or a variable light chain region, wherein the variable light chain region comprises a complementarity-determining region light chain 1 (CDR-L1) of SEQ ID NO: 898, CDR-L2 of SEQ ID NO: 1440, and CDR-L3 of SEQ ID NO: 1982. In some embodiments, the variable heavy chain comprises a polypeptide consensus sequence having at least 95% sequence identity to the amino acid sequence of SEQ ID NO: 85, and the variable light chain comprises a polypeptide consensus sequence having at least 95% sequence identity to the amino acid sequence of SEQ ID NO: 356. In some embodiments, the antibody or antigen binding fragment thereof binds a human HOMEZ, mouse HOMEZ, rat HOMEZ, bovine HOMEZ, or cynomolgus monkey HOMEZ. In some embodiments, the human HOMEZ comprises a sequence of SEQ ID NO: 4403.

Provided herein is an antibody that competes with an antibody or antigen binding fragment for binding to HOMEZ, wherein the antibody binds to human HOMEZ or mouse HOMEZ.

Provided herein is an antibody or an antigen binding fragment thereof that selectively binds to BAR/IMD domain containing adaptor protein 2, transcript variant 3 (BAIAP2) or a variant thereof, comprising at least one of: a variable heavy chain region, wherein the variable heavy chain region comprises a complementarity-determining region heavy chain 1 (CDR-H1) of SEQ ID NO: 627, CDR-H2 of SEQ ID NO: 1169, and CDR-H3 of SEQ ID NO: 1711; and/or a variable light chain region, wherein the variable light chain region comprises a complementarity-determining region light chain 1 (CDR-L1) of SEQ ID NO: 898, CDR-L2 of SEQ ID NO: 1440, and CDR-L3 of SEQ ID NO: 1982. In some embodiments, the variable heavy chain comprises a polypeptide consensus sequence having at least 95% sequence identity to the amino acid sequence of SEQ ID NO: 85, and the variable light chain comprises a polypeptide consensus sequence having at least 95% sequence identity to the amino acid sequence of SEQ ID NO: 356. In some embodiments, the antibody or antigen binding fragment thereof binds a human BAIAP2, mouse BAIAP2, rat BAIAP2, bovine BAIAP2, or cynomolgus monkey BAIAP2. In some embodiments, the human BAIAP2 comprises a sequence of SEQ ID NO: 4404.

Provided herein is an antibody that competes with an antibody or antigen binding fragment for binding to BAIAP2, wherein the antibody binds to human BAIAP2 or mouse BAIAP2.

Provided herein is an antibody or an antigen binding fragment thereof that selectively binds to kelch like ECH associated protein 1, transcript variant 1 (KEAP1) or a variant thereof, comprising at least one of: a variable heavy chain region, wherein the variable heavy chain region comprises a complementarity-determining region heavy chain 1 (CDR-H1) of SEQ ID NO: 628, CDR-H2 of SEQ ID NO: 1170, and CDR-H3 of SEQ ID NO: 1712; and/or a variable light chain region, wherein the variable light chain region comprises a complementarity-determining region light chain 1 (CDR-L1) of SEQ ID NO: 899, CDR-L2 of SEQ ID NO: 1441, and CDR-L3 of SEQ ID NO: 1983. In some embodiments, the variable heavy chain comprises a polypeptide consensus sequence having at least 95% sequence identity to the amino acid sequence of SEQ ID NO: 86, and the variable light chain comprises a polypeptide consensus sequence having at least 95% sequence identity to the amino acid sequence of SEQ ID NO: 357. In some embodiments, the antibody or antigen binding fragment thereof binds a human KEAP1, mouse KEAP1, rat KEAP1, bovine KEAP1, or cynomolgus monkey KEAP1. In some embodiments, the human KEAP1 comprises a sequence of SEQ ID NO: 4385.

Provided herein is an antibody that competes with an antibody or antigen binding fragment for binding to KEAP1, wherein the antibody binds to human KEAP1 or mouse KEAP1.

Provided herein is an antibody or an antigen binding fragment thereof that selectively binds to RUN and FYVE domain containing 3, transcript variant 2 (RUFY3) or a variant thereof, comprising at least one of: a variable heavy chain region, wherein the variable heavy chain region comprises a complementarity-determining region heavy chain 1 (CDR-H1) of SEQ ID NO: 629, CDR-H2 of SEQ ID NO: 1171, and CDR-H3 of SEQ ID NO: 1713; and/or a variable light chain region, wherein the variable light chain region comprises a complementarity-determining region light chain 1 (CDR-L1) of SEQ ID NO: 900, CDR-L2 of SEQ ID NO: 1442, and CDR-L3 of SEQ ID NO: 1984. In some embodiments, the variable heavy chain comprises a polypeptide consensus sequence having at least 95% sequence identity to the amino acid sequence of SEQ ID NO: 87, and the variable light chain comprises a polypeptide consensus sequence having at least 95% sequence identity to the amino acid sequence of SEQ ID NO: 358. In some embodiments, the antibody or antigen binding fragment thereof binds a human RUFY3, mouse RUFY3, rat RUFY3, bovine RUFY3, or cynomolgus monkey RUFY3. In some embodiments, the human RUFY3 comprises a sequence of SEQ ID NO: 4405.

Provided herein is an antibody that competes with an antibody or antigen binding fragment for binding to RUFY3, wherein the antibody binds to human RUFY3 or mouse RUFY3.

Provided herein is an antibody or an antigen binding fragment thereof that selectively binds to LIM homeobox 5 (LHX5) or a variant thereof, comprising at least one of: a variable heavy chain region, wherein the variable heavy chain region comprises a complementarity-determining region heavy chain 1 (CDR-H1) of SEQ ID NO: 630, CDR-H2 of SEQ ID NO: 1172, and CDR-H3 of SEQ ID NO: 1714; and/or a variable light chain region, wherein the variable light chain region comprises a complementarity-determining region light chain 1 (CDR-L1) of SEQ ID NO: 901, CDR-L2 of SEQ ID NO: 1443, and CDR-L3 of SEQ ID NO: 1985. In some embodiments, the variable heavy chain comprises a polypeptide consensus sequence having at least 95% sequence identity to the amino acid sequence of SEQ ID NO: 88, and the variable light chain comprises a polypeptide consensus sequence having at least 95% sequence identity to the amino acid sequence of SEQ ID NO: 359. In some embodiments, the antibody or antigen binding fragment thereof binds a human LHX5, mouse LHX5, rat LHX5, bovine LHX5, or cynomolgus monkey LHX5. In some embodiments, the human LHX5 comprises a sequence of SEQ ID NO: 4406.

Provided herein is an antibody that competes with an antibody or antigen binding fragment for binding to LHX5, wherein the antibody binds to human LHX5 or mouse LHX5.

Provided herein is an antibody or an antigen binding fragment thereof that selectively binds to growth factor receptor bound protein 2, transcript variant 1 (GRB2) or a variant thereof, comprising at least one of: a variable heavy chain region, wherein the variable heavy chain region comprises a complementarity-determining region heavy chain 1 (CDR-H1) of SEQ ID NO: 630, CDR-H2 of SEQ ID NO:

1172, and CDR-H3 of SEQ ID NO: 1714; and/or a variable light chain region, wherein the variable light chain region comprises a complementarity-determining region light chain 1 (CDR-L1) of SEQ ID NO: 901, CDR-L2 of SEQ ID NO: 1443, and CDR-L3 of SEQ ID NO: 1985. In some embodiments, the variable heavy chain comprises a polypeptide consensus sequence having at least 95% sequence identity to the amino acid sequence of SEQ ID NO: 88, and the variable light chain comprises a polypeptide consensus sequence having at least 95% sequence identity to the amino acid sequence of SEQ ID NO: 359. In some embodiments, the antibody or antigen binding fragment thereof binds a human GRB2, mouse GRB2, rat GRB2, bovine GRB2, or cynomolgus monkey GRB2. In some embodiments, the human GRB2 comprises a sequence of SEQ ID NO: 4407.

Provided herein is an antibody that competes with an antibody or antigen binding fragment for binding to GRB2, wherein the antibody binds to human GRB2 or mouse GRB2.

Provided herein is an antibody or an antigen binding fragment thereof that selectively binds to Tyrosine hydroxylase (TH) or a variant thereof, comprising at least one of: a variable heavy chain region, wherein the variable heavy chain region comprises a complementarity-determining region heavy chain 1 (CDR-H1) of SEQ ID NO: 631, CDR-H2 of SEQ ID NO: 1173, and CDR-H3 of SEQ ID NO: 1715; and/or a variable light chain region, wherein the variable light chain region comprises a complementarity-determining region light chain 1 (CDR-L1) of SEQ ID NO: 902, CDR-L2 of SEQ ID NO: 1444, and CDR-L3 of SEQ ID NO: 1986. In some embodiments, the variable heavy chain comprises a polypeptide consensus sequence having at least 95% sequence identity to the amino acid sequence of SEQ ID NO: 89, and the variable light chain comprises a polypeptide consensus sequence having at least 95% sequence identity to the amino acid sequence of SEQ ID NO: 360. In some embodiments, the antibody or antigen binding fragment thereof binds a human TH, mouse TH, rat TH, bovine TH, or cynomolgus monkey TH. In some embodiments, the human TH comprises a sequence of SEQ ID NO: 4408.

Provided herein is an antibody that competes with an antibody or antigen binding fragment for binding to TH, wherein the antibody binds to human TH or mouse TH.

Provided herein is an antibody or an antigen binding fragment thereof that selectively binds to leucine rich repeat containing 28, transcript variant 1 (LRRC28) or a variant thereof, comprising at least one of: a variable heavy chain region, wherein the variable heavy chain region comprises a complementarity-determining region heavy chain 1 (CDR-H1) of SEQ ID NO: 633, CDR-H2 of SEQ ID NO: 1175, and CDR-H3 of SEQ ID NO: 1717; and/or a variable light chain region, wherein the variable light chain region comprises a complementarity-determining region light chain 1 (CDR-L1) of SEQ ID NO: 904, CDR-L2 of SEQ ID NO: 1446, and CDR-L3 of SEQ ID NO: 1988. In some embodiments, the variable heavy chain comprises a polypeptide consensus sequence having at least 95% sequence identity to the amino acid sequence of SEQ ID NO: 91, and the variable light chain comprises a polypeptide consensus sequence having at least 95% sequence identity to the amino acid sequence of SEQ ID NO: 362. In some embodiments, the antibody or antigen binding fragment thereof binds a human LRRC28, mouse LRRC28, rat LRRC28, bovine LRRC28, or cynomolgus monkey LRRC28. In some embodiments, the human LRRC28 comprises a sequence of SEQ ID NO: 4409.

Provided herein is an antibody that competes with an antibody or antigen binding fragment for binding to LRRC28, wherein the antibody binds to human LRRC28 or mouse LRRC28.

Provided herein is an antibody or an antigen binding fragment thereof that selectively binds to spermatogenesis associated 33, transcript variant 2 (SPATA33) or a variant thereof, comprising at least one of: a variable heavy chain region, wherein the variable heavy chain region comprises a complementarity-determining region heavy chain 1 (CDR-H1) of SEQ ID NO: 635, CDR-H2 of SEQ ID NO: 1177, and CDR-H3 of SEQ ID NO: 1719; and/or a variable light chain region, wherein the variable light chain region comprises a complementarity-determining region light chain 1 (CDR-L1) of SEQ ID NO: 906, CDR-L2 of SEQ ID NO: 1448, and CDR-L3 of SEQ ID NO: 1990. In some embodiments, the variable heavy chain comprises a polypeptide consensus sequence having at least 95% sequence identity to the amino acid sequence of SEQ ID NO: 93, and the variable light chain comprises a polypeptide consensus sequence having at least 95% sequence identity to the amino acid sequence of SEQ ID NO: 364. In some embodiments, the antibody or antigen binding fragment thereof binds a human SPATA33, mouse SPATA33, rat SPATA33, bovine SPATA33, or cynomolgus monkey SPATA33. In some embodiments, the human SPATA33 comprises a sequence of SEQ ID NO: 4410.

Provided herein is an antibody that competes with an antibody or antigen binding fragment for binding to SPATA33, wherein the antibody binds to human SPATA33 or mouse SPATA33.

Provided herein is an antibody or an antigen binding fragment thereof that selectively binds to Atpase secretory pathway ca2+ transporting 1 (ATP2C1) or a variant thereof, comprising at least one of: a variable heavy chain region, wherein the variable heavy chain region comprises a complementarity-determining region heavy chain 1 (CDR-H1) of SEQ ID NO: 636, CDR-H2 of SEQ ID NO: 1178, and CDR-H3 of SEQ ID NO: 1720; and/or a variable light chain region, wherein the variable light chain region comprises a complementarity-determining region light chain 1 (CDR-L1) of SEQ ID NO: 907, CDR-L2 of SEQ ID NO: 1449, and CDR-L3 of SEQ ID NO: 1991. In some embodiments, the variable heavy chain comprises a polypeptide consensus sequence having at least 95% sequence identity to the amino acid sequence of SEQ ID NO: 94, and the variable light chain comprises a polypeptide consensus sequence having at least 95% sequence identity to the amino acid sequence of SEQ ID NO: 365. In some embodiments, the antibody or antigen binding fragment thereof binds a human ATP2C1, mouse ATP2C1, rat ATP2C1, bovine ATP2C1, or cynomolgus monkey ATP2C1. In some embodiments, the human ATP2C1 comprises a sequence of SEQ ID NO: 4411.

Provided herein is an antibody that competes with an antibody or antigen binding fragment for binding to ATP2C1, wherein the antibody binds to human ATP2C1 or mouse ATP2C1.

Provided herein is an antibody or an antigen binding fragment thereof that selectively binds to teashirt zinc finger homeobox 2, transcript variant 1 (TSHZ2) or a variant thereof, comprising at least one of: a variable heavy chain region, wherein the variable heavy chain region comprises a complementarity-determining region heavy chain 1 (CDR-H1) of SEQ ID NO: 636, CDR-H2 of SEQ ID NO: 1178, and CDR-H3 of SEQ ID NO: 1720; and/or a variable light chain region, wherein the variable light chain region comprises a complementarity-determining region light chain 1 (CDR- L1) of SEQ ID NO: 907, CDR-L2 of SEQ ID NO: 1449, and CDR-L3 of SEQ ID NO: 1991. In some embodiments, the variable heavy chain comprises a polypeptide consensus sequence having at least 95% sequence identity to the amino acid sequence of SEQ ID NO: 94, and the variable light chain comprises a polypeptide consensus sequence having at least 95% sequence identity to the amino acid sequence of SEQ ID NO: 365. In some embodiments, the antibody or antigen binding fragment thereof binds a human TSHZ2, mouse TSHZ2, rat TSHZ2, bovine TSHZ2, or cynomolgus monkey TSHZ2. In some embodiments, the human TSHZ2 comprises a sequence of SEQ ID NO: 4412.

Provided herein is an antibody that competes with an antibody or antigen binding fragment for binding to TSHZ2, wherein the antibody binds to human TSHZ2 or mouse TSHZ2.

Provided herein is an antibody or an antigen binding fragment thereof that selectively binds to Complement component 4 binding protein beta (C4BPB) or a variant thereof, comprising at least one of: a variable heavy chain region, wherein the variable heavy chain region comprises a complementarity-determining region heavy chain 1 (CDR-H1) of SEQ ID NO: 639, CDR-H2 of SEQ ID NO: 1181, and CDR-H3 of SEQ ID NO: 1723; and/or a variable light chain region, wherein the variable light chain region comprises a complementarity-determining region light chain 1 (CDR-L1) of SEQ ID NO: 910, CDR-L2 of SEQ ID NO: 1452, and CDR-L3 of SEQ ID NO: 1994. In some embodiments, the variable heavy chain comprises a polypeptide consensus sequence having at least 95% sequence identity to the amino acid sequence of SEQ ID NO: 97, and the variable light chain comprises a polypeptide consensus sequence having at least 95% sequence identity to the amino acid sequence of SEQ ID NO: 368. In some embodiments, the antibody or antigen binding fragment thereof binds a human C4BPB, mouse C4BPB, rat C4BPB, bovine C4BPB, or cynomolgus monkey C4BPB. In some embodiments, the human C4BPB comprises a sequence of SEQ ID NO: 4413.

Provided herein is an antibody that competes with an antibody or antigen binding fragment for binding to C4BPB, wherein the antibody binds to human C4BPB or mouse C4BPB.

Provided herein is an antibody or an antigen binding fragment thereof that selectively binds to NCCRP1, F-box associated domain containing (NCCRP1) or a variant thereof, comprising at least one of: a variable heavy chain region, wherein the variable heavy chain region comprises a complementarity-determining region heavy chain 1 (CDR-H1) of SEQ ID NO: 640, CDR-H2 of SEQ ID NO: 1182, and CDR-H3 of SEQ ID NO: 1724; and/or a variable light chain region, wherein the variable light chain region comprises a complementarity-determining region light chain 1 (CDR-L1) of SEQ ID NO: 911, CDR-L2 of SEQ ID NO: 1453, and CDR-L3 of SEQ ID NO: 1995. In some embodiments, the variable heavy chain comprises a polypeptide consensus sequence having at least 95% sequence identity to the amino acid sequence of SEQ ID NO: 98, and the variable light chain comprises a polypeptide consensus sequence having at least 95% sequence identity to the amino acid sequence of SEQ ID NO: 369. In some embodiments, the antibody or antigen binding fragment thereof binds a human NCCRP1, mouse NCCRP1, rat NCCRP1, bovine NCCRP1, or cynomolgus monkey NCCRP1. In some embodiments, the human NCCRP1 comprises a sequence of SEQ ID NO: 4414.

Provided herein is an antibody that competes with an antibody or antigen binding fragment for binding to NCCRP1, wherein the antibody binds to human NCCRP1 or mouse NCCRP1.

Provided herein is an antibody or an antigen binding fragment thereof that selectively binds to coiled-coil domain containing 102A, transcript variant X1 (CCDC102A) or a variant thereof, comprising at least one of: a variable heavy chain region, wherein the variable heavy chain region comprises a complementarity-determining region heavy chain 1 (CDR-H1) of SEQ ID NO: 640, CDR-H2 of SEQ ID NO: 1182, and CDR-H3 of SEQ ID NO: 1724; and/or a variable light chain region, wherein the variable light chain region comprises a complementarity-determining region light chain 1 (CDR-L1) of SEQ ID NO: 911, CDR-L2 of SEQ ID NO: 1453, and CDR-L3 of SEQ ID NO: 1995. In some embodiments, the variable heavy chain comprises a polypeptide consensus sequence having at least 95% sequence identity to the amino acid sequence of SEQ ID NO: 98, and the variable light chain comprises a polypeptide consensus sequence having at least 95% sequence identity to the amino acid sequence of SEQ ID NO: 369. In some embodiments, the antibody or antigen binding fragment thereof binds a human CCDC102A, mouse CCDC102A, rat CCDC102A, bovine CCDC102A, or cynomolgus monkey CCDC102A. In some embodiments, the human CCDC102A comprises a sequence of SEQ ID NO: 4415.

Provided herein is an antibody that competes with an antibody or antigen binding fragment for binding to CCDC102A, wherein the antibody binds to human CCDC102A or mouse CCDC102A.

Provided herein is an antibody or an antigen binding fragment thereof that selectively binds to RNA binding motif protein 47, transcript variant X10 (RBM47) or a variant thereof, comprising at least one of: a variable heavy chain region, wherein the variable heavy chain region comprises a complementarity-determining region heavy chain 1 (CDR-H1) of SEQ ID NO: 641, CDR-H2 of SEQ ID NO: 1183, and CDR-H3 of SEQ ID NO: 1725; and/or a variable light chain region, wherein the variable light chain region comprises a complementarity-determining region light chain 1 (CDR-L1) of SEQ ID NO: 912, CDR-L2 of SEQ ID NO: 1454, and CDR-L3 of SEQ ID NO: 1996. In some embodiments, the variable heavy chain comprises a polypeptide consensus sequence having at least 95% sequence identity to the amino acid sequence of SEQ ID NO: 99, and the variable light chain comprises a polypeptide consensus sequence having at least 95% sequence identity to the amino acid sequence of SEQ ID NO: 370. In some embodiments, the antibody or antigen binding fragment thereof binds a human RBM47, mouse RBM47, rat RBM47, bovine RBM47, or cynomolgus monkey RBM47. In some embodiments, the human RBM47 comprises a sequence of SEQ ID NO: 4416.

Provided herein is an antibody that competes with an antibody or antigen binding fragment for binding to RBM47, wherein the antibody binds to human RBM47 or mouse RBM47.

Provided herein is an antibody or an antigen binding fragment thereof that selectively binds to RAD1 checkpoint DNA exonuclease, transcript variant 1 (RAD1) or a variant thereof, comprising at least one of: a variable heavy chain region, wherein the variable heavy chain region comprises a complementarity-determining region heavy chain 1 (CDR-H1) of SEQ ID NO: 643, CDR-H2 of SEQ ID NO: 1185, and CDR-H3 of SEQ ID NO: 1727; and/or a variable light chain region, wherein the variable light chain region comprises a complementarity-determining region light chain 1 (CDR- L1) of SEQ ID NO: 914, CDR-L2 of SEQ ID NO: 1456, and CDR-L3 of SEQ ID NO: 1998. In some embodiments, the variable heavy chain comprises a polypeptide consensus sequence having at least 95% sequence identity to the amino acid sequence of SEQ ID NO: 101, and the variable light chain comprises a polypeptide consensus sequence having at least 95% sequence identity to the amino acid sequence of SEQ ID NO: 372. In some embodiments, the antibody or antigen binding fragment thereof binds a human RAD1, mouse RAD1, rat RAD1, bovine RAD1, or cynomolgus monkey RAD1. In some embodiments, the human RAD1 comprises a sequence of SEQ ID NO: 4417.

Provided herein is an antibody that competes with an antibody or antigen binding fragment for binding to RAD1, wherein the antibody binds to human RAD1 or mouse RAD.

Provided herein is an antibody or an antigen binding fragment thereof that selectively binds to Microtubule associated scaffold protein 1 (MTUS1) or a variant thereof, comprising at least one of: a variable heavy chain region, wherein the variable heavy chain region comprises a complementarity-determining region heavy chain 1 (CDR-H1) of SEQ ID NO: 643, CDR-H2 of SEQ ID NO: 1185, and CDR-H3 of SEQ ID NO: 1727; and/or a variable light chain region, wherein the variable light chain region comprises a complementarity-determining region light chain 1 (CDR-L1) of SEQ ID NO: 914, CDR-L2 of SEQ ID NO: 1456, and CDR-L3 of SEQ ID NO: 1998. In some embodiments, the variable heavy chain comprises a polypeptide consensus sequence having at least 95% sequence identity to the amino acid sequence of SEQ ID NO: 101, and the variable light chain comprises a polypeptide consensus sequence having at least 95% sequence identity to the amino acid sequence of SEQ ID NO: 372. In some embodiments, the antibody or antigen binding fragment thereof binds a human MTUS1, mouse MTUS1, rat MTUS1, bovine MTUS1, or cynomolgus monkey MTUS1. In some embodiments, the human MTUS1 comprises a sequence of SEQ ID NO: 4418.

Provided herein is an antibody that competes with an antibody or antigen binding fragment for binding to MTUS1, wherein the antibody binds to human MTUS1 or mouse MTUS1.

Provided herein is an antibody or an antigen binding fragment thereof that selectively binds to kelch like ECH associated protein 1, transcript variant 1 (KEAP1) or a variant thereof, comprising at least one of: a variable heavy chain region, wherein the variable heavy chain region comprises a complementarity-determining region heavy chain 1 (CDR-H1) of SEQ ID NO: 645, CDR-H2 of SEQ ID NO: 1187, and CDR-H3 of SEQ ID NO: 1729; and/or a variable light chain region, wherein the variable light chain region comprises a complementarity-determining region light chain 1 (CDR-L1) of SEQ ID NO: 916, CDR-L2 of SEQ ID NO: 1458, and CDR-L3 of SEQ ID NO: 2000. In some embodiments, the variable heavy chain comprises a polypeptide consensus sequence having at least 95% sequence identity to the amino acid sequence of SEQ ID NO: 103, and the variable light chain comprises a polypeptide consensus sequence having at least 95% sequence identity to the amino acid sequence of SEQ ID NO: 374. In some embodiments, the antibody or antigen binding fragment thereof binds a human KEAP1, mouse KEAP1, rat KEAP1, bovine KEAP1, or cynomolgus monkey KEAP1. In some embodiments, the human KEAP1 comprises a sequence of SEQ ID NO: 4385.

Provided herein is an antibody that competes with an antibody or antigen binding fragment for binding to KEAP1, wherein the antibody binds to human KEAP1 or mouse KEAP1.

Provided herein is an antibody or an antigen binding fragment thereof that selectively binds to PNMA family member 5, transcript variant 2 (PNMA5) or a variant thereof, comprising at least one of: a variable heavy chain region, wherein the variable heavy chain region comprises a complementarity-determining region heavy chain 1 (CDR-H1) of SEQ ID NO: 646, CDR-H2 of SEQ ID NO: 1188, and CDR-H3 of SEQ ID NO: 1730; and/or a variable light chain region, wherein the variable light chain region comprises a complementarity-determining region light chain 1 (CDR-L1) of SEQ ID NO: 917, CDR-L2 of SEQ ID NO: 1459, and CDR-L3 of SEQ ID NO: 2001. In some embodiments, the variable heavy chain comprises a polypeptide consensus sequence having at least 95% sequence identity to the amino acid sequence of SEQ ID NO: 104, and the variable light chain comprises a polypeptide consensus sequence having at least 95% sequence identity to the amino acid sequence of SEQ ID NO: 375. In some embodiments, the antibody or antigen binding fragment thereof binds a human PNMA5, mouse PNMA5, rat PNMA5, bovine PNMA5, or cynomolgus monkey PNMA5. In some embodiments, the human PNMA5 comprises a sequence of SEQ ID NO: 4357.

Provided herein is an antibody that competes with an antibody or antigen binding fragment for binding to PNMA5, wherein the antibody binds to human PNMA5 or mouse PNMA5.

Provided herein is an antibody or an antigen binding fragment thereof that selectively binds to G protein-coupled receptor 83, transcript variant 1 (GPR83) or a variant thereof, comprising at least one of: a variable heavy chain region, wherein the variable heavy chain region comprises a complementarity-determining region heavy chain 1 (CDR-H1) of SEQ ID NO: 650, CDR-H2 of SEQ ID NO: 1192, and CDR-H3 of SEQ ID NO: 1734; and/or a variable light chain region, wherein the variable light chain region comprises a complementarity-determining region light chain 1 (CDR-L1) of SEQ ID NO: 921, CDR-L2 of SEQ ID NO: 1463, and CDR-L3 of SEQ ID NO: 2005. In some embodiments, the variable heavy chain comprises a polypeptide consensus sequence having at least 95% sequence identity to the amino acid sequence of SEQ ID NO: 108, and the variable light chain comprises a polypeptide consensus sequence having at least 95% sequence identity to the amino acid sequence of SEQ ID NO: 379. In some embodiments, the antibody or antigen binding fragment thereof binds a human GPR83, mouse GPR83, rat GPR83, bovine GPR83, or cynomolgus monkey GPR83. In some embodiments, the human GPR83 comprises a sequence of SEQ ID NO: 4419.

Provided herein is an antibody that competes with an antibody or antigen binding fragment for binding to GPR83, wherein the antibody binds to human GPR83 or mouse GPR83.

Provided herein is an antibody or an antigen binding fragment thereof that selectively binds to CDP-diacylglycerol synthase 1 (CDS1) or a variant thereof, comprising at least one of: a variable heavy chain region, wherein the variable heavy chain region comprises a complementarity-determining region heavy chain 1 (CDR-H1) of SEQ ID NO: 651, CDR-H2 of SEQ ID NO: 1193, and CDR-H3 of SEQ ID NO: 1735; and/or a variable light chain region, wherein the variable light chain region comprises a complementarity-determining region light chain 1 (CDR-L1) of SEQ ID NO: 922, CDR-L2 of SEQ ID NO: 1464, and CDR-L3 of SEQ ID NO: 2006. In some embodiments, the variable heavy chain comprises a polypeptide consensus sequence having at least 95% sequence identity to the amino acid sequence of SEQ ID NO: 109, and the variable light chain comprises a polypeptide consensus sequence having at least 95% sequence identity to the amino acid sequence of SEQ ID NO: 380. In some embodiments, the antibody or antigen binding fragment thereof binds a human CDS1, mouse CDS1, rat CDS1, bovine CDS1, or cynomolgus monkey CDS1. In some embodiments, the human CDS1 comprises a sequence of SEQ ID NO: 4420.

Provided herein is an antibody that competes with an antibody or antigen binding fragment for binding to CDS1, wherein the antibody binds to human CDS1 or mouse CDS1.

Provided herein is an antibody or an antigen binding fragment thereof that selectively binds to dynein axonemal assembly factor 3, transcript variant 3 (DNAAF3) or a variant thereof, comprising at least one of: a variable heavy chain region, wherein the variable heavy chain region comprises a complementarity-determining region heavy chain 1 (CDR-H1) of SEQ ID NO: 651, CDR-H2 of SEQ ID NO: 1193, and CDR-H3 of SEQ ID NO: 1735; and/or a variable light chain region, wherein the variable light chain region comprises a complementarity-determining region light chain 1 (CDR-L1) of SEQ ID NO: 922, CDR-L2 of SEQ ID NO: 1464, and CDR-L3 of SEQ ID NO: 2006. In some embodiments, the variable heavy chain comprises a polypeptide consensus sequence having at least 95% sequence identity to the amino acid sequence of SEQ ID NO: 109, and the variable light chain comprises a polypeptide consensus sequence having at least 95% sequence identity to the amino acid sequence of SEQ ID NO: 380. In some embodiments, the antibody or antigen binding fragment thereof binds a human DNAAF3, mouse DNAAF3, rat DNAAF3, bovine DNAAF3, or cynomolgus monkey DNAAF3. In some embodiments, the human DNAAF3 comprises a sequence of SEQ ID NO: 4421.

Provided herein is an antibody that competes with an antibody or antigen binding fragment for binding to DNAAF3, wherein the antibody binds to human DNAAF3 or mouse DNAAF3.

Provided herein is an antibody or an antigen binding fragment thereof that selectively binds to copine 1, transcript variant 2 (CPNE1) or a variant thereof, comprising at least one of: a variable heavy chain region, wherein the variable heavy chain region comprises a complementarity-determining region heavy chain 1 (CDR-H1) of SEQ ID NO: 652, CDR-H2 of SEQ ID NO: 1194, and CDR-H3 of SEQ ID NO: 1736; and/or a variable light chain region, wherein the variable light chain region comprises a complementarity-determining region light chain 1 (CDR-L1) of SEQ ID NO: 923, CDR-L2 of SEQ ID NO: 1465, and CDR-L3 of SEQ ID NO: 2007. In some embodiments, the variable heavy chain comprises a polypeptide consensus sequence having at least 95% sequence identity to the amino acid sequence of SEQ ID NO: 110, and the variable light chain comprises a polypeptide consensus sequence having at least 95% sequence identity to the amino acid sequence of SEQ ID NO: 381. In some embodiments, the antibody or antigen binding fragment thereof binds a human CPNE1, mouse CPNE1, rat CPNE1, bovine CPNE1, or cynomolgus monkey CPNE1. In some embodiments, the human CPNE1 comprises a sequence of SEQ ID NO: 4422.

Provided herein is an antibody that competes with an antibody or antigen binding fragment for binding to CPNE1, wherein the antibody binds to human CPNE1 or mouse CPNE1.

Provided herein is an antibody or an antigen binding fragment thereof that selectively binds to aarF domain containing kinase 5 (ADCK5) or a variant thereof, comprising at least one of: a variable heavy chain region, wherein the variable heavy chain region comprises a complementarity-determining region heavy chain 1 (CDR-H1) of SEQ ID NO: 653, CDR-H2 of SEQ ID NO: 1195, and CDR-H3 of SEQ ID NO: 1737; and/or a variable light chain region, wherein the variable light chain region comprises a complementarity-determining region light chain 1 (CDR-L1) of SEQ ID NO: 924, CDR-L2 of SEQ ID NO: 1466, and CDR-L3 of SEQ ID NO: 2008. In some embodiments, the variable heavy chain comprises a polypeptide consensus sequence having at least 95% sequence identity to the amino acid sequence of SEQ ID NO: 111, and the variable light chain comprises a polypeptide consensus sequence having at least 95% sequence identity to the amino acid sequence of SEQ ID NO: 382. In some embodiments, the antibody or antigen binding fragment thereof binds a human ADCK5, mouse ADCK5, rat ADCK5, bovine ADCK5, or cynomolgus monkey ADCK5. In some embodiments, the human ADCK5 comprises a sequence of SEQ ID NO: 4423.

Provided herein is an antibody that competes with an antibody or antigen binding fragment for binding to ADCK5, wherein the antibody binds to human ADCK5 or mouse ADCK5.

Provided herein is an antibody or an antigen binding fragment thereof that selectively binds to crystallin alpha B, transcript variant 2 (CRYAB) or a variant thereof, comprising at least one of: a variable heavy chain region, wherein the variable heavy chain region comprises a complementarity-determining region heavy chain 1 (CDR-H1) of SEQ ID NO: 655, CDR-H2 of SEQ ID NO: 1197, and CDR-H3 of SEQ ID NO: 1739; and/or a variable light chain region, wherein the variable light chain region comprises a complementarity-determining region light chain 1 (CDR-L1) of SEQ ID NO: 926, CDR-L2 of SEQ ID NO: 1468, and CDR-L3 of SEQ ID NO: 2010. In some embodiments, the variable heavy chain comprises a polypeptide consensus sequence having at least 95% sequence identity to the amino acid sequence of SEQ ID NO: 113, and the variable light chain comprises a polypeptide consensus sequence having at least 95% sequence identity to the amino acid sequence of SEQ ID NO: 384. In some embodiments, the antibody or antigen binding fragment thereof binds a human CRYAB, mouse CRYAB, rat CRYAB, bovine CRYAB, or cynomolgus monkey CRYAB. In some embodiments, the human CRYAB comprises a sequence of SEQ ID NO: 4424.

Provided herein is an antibody that competes with an antibody or antigen binding fragment for binding to CRYAB, wherein the antibody binds to human CRYAB or mouse CRYAB.

Provided herein is an antibody or an antigen binding fragment thereof that selectively binds to hematopoietic cell-specific Lyn substrate 1, transcript variant 1 (HCLS1) or a variant thereof, comprising at least one of: a variable heavy chain region, wherein the variable heavy chain region comprises a complementarity-determining region heavy chain 1 (CDR-H1) of SEQ ID NO: 656, CDR-H2 of SEQ ID NO: 1198, and CDR-H3 of SEQ ID NO: 1740; and/or a variable light chain region, wherein the variable light chain region comprises a complementarity-determining region light chain 1 (CDR-L1) of SEQ ID NO: 927, CDR-L2 of SEQ ID NO: 1469, and CDR-L3 of SEQ ID NO: 2011. In some embodiments, the variable heavy chain comprises a polypeptide consensus sequence having at least 95% sequence identity to the amino acid sequence of SEQ ID NO: 114, and the variable light chain comprises a polypeptide consensus sequence having at least 95% sequence identity to the amino acid sequence of SEQ ID NO: 385. In some embodiments, the antibody or antigen binding fragment thereof binds a human HCLS1, mouse HCLS1, rat HCLS1, bovine HCLS1, or cynomolgus monkey HCLS1. In some embodiments, the human HCLS1 comprises a sequence of SEQ ID NO: 4425.

Provided herein is an antibody that competes with an antibody or antigen binding fragment for binding to HCLS1, wherein the antibody binds to human HCLS1 or mouse HCLS1.

Provided herein is an antibody or an antigen binding fragment thereof that selectively binds to aldo-keto reductase family 1 member B, transcript variant 1 (AKR1B1) or a variant thereof, comprising at least one of: a variable heavy chain region, wherein the variable heavy chain region comprises a complementarity-determining region heavy chain 1 (CDR-H1) of SEQ ID NO: 657, CDR-H2 of SEQ ID NO: 1199, and CDR-H3 of SEQ ID NO: 1741; and/or a variable light chain region, wherein the variable light chain region comprises a complementarity-determining region light chain 1 (CDR-L1) of SEQ ID NO: 928, CDR-L2 of SEQ ID NO: 1470, and CDR-L3 of SEQ ID NO: 2012. In some embodiments, the variable heavy chain comprises a polypeptide consensus sequence having at least 95% sequence identity to the amino acid sequence of SEQ ID NO: 115, and the variable light chain comprises a polypeptide consensus sequence having at least 95% sequence identity to the amino acid sequence of SEQ ID NO: 386. In some embodiments, the antibody or antigen binding fragment thereof binds a human AKR1B1, mouse AKR1B1, rat AKR1B1, bovine AKR1B1, or cynomolgus monkey AKR1B1. In some embodiments, the human AKR1B1 comprises a sequence of SEQ ID NO: 4426.

Provided herein is an antibody that competes with an antibody or antigen binding fragment for binding to AKR1B1, wherein the antibody binds to human AKR1B1 or mouse AKR1B1.

Provided herein is an antibody or an antigen binding fragment thereof that selectively binds to surfeit 6, transcript variant 1 (SURF6) or a variant thereof, comprising at least one of: a variable heavy chain region, wherein the variable heavy chain region comprises a complementarity-determining region heavy chain 1 (CDR-H1) of SEQ ID NO: 658, CDR-H2 of SEQ ID NO: 1200, and CDR-H3 of SEQ ID NO: 1742; and/or a variable light chain region, wherein the variable light chain region comprises a complementarity-determining region light chain 1 (CDR-L1) of SEQ ID NO: 929, CDR-L2 of SEQ ID NO: 1471, and CDR-L3 of SEQ ID NO: 2013. In some embodiments, the variable heavy chain comprises a polypeptide consensus sequence having at least 95% sequence identity to the amino acid sequence of SEQ ID NO: 116, and the variable light chain comprises a polypeptide consensus sequence having at least 95% sequence identity to the amino acid sequence of SEQ ID NO: 387. In some embodiments, the antibody or antigen binding fragment thereof binds a human SURF6, mouse SURF6, rat SURF6, bovine SURF6, or cynomolgus monkey SURF6. In some embodiments, the human SURF6 comprises a sequence of SEQ ID NO: 4427.

Provided herein is an antibody that competes with an antibody or antigen binding fragment for binding to SURF6, wherein the antibody binds to human SURF6 or mouse SURF6.

Provided herein is an antibody or an antigen binding fragment thereof that selectively binds to proliferating cell nuclear antigen, transcript variant 1 (PCNA) or a variant thereof, comprising at least one of: a variable heavy chain region, wherein the variable heavy chain region comprises a complementarity-determining region heavy chain 1 (CDR-H1) of SEQ ID NO: 658, CDR-H2 of SEQ ID NO: 1200, and CDR-H3 of SEQ ID NO: 1742; and/or a variable light chain region, wherein the variable light chain region comprises a complementarity-determining region light chain 1 (CDR-L1) of SEQ ID NO: 929, CDR-L2 of SEQ ID NO: 1471, and CDR-L3 of SEQ ID NO: 2013. In some embodiments, the variable heavy chain comprises a polypeptide consensus sequence having at least 95% sequence identity to the amino acid sequence of SEQ ID NO: 116, and the variable light chain comprises a polypeptide consensus sequence having at least 95% sequence identity to the amino acid sequence of SEQ ID NO: 387. In some embodiments, the antibody or antigen binding fragment thereof binds a human PCNA, mouse PCNA, rat PCNA, bovine PCNA, or cynomolgus monkey PCNA. In some embodiments, the human PCNA comprises a sequence of SEQ ID NO: 4428.

Provided herein is an antibody that competes with an antibody or antigen binding fragment for binding to PCNA, wherein the antibody binds to human PCNA or mouse PCNA.

Provided herein is an antibody or an antigen binding fragment thereof that selectively binds to S100 calcium binding protein B (S100B) or a variant thereof, comprising at least one of: a variable heavy chain region, wherein the variable heavy chain region comprises a complementarity-determining region heavy chain 1 (CDR-H1) of SEQ ID NO: 663, CDR-H2 of SEQ ID NO: 1205, and CDR-H3 of SEQ ID NO: 1747; and/or a variable light chain region, wherein the variable light chain region comprises a complementarity-determining region light chain 1 (CDR-L1) of SEQ ID NO: 934, CDR-L2 of SEQ ID NO: 1476, and CDR-L3 of SEQ ID NO: 2018. In some embodiments, the variable heavy chain comprises a polypeptide consensus sequence having at least 95% sequence identity to the amino acid sequence of SEQ ID NO: 121, and the variable light chain comprises a polypeptide consensus sequence having at least 95% sequence identity to the amino acid sequence of SEQ ID NO: 392. In some embodiments, he antibody or antigen binding fragment thereof binds a human S100B, mouse S100B, rat S100B, bovine S100B, or cynomolgus monkey S100B. In some embodiments, the human S100B comprises a sequence of SEQ ID NO: 4429.

Provided herein is an antibody that competes with an antibody or antigen binding fragment for binding to S100B, wherein the antibody binds to human S100B or mouse S100B.

Provided herein is an antibody or an antigen binding fragment thereof that selectively binds to checkpoint kinase 2, transcript variant 3 (CHEK2) or a variant thereof, comprising at least one of: a variable heavy chain region, wherein the variable heavy chain region comprises a complementarity-determining region heavy chain 1 (CDR-H1) of SEQ ID NO: 664, CDR-H2 of SEQ ID NO: 1206, and CDR-H3 of SEQ ID NO: 1748; and/or a variable light chain region, wherein the variable light chain region comprises a complementarity-determining region light chain 1 (CDR-L1) of SEQ ID NO: 935, CDR-L2 of SEQ ID NO: 1477, and CDR-L3 of SEQ ID NO: 2019. In some embodiments, the variable heavy chain comprises a polypeptide consensus sequence having at least 95% sequence identity to the amino acid sequence of SEQ ID NO: 122, and the variable light chain comprises a polypeptide consensus sequence having at least 95% sequence identity to the amino acid sequence of SEQ ID NO: 393. In some embodiments, the antibody or antigen binding fragment thereof binds a human CHEK2, mouse CHEK2, rat CHEK2, bovine CHEK2, or cynomolgus monkey CHEK2. In some embodiments, the human CHEK2 comprises a sequence of SEQ ID NO: 4430.

Provided herein is an antibody that competes with an antibody or antigen binding fragment for binding to CHEK2, wherein the antibody binds to human CHEK2 or mouse CHEK2.

Provided herein is an antibody or an antigen binding fragment thereof that selectively binds to ankyrin repeat domain 53, transcript variant 2 (ANKRD53) or a variant thereof, comprising at least one of: a variable heavy chain region, wherein the variable heavy chain region comprises a complementarity-determining region heavy chain 1 (CDR-H1) of SEQ ID NO: 670, CDR-H2 of SEQ ID NO: 1212, and CDR-H3 of SEQ ID NO: 1754; and/or a variable light chain region, wherein the variable light chain region comprises a complementarity-determining region light chain 1 (CDR-L1) of SEQ ID NO: 941, CDR-L2 of SEQ ID NO: 1483, and CDR-L3 of SEQ ID NO: 2025. In some embodiments, the variable heavy chain comprises a polypeptide consensus sequence having at least 95% sequence identity to the amino acid sequence of SEQ ID NO: 128, and
the variable light chain comprises a polypeptide consensus sequence having at least 95% sequence identity to the amino acid sequence of SEQ ID NO: 399. In some embodiments, the antibody or antigen binding fragment thereof binds a human ANKRD53, mouse ANKRD53, rat ANKRD53, bovine ANKRD53, or cynomolgus monkey ANKRD53. In some embodiments, the human ANKRD53 comprises a sequence of SEQ ID NO: 4431.

Provided herein is an antibody that competes with an antibody or antigen binding fragment for binding to ANKRD53, wherein the antibody binds to human ANKRD53 or mouse ANKRD53.

Provided herein is an antibody or an antigen binding fragment thereof that selectively binds to Killer cell lectin like receptor g2 (KLRG2) or a variant thereof, comprising at least one of: a variable heavy chain region, wherein the variable heavy chain region comprises a complementarity-determining region heavy chain 1 (CDR-H1) of SEQ ID NO: 683, CDR-H2 of SEQ ID NO: 1225, and CDR-H3 of SEQ ID NO: 1767; and/or a variable light chain region, wherein the variable light chain region comprises a complementarity-determining region light chain 1 (CDR-L1) of SEQ ID NO: 954, CDR-L2 of SEQ ID NO: 1496, and CDR-L3 of SEQ ID NO: 2038. In some embodiments, the variable heavy chain comprises a polypeptide consensus sequence having at least 95% sequence identity to the amino acid sequence of SEQ ID NO: 141, and the variable light chain comprises a polypeptide consensus sequence having at least 95% sequence identity to the amino acid sequence of SEQ ID NO: 412. In some embodiments, the antibody or antigen binding fragment thereof binds a human KLRG2, mouse KLRG2, rat KLRG2, bovine KLRG2, or cynomolgus monkey KLRG2. In some embodiments, the human KLRG2 comprises a sequence of SEQ ID NO: 4432.

Provided herein is an antibody that competes with an antibody or antigen binding fragment for binding to KLRG2, wherein the antibody binds to human KLRG2 or mouse KLRG2.

Provided herein is an antibody or an antigen binding fragment thereof that selectively binds to tripartite motif containing 35, transcript variant 1 (TRIM35) or a variant thereof, comprising at least one of: a variable heavy chain region, wherein the variable heavy chain region comprises a complementarity-determining region heavy chain 1 (CDR-H1) of SEQ ID NO: 683, CDR-H2 of SEQ ID NO: 1225, and CDR-H3 of SEQ ID NO: 1767; and/or a variable light chain region, wherein the variable light chain region comprises a complementarity-determining region light chain 1 (CDR-L1) of SEQ ID NO: 954, CDR-L2 of SEQ ID NO: 1496, and CDR-L3 of SEQ ID NO: 2038. In some embodiments, the variable heavy chain comprises a polypeptide consensus sequence having at least 95% sequence identity to the amino acid sequence of SEQ ID NO: 141, and the variable light chain comprises a polypeptide consensus sequence having at least 95% sequence identity to the amino acid sequence of SEQ ID NO: 412. In some embodiments, the antibody or antigen binding fragment thereof binds a human TRIM35, mouse TRIM35, rat TRIM35, bovine TRIM35, or cynomolgus monkey TRIM35. In some embodiments, the human TRIM35 comprises a sequence of SEQ ID NO: 4433.

Provided herein is an antibody that competes with an antibody or antigen binding fragment for binding to TRIM35, wherein the antibody binds to human TRIM35 or mouse TRIM35.

Provided herein is an antibody or an antigen binding fragment thereof that selectively binds to FMR1 autosomal homolog 2 (FXR2) or a variant thereof, comprising at least one of: a variable heavy chain region, wherein the variable heavy chain region comprises a complementarity-determining region heavy chain 1 (CDR-H1) of SEQ ID NO: 683, CDR-H2 of SEQ ID NO: 1225, and CDR-H3 of SEQ ID NO: 1767; and/or a variable light chain region, wherein the variable light chain region comprises a complementarity-determining region light chain 1 (CDR-L1) of SEQ ID NO: 954, CDR-L2 of SEQ ID NO: 1496, and CDR-L3 of SEQ ID NO: 2038. In some embodiments, the variable heavy chain comprises a polypeptide consensus sequence having at least 95% sequence identity to the amino acid sequence of SEQ ID NO: 141, and the variable light chain comprises a polypeptide consensus sequence having at least 95% sequence identity to the amino acid sequence of SEQ ID NO: 412. In some embodiments, the antibody or antigen binding fragment thereof binds a human FXR2, mouse FXR2, rat FXR2, bovine FXR2, or cynomolgus monkey FXR2. In some embodiments, the human FXR2 comprises a sequence of SEQ ID NO: 4434.

Provided herein is an antibody that competes with an antibody or antigen binding fragment for binding to FXR2, wherein the antibody binds to human FXR2 or mouse FXR2.

Provided herein is an antibody or an antigen binding fragment thereof that selectively binds to annexin A1 (ANXA1) or a variant thereof, comprising at least one of: a variable heavy chain region, wherein the variable heavy chain region comprises a complementarity-determining region heavy chain 1 (CDR-H1) of SEQ ID NO: 686, CDR-H2 of SEQ ID NO: 1228, and CDR-H3 of SEQ ID NO: 1770; and/or a variable light chain region, wherein the variable light chain region comprises a complementarity-determining region light chain 1 (CDR-L1) of SEQ ID NO: 957, CDR-L2 of SEQ ID NO: 1499, and CDR-L3 of SEQ ID NO: 2041. In some embodiments, the variable heavy chain comprises a polypeptide consensus sequence having at least 95% sequence identity to the amino acid sequence of SEQ ID NO: 144, and the variable light chain comprises a polypeptide consensus sequence having at least 95% sequence identity to the amino acid sequence of SEQ ID NO: 415. In some embodiments, the antibody or antigen binding fragment thereof binds a human ANXA1, mouse ANXA1, rat ANXA1, bovine ANXA1, or cynomolgus monkey ANXA1. In some embodiments, the human ANXA1 comprises a sequence of SEQ ID NO: 4435.

Provided herein is an antibody that competes with an antibody or antigen binding fragment for binding to ANXA1, wherein the antibody binds to human ANXA1 or mouse ANXA1.

Provided herein is an antibody or an antigen binding fragment thereof that selectively binds to zinc finger protein 287, transcript variant 2 (ZNF287) or a variant thereof, comprising at least one of: a variable heavy chain region, wherein the variable heavy chain region comprises a complementarity-determining region heavy chain 1 (CDR-H1) of SEQ ID NO: 690, CDR-H2 of SEQ ID NO: 1232, and CDR-H3 of SEQ ID NO: 1774; and/or a variable light chain region, wherein the variable light chain region comprises a complementarity-determining region light chain 1 (CDR-L1) of SEQ ID NO: 961, CDR-L2 of SEQ ID NO: 1503, and CDR-L3 of SEQ ID NO: 2045. In some embodiments, the variable heavy chain comprises a polypeptide consensus sequence having at least 95% sequence identity to the amino acid sequence of SEQ ID NO: 148, and the variable light chain comprises a polypeptide consensus sequence having at least 95% sequence identity to the amino acid sequence of SEQ ID NO: 419. In some embodiments, the antibody or antigen binding fragment thereof binds a human ZNF287, mouse ZNF287, rat ZNF287, bovine ZNF287, or cynomolgus monkey ZNF287. In some embodiments, the human ZNF287 comprises a sequence of SEQ ID NO: 4436.

Provided herein is an antibody that competes with an antibody or antigen binding fragment for binding to ZNF287, wherein the antibody binds to human ZNF287 or mouse ZNF287.

Provided herein is an antibody or an antigen binding fragment thereof that selectively binds to family with sequence similarity 177 member A1, transcript variant 2 (FAM177A1) or a variant thereof, comprising at least one of: a variable heavy chain region, wherein the variable heavy chain region comprises a complementarity-determining region heavy chain 1 (CDR-H1) of SEQ ID NO: 698, CDR-H2 of SEQ ID NO: 1240, and CDR-H3 of SEQ ID NO: 1782; and/or a variable light chain region, wherein the variable light chain region comprises a complementarity-determining region light chain 1 (CDR-L1) of SEQ ID NO: 969, CDR-L2 of SEQ ID NO: 1511, and CDR-L3 of SEQ ID NO: 2053. In some embodiments, the variable heavy chain comprises a polypeptide consensus sequence having at least 95% sequence identity to the amino acid sequence of SEQ ID NO: 156, and the variable light chain comprises a polypeptide consensus sequence having at least 95% sequence identity to the amino acid sequence of SEQ ID NO: 427. In some embodiments, the antibody or antigen binding fragment thereof binds a human FAM177A1, mouse FAM177A1, rat FAM177A1, bovine FAM177A1, or cynomolgus monkey FAM177A1. In some embodiments, the human FAM177A1 comprises a sequence of SEQ ID NO: 4437.

Provided herein is an antibody that competes with an antibody or antigen binding fragment for binding to FAM177A1, wherein the antibody binds to human FAM177A1 or mouse FAM177A1.

Provided herein is an antibody or an antigen binding fragment thereof that selectively binds to quinoid dihydropteridine reductase, transcript variant 1 (QDPR) or a variant thereof, comprising at least one of: a variable heavy chain region, wherein the variable heavy chain region comprises a complementarity-determining region heavy chain 1 (CDR-H1) of SEQ ID NO: 701, CDR-H2 of SEQ ID NO: 1243, and CDR-H3 of SEQ ID NO: 1785; and/or a variable light chain region, wherein the variable light chain region comprises a complementarity-determining region light chain 1 (CDR-L1) of SEQ ID NO: 972, CDR-L2 of SEQ ID NO: 1514, and CDR-L3 of SEQ ID NO: 2056. In some embodiments, the variable heavy chain comprises a polypeptide consensus sequence having at least 95% sequence identity to the amino acid sequence of SEQ ID NO: 159, and the variable light chain comprises a polypeptide consensus sequence having at least 95% sequence identity to the amino acid sequence of SEQ ID NO: 430. In some embodiments, the antibody or antigen binding fragment thereof binds a human QDPR, mouse QDPR, rat QDPR, bovine QDPR, or cynomolgus monkey QDPR. In some embodiments, the human QDPR comprises a sequence of SEQ ID NO: 4438.

Provided herein is an antibody that competes with an antibody or antigen binding fragment for binding to QDPR, wherein the antibody binds to human QDPR or mouse QDPR.

Provided herein is an antibody or an antigen binding fragment thereof that selectively binds to ELK2, member of ETS oncogene family, pseudogene 1 (BC031259.1_frag) or a variant thereof, comprising at least one of: a variable heavy chain region, wherein the variable heavy chain region comprises a complementarity-determining region heavy chain 1 (CDR-H1) of SEQ ID NO: 703, CDR-H2 of SEQ ID NO: 1245, and CDR-H3 of SEQ ID NO: 1787; and/or a variable light chain region, wherein the variable light chain region comprises a complementarity-determining region light chain 1 (CDR-L1) of SEQ ID NO: 974, CDR-L2 of SEQ ID NO: 1516, and CDR-L3 of SEQ ID NO: 2058. In some embodiments, the variable heavy chain comprises a polypeptide consensus sequence having at least 95% sequence identity to the amino acid sequence of SEQ ID NO: 161, and the variable light chain comprises a polypeptide consensus sequence having at least 95% sequence identity to the amino acid sequence of SEQ ID NO: 432. In some embodiments, the antibody or antigen binding fragment thereof binds a human BC031259.1_frag, mouse BC031259.1frag, rat BC031259.1_frag, bovine BC031259.1_frag, or cynomolgus monkey BC031259.1_frag. In some embodiments, the human BC031259.1_frag comprises a sequence of SEQ ID NO: 4439.

Provided herein is an antibody that competes with an antibody or antigen binding fragment for binding to BC031259.1_frag, wherein the antibody binds to human BC031259.1_frag or mouse BC031259.1_frag.

Provided herein is an antibody or an antigen binding fragment thereof that selectively binds to methyltransferase like 21C (METTL21C) or a variant thereof, comprising at least one of: a variable heavy chain region, wherein the variable heavy chain region comprises a complementarity-determining region heavy chain 1 (CDR-H1) of SEQ ID NO: 703, CDR-H2 of SEQ ID NO: 1245, and CDR-H3 of SEQ ID NO: 1787; and/or a variable light chain region, wherein the variable light chain region comprises a complementarity-determining region light chain 1 (CDR-L1) of SEQ ID NO: 974, CDR-L2 of SEQ ID NO: 1516, and CDR-L3 of SEQ ID NO: 2058. In some embodiments, the variable heavy chain comprises a polypeptide consensus sequence having at least 95% sequence identity to the amino acid sequence of SEQ ID NO: 161, and the variable light chain comprises a polypeptide consensus sequence having at least 95% sequence identity to the amino acid sequence of SEQ ID NO: 432. In some embodiments, the antibody or antigen binding fragment thereof binds a human METTL21C, mouse METTL21C, rat METTL21C, bovine METTL21C, or cynomolgus monkey METTL21C. In some embodiments, the human METTL21C comprises a sequence of SEQ ID NO: 4440.

Provided herein is an antibody that competes with an antibody or antigen binding fragment for binding to METTL21C, wherein the antibody binds to human METTL21C or mouse METTL21C.

Provided herein is an antibody or an antigen binding fragment thereof that selectively binds to hydroxymethylbilane synthase, transcript variant X3 (IAMBS) or a variant thereof, comprising at least one of: a variable heavy chain region, wherein the variable heavy chain region comprises a complementarity-determining region heavy chain 1 (CDR-H1) of SEQ ID NO: 706, CDR-H2 of SEQ ID NO: 1248, and CDR-H3 of SEQ ID NO: 1790; and/or a variable light chain region, wherein the variable light chain region comprises a complementarity-determining region light chain 1 (CDR-L1) of SEQ ID NO: 977, CDR-L2 of SEQ ID NO: 1519, and CDR-L3 of SEQ ID NO: 2061. In some embodiments, the variable heavy chain comprises a polypeptide consensus sequence having at least 95% sequence identity to the amino acid sequence of SEQ ID NO: 164, and the variable light chain comprises a polypeptide consensus sequence having at least 95% sequence identity to the amino acid sequence of SEQ ID NO: 435. In some embodiments, the antibody or antigen binding fragment thereof binds a human HMBS, mouse HMBS, rat HMBS, bovine HMBS, or cynomolgus monkey HMBS. In some embodiments, the human HMBS comprises a sequence of SEQ ID NO: 4441.

Provided herein is an antibody that competes with an antibody or antigen binding fragment for binding to HMBS, wherein the antibody binds to human HMBS or mouse HMBS.

Provided herein is an antibody or an antigen binding fragment thereof that selectively binds to hook microtubule tethering protein 2, transcript variant 2 (HOOK2) or a variant thereof, comprising at least one of: a variable heavy chain region, wherein the variable heavy chain region comprises a complementarity-determining region heavy chain 1 (CDR-H1) of SEQ ID NO: 706, CDR-H2 of SEQ ID NO: 1248, and CDR-H3 of SEQ ID NO: 1790; and/or a variable light chain region, wherein the variable light chain region comprises a complementarity-determining region light chain 1 (CDR-L1) of SEQ ID NO: 977, CDR-L2 of SEQ ID NO: 1519, and CDR-L3 of SEQ ID NO: 2061. In some embodiments, the variable heavy chain comprises a polypeptide consensus sequence having at least 95% sequence identity to the amino acid sequence of SEQ ID NO: 164, and the variable light chain comprises a polypeptide consensus sequence having at least 95% sequence identity to the amino acid sequence of SEQ ID NO: 435. In some embodiments, the antibody or antigen binding fragment thereof binds a human HOOK2, mouse HOOK2, rat HOOK2, bovine HOOK2, or cynomolgus monkey HOOK2. In some embodiments, the human HOOK2 comprises a sequence of SEQ ID NO: 4442.

Provided herein is an antibody that competes with an antibody or antigen binding fragment for binding to HOOK2, wherein the antibody binds to human HOOK2 or mouse HOOK2.

Provided herein is an antibody or an antigen binding fragment thereof that selectively binds to Magel2 (Q6ir13_frag) or a variant thereof, comprising at least one of:
a variable heavy chain region, wherein the variable heavy chain region comprises a complementarity-determining region heavy chain 1 (CDR-H1) of SEQ ID NO: 713, CDR-H2 of SEQ ID NO: 1255, and CDR-H3 of SEQ ID NO: 1797; and/or a variable light chain region, wherein the variable light chain region comprises a complementarity-determining region light chain 1 (CDR-L1) of SEQ ID NO: 984, CDR-L2 of SEQ ID NO: 1526, and CDR-L3 of SEQ ID NO: 2068. In some embodiments, the variable heavy chain comprises a polypeptide consensus sequence having at least 95% sequence identity to the amino acid sequence of SEQ ID NO: 171, and the variable light chain comprises a polypeptide consensus sequence having at least 95% sequence identity to the amino acid sequence of SEQ ID NO: 442. In some embodiments, the antibody or antigen binding fragment thereof binds a human Q6ir13_frag, mouse Q6ir13_frag, rat Q6ir13_frag, bovine Q6ir13_frag, or cynomolgus monkey Q6ir13_frag. In some embodiments, the human Q6ir13_frag comprises a sequence of SEQ ID NO: 4443.

Provided herein is an antibody that competes with an antibody or antigen binding fragment for binding to Q6ir13_frag, wherein the antibody binds to human Q6ir13_frag or mouse Q6ir13_frag.

Provided herein is an antibody or an antigen binding fragment thereof that selectively binds to serine and arginine rich splicing factor 3, transcript variant 1 (SRSF3) or a variant thereof, comprising at least one of: a variable heavy chain region, wherein the variable heavy chain region comprises a complementarity-determining region heavy chain 1 (CDR-H1) of SEQ ID NO: 713, CDR-H2 of SEQ ID NO: 1255, and CDR-H3 of SEQ ID NO: 1797; and/or a variable light chain region, wherein the variable light chain region comprises a complementarity-determining region light chain 1 (CDR-L1) of SEQ ID NO: 984, CDR-L2 of SEQ ID NO: 1526, and CDR-L3 of SEQ ID NO: 2068. In some embodiments, the variable heavy chain comprises a polypeptide consensus sequence having at least 95% sequence identity to the amino acid sequence of SEQ ID NO: 171, and the variable light chain comprises a polypeptide consensus sequence having at least 95% sequence identity to the amino acid sequence of SEQ ID NO: 442. In some embodiments, the antibody or antigen binding fragment thereof binds a human SRSF3, mouse SRSF3, rat SRSF3, bovine SRSF3, or cynomolgus monkey SRSF3. In some embodiments, the human SRSF3 comprises a sequence of SEQ ID NO: 4444.

Provided herein is an antibody that competes with an antibody or antigen binding fragment for binding to SRSF3, wherein the antibody binds to human SRSF3 or mouse SRSF3.

Provided herein is an antibody or an antigen binding fragment thereof that selectively binds to RAN binding protein 10, transcript variant 1 (RANBP10) or a variant thereof, comprising at least one of: a variable heavy chain region, wherein the variable heavy chain region comprises a complementarity-determining region heavy chain 1 (CDR-H1) of SEQ ID NO: 714, CDR-H2 of SEQ ID NO: 1256, and CDR-H3 of SEQ ID NO: 1798; and/or a variable light chain region, wherein the variable light chain region comprises a complementarity-determining region light chain 1 (CDR-L1) of SEQ ID NO: 985, CDR-L2 of SEQ ID NO: 1527, and CDR-L3 of SEQ ID NO: 2069. In some embodiments, the variable heavy chain comprises a polypeptide consensus sequence having at least 95% sequence identity to the amino acid sequence of SEQ ID NO: 172, and the variable light chain comprises a polypeptide consensus sequence having at least 95% sequence identity to the amino acid sequence of SEQ ID NO: 443. In some embodiments, the antibody or antigen binding fragment thereof binds a human RANBP10, mouse RANBP10, rat RANBP10, bovine RANBP10, or cynomolgus monkey RANBP10. In some embodiments, the human RANBP10 comprises a sequence of SEQ ID NO: 4445.

Provided herein is an antibody that competes with an antibody or antigen binding fragment for binding to RANBP10, wherein the antibody binds to human RANBP10 or mouse RANBP10.

Provided herein is an antibody or an antigen binding fragment thereof that selectively binds to Wnt family member 9b (WNT9B) or a variant thereof, comprising at least one of: a variable heavy chain region, wherein the variable heavy chain region comprises a complementarity-determining region heavy chain 1 (CDR-H1) of SEQ ID NO: 714, CDR-H2 of SEQ ID NO: 1256, and CDR-H3 of SEQ ID NO: 1798; and/or a variable light chain region, wherein the variable light chain region comprises a complementarity-determining region light chain 1 (CDR-L1) of SEQ ID NO: 985, CDR-L2 of SEQ ID NO: 1527, and CDR-L3 of SEQ ID NO: 2069. In some embodiments, the variable heavy chain comprises a polypeptide consensus sequence having at least 95% sequence identity to the amino acid sequence of SEQ ID NO: 172, and the variable light chain comprises a polypeptide consensus sequence having at least 95% sequence identity to the amino acid sequence of SEQ ID NO: 443. In some embodiments, the antibody or antigen binding fragment thereof binds a human WNT9B, mouse WNT9B, rat WNT9B, bovine WNT9B, or cynomolgus monkey WNT9B. In some embodiments, the human WNT9B comprises a sequence of SEQ ID NO: 4446.

Provided herein is an antibody that competes with an antibody or antigen binding fragment for binding to WNT9B, wherein the antibody binds to human WNT9B or mouse WNT9B.

Provided herein is an antibody or an antigen binding fragment thereof that selectively binds to ubiquilin 2 (UBQLN2) or a variant thereof, comprising at least one of: a variable heavy chain region, wherein the variable heavy chain region comprises a complementarity-determining region heavy chain 1 (CDR-H1) of SEQ ID NO: 715, CDR-H2 of SEQ ID NO: 1257, and CDR-H3 of SEQ ID NO: 1799; and/or a variable light chain region, wherein the variable light chain region comprises a complementarity-determining region light chain 1 (CDR-L1) of SEQ ID NO: 986, CDR-L2 of SEQ ID NO: 1528, and CDR-L3 of SEQ ID NO: 2070. In some embodiments, the variable heavy chain comprises a polypeptide consensus sequence having at least 95% sequence identity to the amino acid sequence of SEQ ID NO: 173, and the variable light chain comprises a polypeptide consensus sequence having at least 95% sequence identity to the amino acid sequence of SEQ ID NO: 444. In some embodiments, the antibody or antigen binding fragment thereof binds a human UBQLN2, mouse UBQLN2, rat UBQLN2, bovine UBQLN2, or cynomolgus monkey UBQLN2. In some embodiments, the human UBQLN2 comprises a sequence of SEQ ID NO: 4447.

Provided herein is an antibody that competes with an antibody or antigen binding fragment for binding to UBQLN2, wherein the antibody binds to human UBQLN2 or mouse UBQLN2.

Provided herein is an antibody or an antigen binding fragment thereof that selectively binds to ubiquilin 1, transcript variant 2 (UBQLN1) or a variant thereof, comprising at least one of: a variable heavy chain region, wherein the variable heavy chain region comprises a complementarity-determining region heavy chain 1 (CDR-H1) of SEQ ID NO: 715, CDR-H2 of SEQ ID NO: 1257, and CDR-H3 of SEQ ID NO: 1799; and/or a variable light chain region, wherein the variable light chain region comprises a complementarity-determining region light chain 1 (CDR-L1) of SEQ ID NO: 986, CDR-L2 of SEQ ID NO: 1528, and CDR-L3 of SEQ ID NO: 2070. In some embodiments, the variable heavy chain comprises a polypeptide consensus sequence having at least 95% sequence identity to the amino acid sequence of SEQ ID NO: 173, and the variable light chain comprises a polypeptide consensus sequence having at least 95% sequence identity to the amino acid sequence of SEQ ID NO: 444. In some embodiments, the antibody or antigen binding fragment thereof binds a human UBQLN1, mouse UBQLN1, rat UBQLN1, bovine UBQLN1, or cynomolgus monkey UBQLN1. In some embodiments, the human UBQLN1 comprises a sequence of SEQ ID NO: 4370.

Provided herein is an antibody that competes with an antibody or antigen binding fragment for binding to UBQLN1, wherein the antibody binds to human UBQLN1 or mouse UBQLN1.

Provided herein is an antibody or an antigen binding fragment thereof that selectively binds to Ubiquilin 3 (UBQLN3) or a variant thereof, comprising at least one of: a variable heavy chain region, wherein the variable heavy chain region comprises a complementarity-determining region heavy chain 1 (CDR-H1) of SEQ ID NO: 715, CDR-H2 of SEQ ID NO: 1257, and CDR-H3 of SEQ ID NO: 1799; and/or a variable light chain region, wherein the variable light chain region comprises a complementarity-determining region light chain 1 (CDR-L1) of SEQ ID NO: 986, CDR-L2 of SEQ ID NO: 1528, and CDR-L3 of SEQ ID NO: 2070. In some embodiments, the variable heavy chain comprises a polypeptide consensus sequence having at least 95% sequence identity to the amino acid sequence of SEQ ID NO: 173, and the variable light chain comprises a polypeptide consensus sequence having at least 95% sequence identity to the amino acid sequence of SEQ ID NO: 444. In some embodiments, the antibody or antigen binding fragment thereof binds a human UBQLN3, mouse UBQLN3, rat UBQLN3, bovine UBQLN3, or cynomolgus monkey UBQLN3. In some embodiments, the human UBQLN3 comprises a sequence of SEQ ID NO: 4448.

Provided herein is an antibody that competes with an antibody or antigen binding fragment for binding to UBQLN3, wherein the antibody binds to human UBQLN3 or mouse UBQLN3.

Provided herein is an antibody or an antigen binding fragment thereof that selectively binds to anterior gradient 3, protein disulphide isomerase family member (AGR3) or a variant thereof, comprising at least one of: a variable heavy chain region, wherein the variable heavy chain region comprises a complementarity-determining region heavy chain 1 (CDR-H1) of SEQ ID NO: 717, CDR-H2 of SEQ ID NO: 1259, and CDR-H3 of SEQ ID NO: 1801; and/or a variable light chain region, wherein the variable light chain region comprises a complementarity-determining region light chain 1 (CDR-L1) of SEQ ID NO: 988, CDR-L2 of SEQ ID NO: 1530, and CDR-L3 of SEQ ID NO: 2072. In some embodiments, the variable heavy chain comprises a polypeptide consensus sequence having at least 95% sequence identity to the amino acid sequence of SEQ ID NO: 175, and the variable light chain comprises a polypeptide consensus sequence having at least 95% sequence identity to the amino acid sequence of SEQ ID NO: 446. In some embodiments, the antibody or antigen binding fragment thereof binds a human AGR3, mouse AGR3, rat AGR3, bovine AGR3, or cynomolgus monkey AGR3. In some embodiments, the human AGR3 comprises a sequence of SEQ ID NO: 4449.

Provided herein is an antibody that competes with an antibody or antigen binding fragment for binding to AGR3, wherein the antibody binds to human AGR3 or mouse AGR3.

Provided herein is an antibody or an antigen binding fragment thereof that selectively binds to serine and arginine rich splicing factor 3, transcript variant 1 (SRSF3) or a variant thereof, comprising at least one of: a variable heavy chain region, wherein the variable heavy chain region comprises a complementarity-determining region heavy chain 1 (CDR-H1) of SEQ ID NO: 719, CDR-H2 of SEQ ID NO: 1261, and CDR-H3 of SEQ ID NO: 1803; and/or a variable light chain region, wherein the variable light chain region comprises a complementarity-determining region light chain 1 (CDR-L1) of SEQ ID NO: 990, CDR-L2 of SEQ ID NO: 1532, and CDR-L3 of SEQ ID NO: 2074. In some embodiments, the variable heavy chain comprises a polypeptide consensus sequence having at least 95% sequence identity to the amino acid sequence of SEQ ID NO: 177, and the variable light chain comprises a polypeptide consensus sequence having at least 95% sequence identity to the amino acid sequence of SEQ ID NO: 448. In some embodiments, the antibody or antigen binding fragment thereof binds a human SRSF3, mouse SRSF3, rat SRSF3, bovine SRSF3, or cynomolgus monkey SRSF3. In some embodiments, the human SRSF3 comprises a sequence of SEQ ID NO: 4444.

Provided herein is an antibody that competes with an antibody or antigen binding fragment for binding to SRSF3, wherein the antibody binds to human SRSF3 or mouse SRSF3.

Provided herein is an antibody or an antigen binding fragment thereof that selectively binds to baculoviral IAP repeat containing 7, transcript variant 1 (BIRC7) or a variant thereof, comprising at least one of: a variable heavy chain region, wherein the variable heavy chain region comprises a complementarity-determining region heavy chain 1 (CDR-H1) of SEQ ID NO: 720, CDR-H2 of SEQ ID NO: 1262, and CDR-H3 of SEQ ID NO: 1804; and/or a variable light chain region, wherein the variable light chain region comprises a complementarity-determining region light chain 1 (CDR-L1) of SEQ ID NO: 991, CDR-L2 of SEQ ID NO: 1533, and CDR-L3 of SEQ ID NO: 2075. In some embodiments, the variable heavy chain comprises a polypeptide consensus sequence having at least 95% sequence identity to the amino acid sequence of SEQ ID NO: 178, and the variable light chain comprises a polypeptide consensus sequence having at least 95% sequence identity to the amino acid sequence of SEQ ID NO: 449. In some embodiments, the antibody or antigen binding fragment thereof binds a human BIRC7, mouse BIRC7, rat BIRC7, bovine BIRC7, or cynomolgus monkey BIRC7. In some embodiments, the human BIRC7 comprises a sequence of SEQ ID NO: 4450.

Provided herein is an antibody that competes with an antibody or antigen binding fragment for binding to BIRC7, wherein the antibody binds to human BIRC7 or mouse BIRC7.

Provided herein is an antibody or an antigen binding fragment thereof that selectively binds to endosome associated trafficking regulator 1, transcript variant 2 (SDCCAG3) or a variant thereof, comprising at least one of: a variable heavy chain region, wherein the variable heavy chain region comprises a complementarity-determining region heavy chain 1 (CDR-H1) of SEQ ID NO: 722, CDR-H2 of SEQ ID NO: 1264, and CDR-H3 of SEQ ID NO: 1806; and/or a variable light chain region, wherein the variable light chain region comprises a complementarity-determining region light chain 1 (CDR-L1) of SEQ ID NO: 993, CDR-L2 of SEQ ID NO: 1535, and CDR-L3 of SEQ ID NO: 2077. In some embodiments, the variable heavy chain comprises a polypeptide consensus sequence having at least 95% sequence identity to the amino acid sequence of SEQ ID NO: 180, and the variable light chain comprises a polypeptide consensus sequence having at least 95% sequence identity to the amino acid sequence of SEQ ID NO: 451. In some embodiments, the antibody or antigen binding fragment thereof binds a human SDCCAG3, mouse SDCCAG3, rat SDCCAG3, bovine SDCCAG3, or cynomolgus monkey SDCCAG3. In some embodiments, the human SDCCAG3 comprises a sequence of SEQ ID NO: 4373.

Provided herein is an antibody that competes with an antibody or antigen binding fragment for binding to SDCCAG3, wherein the antibody binds to human SDCCAG3 or mouse SDCCAG3.

Provided herein is an antibody or an antigen binding fragment thereof that selectively binds to microtubule associated scaffold protein 2, transcript variant 2 (MTUS2) or a variant thereof, comprising at least one of: a variable heavy chain region, wherein the variable heavy chain region comprises a complementarity-determining region heavy chain 1 (CDR-H1) of SEQ ID NO: 724, CDR-H2 of SEQ ID NO: 1266, and CDR-H3 of SEQ ID NO: 1808; and/or a variable light chain region, wherein the variable light chain region comprises a complementarity-determining region light chain 1 (CDR-L1) of SEQ ID NO: 995, CDR-L2 of SEQ ID NO: 1537, and CDR-L3 of SEQ ID NO: 2079. In some embodiments, the variable heavy chain comprises a polypeptide consensus sequence having at least 95% sequence identity to the amino acid sequence of SEQ ID NO: 182, and the variable light chain comprises a polypeptide consensus sequence having at least 95% sequence identity to the amino acid sequence of SEQ ID NO: 453. In some embodiments, the antibody or antigen binding fragment thereof binds a human MTUS2, mouse MTUS2, rat MTUS2, bovine MTUS2, or cynomolgus monkey MTUS2. In some embodiments, the human MTUS2 comprises a sequence of SEQ ID NO: 4451.

Provided herein is an antibody that competes with an antibody or antigen binding fragment for binding to MTUS2, wherein the antibody binds to human MTUS2 or mouse MTUS2.

Provided herein is an antibody or an antigen binding fragment thereof that selectively binds to zinc finger protein 296 (ZNF296) or a variant thereof, comprising at least one of: a variable heavy chain region, wherein the variable heavy chain region comprises a complementarity-determining region heavy chain 1 (CDR-H1) of SEQ ID NO: 725, CDR-H2 of SEQ ID NO: 1267, and CDR-H3 of SEQ ID NO: 1809; and/or a variable light chain region, wherein the variable light chain region comprises a complementarity-determining region light chain 1 (CDR-L1) of SEQ ID NO: 996, CDR-L2 of SEQ ID NO: 1538, and CDR-L3 of SEQ ID NO: 2080. In some embodiments, the variable heavy chain comprises a polypeptide consensus sequence having at least 95% sequence identity to the amino acid sequence of SEQ ID NO: 183, and the variable light chain comprises a polypeptide consensus sequence having at least 95% sequence identity to the amino acid sequence of SEQ ID NO: 454. In some embodiments, the antibody or antigen binding fragment thereof binds a human ZNF296, mouse ZNF296, rat ZNF296, bovine ZNF296, or cynomolgus monkey ZNF296. In some embodiments, the human ZNF296 comprises a sequence of SEQ ID NO: 4452.

Provided herein is an antibody that competes with an antibody or antigen binding fragment for binding to ZNF296, wherein the antibody binds to human ZNF296 or mouse ZNF296.

Provided herein is an antibody or an antigen binding fragment thereof that selectively binds to phosphodiesterase 5A, transcript variant 1 (PDE5A) or a variant thereof, comprising at least one of: a variable heavy chain region, wherein the variable heavy chain region comprises a complementarity-determining region heavy chain 1 (CDR-H1) of SEQ ID NO: 725, CDR-H2 of SEQ ID NO: 1267, and CDR-H3 of SEQ ID NO: 1809; and/or a variable light chain region, wherein the variable light chain region comprises a complementarity-determining region light chain 1 (CDR-L1) of SEQ ID NO: 996, CDR-L2 of SEQ ID NO: 1538, and CDR-L3 of SEQ ID NO: 2080. In some embodiments, the variable heavy chain comprises a polypeptide consensus sequence having at least 95% sequence identity to the amino acid sequence of SEQ ID NO: 183, and the variable light chain comprises a polypeptide consensus sequence having at least 95% sequence identity to the amino acid sequence of SEQ ID NO: 454. In some embodiments, the antibody or antigen binding fragment thereof binds a human PDE5A, mouse PDE5A, rat PDE5A, bovine PDE5A, or cynomolgus monkey PDE5A. In some embodiments, the human PDE5A comprises a sequence of SEQ ID NO: 4453.

Provided herein is an antibody that competes with an antibody or antigen binding fragment for binding to PDE5A, wherein the antibody binds to human PDE5A or mouse PDE5A.

Provided herein is an antibody or an antigen binding fragment thereof that selectively binds to Ep400 pseudogene 1 (EP400NL) or a variant thereof, comprising at least one of: a variable heavy chain region, wherein the variable heavy chain region comprises a complementarity-determining region heavy chain 1 (CDR-H1) of SEQ ID NO: 725, CDR-H2 of SEQ ID NO: 1267, and CDR-H3 of SEQ ID NO: 1809; and/or a variable light chain region, wherein the variable light chain region comprises a complementarity-determining region light chain 1 (CDR-L1) of SEQ ID NO: 996, CDR-L2 of SEQ ID NO: 1538, and CDR-L3 of SEQ ID NO: 2080. In some embodiments, the variable heavy chain comprises a polypeptide consensus sequence having at least 95% sequence identity to the amino acid sequence of SEQ ID NO: 183, and the variable light chain comprises a polypeptide consensus sequence having at least 95% sequence identity to the amino acid sequence of SEQ ID NO: 454. In some embodiments, the antibody or antigen binding fragment thereof binds a human EP400NL, mouse EP400NL, rat EP400NL, bovine EP400NL, or cynomolgus monkey EP400NL. In some embodiments, the human EP400NL comprises a sequence of SEQ ID NO: 4454.

Provided herein is an antibody that competes with an antibody or antigen binding fragment for binding to EP400NL, wherein the antibody binds to human EP400NL or mouse EP400NL.

Provided herein is an antibody or an antigen binding fragment thereof that selectively binds to Bcl2 like 1 (BCL2L1) or a variant thereof, comprising at least one of: a variable heavy chain region, wherein the variable heavy chain region comprises a complementarity-determining region heavy chain 1 (CDR-H1) of SEQ ID NO: 727, CDR-H2 of SEQ ID NO: 1269, and CDR-H3 of SEQ ID NO: 1811; and/or a variable light chain region, wherein the variable light chain region comprises a complementarity-determining region light chain 1 (CDR-L1) of SEQ ID NO: 998, CDR-L2 of SEQ ID NO: 1540, and CDR-L3 of SEQ ID NO: 2082. In some embodiments, the variable heavy chain comprises a polypeptide consensus sequence having at least 95% sequence identity to the amino acid sequence of SEQ ID NO: 185, and the variable light chain comprises a polypeptide consensus sequence having at least 95% sequence identity to the amino acid sequence of SEQ ID NO: 456. In some embodiments, the antibody or antigen binding fragment thereof binds a human BCL2L1, mouse BCL2L1, rat BCL2L1, bovine BCL2L1, or cynomolgus monkey BCL2L1. In some embodiments, the human BCL2L1 comprises a sequence of SEQ ID NO: 4455.

Provided herein is an antibody that competes with an antibody or antigen binding fragment for binding to BCL2L1, wherein the antibody binds to human BCL2L1 or mouse BCL2L1.

Provided herein is an antibody or an antigen binding fragment thereof that selectively binds to arginine and glutamate rich 1 (ARGLU1) or a variant thereof, comprising at least one of: a variable heavy chain region, wherein the variable heavy chain region comprises a complementarity-determining region heavy chain 1 (CDR-H1) of SEQ ID NO: 728, CDR-H2 of SEQ ID NO: 1270, and CDR-H3 of SEQ ID NO: 1812; and/or a variable light chain region, wherein the variable light chain region comprises a complementarity-determining region light chain 1 (CDR-L1) of SEQ ID NO: 999, CDR-L2 of SEQ ID NO: 1541, and CDR-L3 of SEQ ID NO: 2083. In some embodiments, the variable heavy chain comprises a polypeptide consensus sequence having at least 95% sequence identity to the amino acid sequence of SEQ ID NO: 186, and the variable light chain comprises a polypeptide consensus sequence having at least 95% sequence identity to the amino acid sequence of SEQ ID NO: 457. In some embodiments, the antibody or antigen binding fragment thereof binds a human ARGLU1, mouse ARGLU1, rat ARGLU1, bovine ARGLU1, or cynomolgus monkey ARGLU1. In some embodiments, the human ARGLU1 comprises a sequence of SEQ ID NO: 4456.

Provided herein is an antibody that competes with an antibody or antigen binding fragment for binding to ARGLU1, wherein the antibody binds to human ARGLU1 or mouse ARGLU1.

Provided herein is an antibody or an antigen binding fragment thereof that selectively binds to SAS-6 centriolar assembly protein, transcript variant 2 (SASS6) or a variant thereof, comprising at least one of: a variable heavy chain region, wherein the variable heavy chain region comprises a complementarity-determining region heavy chain 1 (CDR-H1) of SEQ ID NO: 728, CDR-H2 of SEQ ID NO: 1270, and CDR-H3 of SEQ ID NO: 1812; and/or a variable light chain region, wherein the variable light chain region comprises a complementarity-determining region light chain 1 (CDR-L1) of SEQ ID NO: 999, CDR-L2 of SEQ ID NO: 1541, and CDR-L3 of SEQ ID NO: 2083. In some embodiments, the variable heavy chain comprises a polypeptide consensus sequence having at least 95% sequence identity to the amino acid sequence of SEQ ID NO: 186, and the variable light chain comprises a polypeptide consensus sequence having at least 95% sequence identity to the amino acid sequence of SEQ ID NO: 457. In some embodiments, the antibody or antigen binding fragment thereof binds a human SASS6, mouse SASS6, rat SASS6, bovine SASS6, or cynomolgus monkey SASS6. In some embodiments, the human SASS6 comprises a sequence of SEQ ID NO: 4457.

Provided herein is an antibody that competes with an antibody or antigen binding fragment for binding to SASS6, wherein the antibody binds to human SASS6 or mouse SASS6.

Provided herein is an antibody or an antigen binding fragment thereof that selectively binds to proteasome 26S subunit, non-ATPase 4, transcript variant 2 (PSMD4) or a variant thereof, comprising at least one of: a variable heavy chain region, wherein the variable heavy chain region comprises a complementarity-determining region heavy chain 1 (CDR-H1) of SEQ ID NO: 729, CDR-H2 of SEQ ID NO: 1271, and CDR-H3 of SEQ ID NO: 1813; and/or a variable light chain region, wherein the variable light chain region comprises a complementarity-determining region light chain 1 (CDR-L1) of SEQ ID NO: 1000, CDR-L2 of SEQ ID NO: 1542, and CDR-L3 of SEQ ID NO: 2084. In some embodiments, the variable heavy chain comprises a polypeptide consensus sequence having at least 95% sequence identity to the amino acid sequence of SEQ ID NO: 187, and the variable light chain comprises a polypeptide consensus sequence having at least 95% sequence identity to the amino acid sequence of SEQ ID NO: 458. In some embodiments, the antibody or antigen binding fragment thereof binds a human PSMD4, mouse PSMD4, rat PSMD4, bovine PSMD4, or cynomolgus monkey PSMD4. In some embodiments, the human PSMD4 comprises a sequence of SEQ ID NO: 4458.

Provided herein is an antibody that competes with an antibody or antigen binding fragment for binding to PSMD4, wherein the antibody binds to human PSMD4 or mouse PSMD4.

Provided herein is an antibody or an antigen binding fragment thereof that selectively binds to Src like adaptor, transcript variant 1 (SLA) or a variant thereof, comprising at least one of: a variable heavy chain region, wherein the variable heavy chain region comprises a complementarity-determining region heavy chain 1 (CDR-H1) of SEQ ID NO: 729, CDR-H2 of SEQ ID NO: 1271, and CDR-H3 of SEQ ID NO: 1813; and/or a variable light chain region, wherein the variable light chain region comprises a complementarity-determining region light chain 1 (CDR-L1) of SEQ ID NO: 1000, CDR-L2 of SEQ ID NO: 1542, and CDR-L3 of SEQ ID NO: 2084. In some embodiments, the variable heavy chain comprises a polypeptide consensus sequence having at least 95% sequence identity to the amino acid sequence of SEQ ID NO: 187, and the variable light chain comprises a polypeptide consensus sequence having at least 95% sequence identity to the amino acid sequence of SEQ ID NO: 458. In some embodiments, the antibody or antigen binding fragment thereof binds a human SLA, mouse SLA, rat SLA, bovine SLA, or cynomolgus monkey SLA. In some embodiments, the human SLA comprises a sequence of SEQ ID NO: 4459.

Provided herein is an antibody that competes with an antibody or antigen binding fragment for binding to SLA, wherein the antibody binds to human SLA or mouse SLA.

Provided herein is an antibody or an antigen binding fragment thereof that selectively binds to nudix hydrolase 21 (NUDT21) or a variant thereof, comprising at least one of: a variable heavy chain region, wherein the variable heavy chain region comprises a complementarity-determining region heavy chain 1 (CDR-H1) of SEQ ID NO: 730, CDR-H2 of SEQ ID NO: 1272, and CDR-H3 of SEQ ID NO: 1814; and/or a variable light chain region, wherein the variable light chain region comprises a complementarity-determining region light chain 1 (CDR-L1) of SEQ ID NO: 1001, CDR-L2 of SEQ ID NO: 1543, and CDR-L3 of SEQ ID NO: 2085. In some embodiments, the variable heavy chain comprises a polypeptide consensus sequence having at least 95% sequence identity to the amino acid sequence of SEQ ID NO: 188, and the variable light chain comprises a polypeptide consensus sequence having at least 95% sequence identity to the amino acid sequence of SEQ ID NO: 459. In some embodiments, the antibody or antigen binding fragment thereof binds a human NUDT21, mouse NUDT21, rat NUDT21, bovine NUDT21, or cynomolgus monkey NUDT21. In some embodiments, the human NUDT21 comprises a sequence of SEQ ID NO: 4460.

Provided herein is an antibody that competes with an antibody or antigen binding fragment for binding to NUDT21, wherein the antibody binds to human NUDT21 or mouse NUDT21.

Provided herein is an antibody or an antigen binding fragment thereof that selectively binds to zinc finger protein 431, transcript variant 2 (ZNF431) or a variant thereof, comprising at least one of: a variable heavy chain region, wherein the variable heavy chain region comprises a complementarity-determining region heavy chain 1 (CDR-H1) of SEQ ID NO: 730, CDR-H2 of SEQ ID NO: 1272, and CDR-H3 of SEQ ID NO: 1814; and/or a variable light chain region, wherein the variable light chain region comprises a complementarity-determining region light chain 1 (CDR-L1) of SEQ ID NO: 1001, CDR-L2 of SEQ ID NO: 1543, and CDR-L3 of SEQ ID NO: 2085. In some embodiments, the variable heavy chain comprises a polypeptide consensus sequence having at least 95% sequence identity to the amino acid sequence of SEQ ID NO: 188, and the variable light chain comprises a polypeptide consensus sequence having at least 95% sequence identity to the amino acid sequence of SEQ ID NO: 459. In some embodiments, the antibody or antigen binding fragment thereof binds a human ZNF431, mouse ZNF431, rat ZNF431, bovine ZNF431, or cynomolgus monkey ZNF431. In some embodiments, the human ZNF431 comprises a sequence of SEQ ID NO: 4461.

Provided herein is an antibody that competes with an antibody or antigen binding fragment for binding to ZNF431, wherein the antibody binds to human ZNF431 or mouse ZNF431.

Provided herein is an antibody or an antigen binding fragment thereof that selectively binds to Zinc finger protein 699 (ZNF699) or a variant thereof, comprising at least one of: a variable heavy chain region, wherein the variable heavy chain region comprises a complementarity-determining region heavy chain 1 (CDR-H1) of SEQ ID NO: 730, CDR-H2 of SEQ ID NO: 1272, and CDR-H3 of SEQ ID NO: 1814; and/or a variable light chain region, wherein the variable light chain region comprises a complementarity-determining region light chain 1 (CDR-L1) of SEQ ID NO: 1001, CDR-L2 of SEQ ID NO: 1543, and CDR-L3 of SEQ ID NO: 2085. In some embodiments, the variable heavy chain comprises a polypeptide consensus sequence having at least 95% sequence identity to the amino acid sequence of SEQ ID NO: 188, and the variable light chain comprises a polypeptide consensus sequence having at least 95% sequence identity to the amino acid sequence of SEQ ID NO: 459. In some embodiments, the antibody or antigen binding fragment thereof binds a human ZNF699, mouse ZNF699, rat ZNF699, bovine ZNF699, or cynomolgus monkey ZNF699. In some embodiments, the human ZNF699 comprises a sequence of SEQ ID NO: 4462.

Provided herein is an antibody that competes with an antibody or antigen binding fragment for binding to ZNF699, wherein the antibody binds to human ZNF699 or mouse ZNF699.

Provided herein is an antibody or an antigen binding fragment thereof that selectively binds to quinoid dihydropteridine reductase, transcript variant 1 (QDPR) or a variant thereof, comprising at least one of: a variable heavy chain region, wherein the variable heavy chain region comprises a complementarity-determining region heavy chain 1 (CDR-H1) of SEQ ID NO: 731, CDR-H2 of SEQ ID NO: 1273, and CDR-H3 of SEQ ID NO: 1815; and/or a variable light chain region, wherein the variable light chain region comprises a complementarity-determining region light chain 1 (CDR-L1) of SEQ ID NO: 1002, CDR-L2 of SEQ ID NO: 1544, and CDR-L3 of SEQ ID NO: 2086. In some embodiments, the variable heavy chain comprises a polypeptide consensus sequence having at least 95% sequence identity to the amino acid sequence of SEQ ID NO: 189, and the variable light chain comprises a polypeptide consensus sequence having at least 95% sequence identity to the amino acid sequence of SEQ ID NO: 460. In some embodiments, the antibody or antigen binding fragment thereof binds a human QDPR, mouse QDPR, rat QDPR, bovine QDPR, or cynomolgus monkey QDPR. In some embodiments, the human QDPR comprises a sequence of SEQ ID NO: 4438.

Provided herein is an antibody that competes with an antibody or antigen binding fragment for binding to QDPR, wherein the antibody binds to human QDPR or mouse QDPR.

Provided herein is an antibody or an antigen binding fragment thereof that selectively binds to PAGE family member 2 (PAGE2) or a variant thereof, comprising at least one of:
 a variable heavy chain region, wherein the variable heavy chain region comprises a complementarity-determining region heavy chain 1 (CDR-H1) of SEQ ID NO: 732, CDR-H2 of SEQ ID NO: 1274, and CDR-H3 of SEQ ID NO: 1816; and/or a variable light chain region, wherein the variable light chain region comprises a complementarity-determining region light chain 1 (CDR-L1) of SEQ ID NO: 1003, CDR-L2 of SEQ ID NO: 1545, and CDR-L3 of SEQ ID NO: 2087. In some embodiments, the variable heavy chain comprises a polypeptide consensus sequence having at least 95% sequence identity to the amino acid sequence of SEQ ID NO: 190, and the variable light chain comprises a polypeptide consensus sequence having at least 95% sequence identity to the amino acid sequence of SEQ ID NO: 461. In some embodiments, the antibody or antigen binding fragment thereof binds a human PAGE2, mouse PAGE2, rat PAGE2, bovine PAGE2, or cynomolgus monkey PAGE2. In some embodiments, the human PAGE2 comprises a sequence of SEQ ID NO: 4463.

Provided herein is an antibody that competes with an antibody or antigen binding fragment for binding to PAGE2, wherein the antibody binds to human PAGE2 or mouse PAGE2.

Provided herein is an antibody or an antigen binding fragment thereof that selectively binds to keratin associated protein 12-3 (KRTAP12-3) or a variant thereof, comprising at least one of: a variable heavy chain region, wherein the variable heavy chain region comprises a complementarity-determining region heavy chain 1 (CDR-H1) of SEQ ID NO: 732, CDR-H2 of SEQ ID NO: 1274, and CDR-H3 of SEQ ID NO: 1816; and/or a variable light chain region, wherein the variable light chain region comprises a complementarity-determining region light chain 1 (CDR-L1) of SEQ ID NO: 1003, CDR-L2 of SEQ ID NO: 1545, and CDR-L3 of SEQ ID NO: 2087. In some embodiments, the variable heavy chain comprises a polypeptide consensus sequence having at least 95% sequence identity to the amino acid sequence of SEQ ID NO: 190, and the variable light chain comprises a polypeptide consensus sequence having at least 95% sequence identity to the amino acid sequence of SEQ ID NO: 461. In some embodiments, the antibody or antigen binding fragment thereof binds a human KRTAP12-3, mouse KRTAP12-3, rat KRTAP12-3, bovine KRTAP12-3, or cynomolgus monkey KRTAP12-3. In some embodiments, the human KRTAP12-3 comprises a sequence of SEQ ID NO: 4464.

Provided herein is an antibody that competes with an antibody or antigen binding fragment for binding to KRTAP12-3, wherein the antibody binds to human KRTAP12-3 or mouse KRTAP12-3.

Provided herein is an antibody or an antigen binding fragment thereof that selectively binds to enolase 2 (ENO2) or a variant thereof, comprising at least one of: a variable heavy chain region, wherein the variable heavy chain region comprises a complementarity-determining region heavy chain 1 (CDR-H1) of SEQ ID NO: 734, CDR-H2 of SEQ ID NO: 1276, and CDR-H3 of SEQ ID NO: 1818; and/or a variable light chain region, wherein the variable light chain region comprises a complementarity-determining region light chain 1 (CDR-L1) of SEQ ID NO: 1005, CDR-L2 of SEQ ID NO: 1547, and CDR-L3 of SEQ ID NO: 2089. In some embodiments, the variable heavy chain comprises a polypeptide consensus sequence having at least 95% sequence identity to the amino acid sequence of SEQ ID NO: 192, and the variable light chain comprises a polypeptide consensus sequence having at least 95% sequence identity to the amino acid sequence of SEQ ID NO: 463. In some embodiments, the antibody or antigen binding fragment thereof binds a human ENO2, mouse ENO2, rat ENO2, bovine ENO2, or cynomolgus monkey ENO2. In some embodiments, the human ENO2 comprises a sequence of SEQ ID NO: 4465.

Provided herein is an antibody that competes with an antibody or antigen binding fragment for binding to ENO2, wherein the antibody binds to human ENO2 or mouse ENO2.

Provided herein is an antibody or an antigen binding fragment thereof that selectively binds to chromosome 11 open reading frame 68, transcript variant 1 (C11orf68) or a variant thereof, comprising at least one of: a variable heavy chain region, wherein the variable heavy chain region comprises a complementarity-determining region heavy chain 1 (CDR-H1) of SEQ ID NO: 734, CDR-H2 of SEQ ID NO: 1276, and CDR-H3 of SEQ ID NO: 1818; and/or a variable light chain region, wherein the variable light chain region comprises a complementarity-determining region light chain 1 (CDR-L1) of SEQ ID NO: 1005, CDR-L2 of SEQ ID NO: 1547, and CDR-L3 of SEQ ID NO: 2089. In some embodiments, the variable heavy chain comprises a polypeptide consensus sequence having at least 95% sequence identity to the amino acid sequence of SEQ ID NO: 192, and the variable light chain comprises a polypeptide consensus sequence having at least 95% sequence identity to the amino acid sequence of SEQ ID NO: 463. In some embodiments, the antibody or antigen binding fragment thereof binds a human C11orf68, mouse C11orf68, rat C11orf68, bovine C11orf68, or cynomolgus monkey C11orf68. In some embodiments, the human C11orf68 comprises a sequence of SEQ ID NO: 4466.

Provided herein is an antibody that competes with an antibody or antigen binding fragment for binding to C11orf68, wherein the antibody binds to human C11orf68 or mouse C11orf68.

Provided herein is an antibody or an antigen binding fragment thereof that selectively binds to methionyl-tRNA synthetase 1 (MARS) or a variant thereof, comprising at least one of: a variable heavy chain region, wherein the variable heavy chain region comprises a complementarity-determining region heavy chain 1 (CDR-H1) of SEQ ID NO: 735, CDR-H2 of SEQ ID NO: 1277, and CDR-H3 of SEQ ID NO: 1819; and/or a variable light chain region, wherein the variable light chain region comprises a complementarity-determining region light chain 1 (CDR-L1) of SEQ ID NO: 1006, CDR-L2 of SEQ ID NO: 1548, and CDR-L3 of SEQ ID NO: 2090. In some embodiments, the variable heavy chain comprises a polypeptide consensus sequence having at least 95% sequence identity to the amino acid sequence of SEQ ID NO: 193, and the variable light chain comprises a polypeptide consensus sequence having at least 95% sequence identity to the amino acid sequence of SEQ ID NO: 464. In some embodiments, the antibody or antigen binding fragment thereof binds a human MARS, mouse MARS, rat MARS, bovine MARS, or cynomolgus monkey MARS. In some embodiments, the human MARS comprises a sequence of SEQ ID NO: 4467.

Provided herein is an antibody that competes with an antibody or antigen binding fragment for binding to MARS, wherein the antibody binds to human MARS or mouse MARS.

Provided herein is an antibody or an antigen binding fragment thereof that selectively binds to serpin family B member 6, transcript variant 2 (SERPINB6) or a variant thereof, comprising at least one of: a variable heavy chain region, wherein the variable heavy chain region comprises a complementarity-determining region heavy chain 1 (CDR-H1) of SEQ ID NO: 737, CDR-H2 of SEQ ID NO: 1279, and CDR-H3 of SEQ ID NO: 1821; and/or a variable light chain region, wherein the variable light chain region comprises a complementarity-determining region light chain 1 (CDR-L1) of SEQ ID NO: 1008, CDR-L2 of SEQ ID NO: 1550, and CDR-L3 of SEQ ID NO: 2092. In some embodiments, the variable heavy chain comprises a polypeptide consensus sequence having at least 95% sequence identity to the amino acid sequence of SEQ ID NO: 195, and the variable light chain comprises a polypeptide consensus sequence having at least 95% sequence identity to the amino acid sequence of SEQ ID NO: 466. In some embodiments, the antibody or antigen binding fragment thereof binds a human SERPINB6, mouse SERPINB6, rat SERPINB6, bovine SERPINB6, or cynomolgus monkey SERPINB6. In some embodiments, the human SERPINB6 comprises a sequence of SEQ ID NO: 4468.

Provided herein is an antibody that competes with an antibody or antigen binding fragment for binding to SERPINB6, wherein the antibody binds to human SERPINB6 or mouse SERPINB6.

Provided herein is an antibody or an antigen binding fragment thereof that selectively binds to endoplasmic reticulum protein 27, transcript variant 1 (ERP27) or a variant thereof, comprising at least one of: a variable heavy chain region, wherein the variable heavy chain region comprises a complementarity-determining region heavy chain 1 (CDR-H1) of SEQ ID NO: 738, CDR-H2 of SEQ ID NO: 1280, and CDR-H3 of SEQ ID NO: 1822; and/or a variable light chain region, wherein the variable light chain region comprises a complementarity-determining region light chain 1 (CDR-L1) of SEQ ID NO: 1009, CDR-L2 of SEQ ID NO: 1551, and CDR-L3 of SEQ ID NO: 2093. In some embodiments, the variable heavy chain comprises a polypeptide consensus sequence having at least 95% sequence identity to the amino acid sequence of SEQ ID NO: 196, and the variable light chain comprises a polypeptide consensus sequence having at least 95% sequence identity to the amino acid sequence of SEQ ID NO: 467. In some embodiments, the antibody or antigen binding fragment thereof binds a human ERP27, mouse ERP27, rat ERP27, bovine ERP27, or cynomolgus monkey ERP27. In some embodiments, the human ERP27 comprises a sequence of SEQ ID NO: 4469.

Provided herein is an antibody that competes with an antibody or antigen binding fragment for binding to ERP27, wherein the antibody binds to human ERP27 or mouse ERP27.

Provided herein is an antibody or an antigen binding fragment thereof that selectively binds to Dpy-30 histone methyltransferase complex regulatory subunit (DPY30) or a variant thereof, comprising at least one of:
a variable heavy chain region, wherein the variable heavy chain region comprises a complementarity-determining region heavy chain 1 (CDR-H1) of SEQ ID NO: 738, CDR-H2 of SEQ ID NO: 1280, and CDR-H3 of SEQ ID NO: 1822; and/or a variable light chain region, wherein the variable light chain region comprises a complementarity-determining region light chain 1 (CDR-L1) of SEQ ID NO: 1009, CDR-L2 of SEQ ID NO: 1551, and CDR-L3 of SEQ ID NO: 2093. In some embodiments, the variable heavy chain comprises a polypeptide consensus sequence having at least 95% sequence identity to the amino acid sequence of SEQ ID NO: 196, and the variable light chain comprises a polypeptide consensus sequence having at least 95% sequence identity to the amino acid sequence of SEQ ID NO: 467. In some embodiments, the antibody or antigen binding fragment thereof binds a human DPY30, mouse DPY30, rat DPY30, bovine DPY30, or cynomolgus monkey DPY30. In some embodiments, the human DPY30 comprises a sequence of SEQ ID NO: 4470.

Provided herein is an antibody that competes with an antibody or antigen binding fragment for binding to DPY30, wherein the antibody binds to human DPY30 or mouse DPY30.

Provided herein is an antibody or an antigen binding fragment thereof that selectively binds to rhophilin associated tail protein 1 like, transcript variant 2 (ROPN1L) or a variant thereof, comprising at least one of: a variable heavy chain region, wherein the variable heavy chain region comprises a complementarity-determining region heavy chain 1 (CDR-H1) of SEQ ID NO: 738, CDR-H2 of SEQ ID NO: 1280, and CDR-H3 of SEQ ID NO: 1822; and/or a variable light chain region, wherein the variable light chain region comprises a complementarity-determining region light chain 1 (CDR-L1) of SEQ ID NO: 1009, CDR-L2 of SEQ ID NO: 1551, and CDR-L3 of SEQ ID NO: 2093. In some embodiments, the variable heavy chain comprises a polypeptide consensus sequence having at least 95% sequence identity to the amino acid sequence of SEQ ID NO: 196, and the variable light chain comprises a polypeptide consensus sequence having at least 95% sequence identity to the amino acid sequence of SEQ ID NO: 467. In some embodiments, the antibody or antigen binding fragment thereof binds a human ROPN1L, mouse ROPN1L, rat ROPN1L, bovine ROPN1L, or cynomolgus monkey ROPN1L. In some embodiments, the human ROPN1L comprises a sequence of SEQ ID NO: 4471.

Provided herein is an antibody that competes with an antibody or antigen binding fragment for binding to ROPN1L, wherein the antibody binds to human ROPN1L or mouse ROPN1L.

Provided herein is an antibody or an antigen binding fragment thereof that selectively binds to endosome associated trafficking regulator 1, transcript variant 2 (SDCCAG3) or a variant thereof, comprising at least one of: a variable heavy chain region, wherein the variable heavy chain region comprises a complementarity-determining region heavy chain 1 (CDR-H1) of SEQ ID NO: 739, CDR-H2 of SEQ ID NO: 1281, and CDR-H3 of SEQ ID NO: 1823; and/or a variable light chain region, wherein the variable light chain region comprises a complementarity-determining region light chain 1 (CDR-L1) of SEQ ID NO: 1010, CDR-L2 of SEQ ID NO: 1552, and CDR-L3 of SEQ ID NO: 2094. In some embodiments, the variable heavy chain comprises a polypeptide consensus sequence having at least 95% sequence identity to the amino acid sequence of SEQ ID NO: 197, and the variable light chain comprises a polypeptide consensus sequence having at least 95% sequence identity to the amino acid sequence of SEQ ID NO: 468. In some embodiments, the antibody or antigen binding fragment thereof binds a human SDCCAG3, mouse SDCCAG3, rat SDCCAG3, bovine SDCCAG3, or cynomolgus monkey SDCCAG3. In some embodiments, the human SDCCAG3 comprises a sequence of SEQ ID NO: 4373.

Provided herein is an antibody that competes with an antibody or antigen binding fragment for binding to SDCCAG3, wherein the antibody binds to human SDCCAG3 or mouse SDCCAG3.

Provided herein is an antibody or an antigen binding fragment thereof that selectively binds to Jupiter microtubule associated homolog 2 (HN1L) or a variant thereof, comprising at least one of: a variable heavy chain region, wherein the variable heavy chain region comprises a complementarity-determining region heavy chain 1 (CDR-H1) of SEQ ID NO: 740, CDR-H2 of SEQ ID NO: 1282, and CDR-H3 of SEQ ID NO: 1824; and/or a variable light chain region, wherein the variable light chain region comprises a complementarity-determining region light chain 1 (CDR-L1) of SEQ ID NO: 1011, CDR-L2 of SEQ ID NO: 1553, and CDR-L3 of SEQ ID NO: 2095. In some embodiments, the variable heavy chain comprises a polypeptide consensus sequence having at least 95% sequence identity to the amino acid sequence of SEQ ID NO: 198, and the variable light chain comprises a polypeptide consensus sequence having at least 95% sequence identity to the amino acid sequence of SEQ ID NO: 469. In some embodiments, the antibody or antigen binding fragment thereof binds a human HN1L, mouse HN1L, rat HN1L, bovine HN1L, or cynomolgus monkey HN1L. In some embodiments, the human HN1L comprises a sequence of SEQ ID NO: 4395.

Provided herein is an antibody that competes with an antibody or antigen binding fragment for binding to HN1L, wherein the antibody binds to human HN1L or mouse HN1L.

Provided herein is an antibody or an antigen binding fragment thereof that selectively binds to BTB domain containing 8 (BTBD8) or a variant thereof, comprising at least one of: a variable heavy chain region, wherein the variable heavy chain region comprises a complementarity-determining region heavy chain 1 (CDR-H1) of SEQ ID NO: 740, CDR-H2 of SEQ ID NO: 1282, and CDR-H3 of SEQ ID NO: 1824; and/or a variable light chain region, wherein the variable light chain region comprises a complementarity-determining region light chain 1 (CDR-L1) of SEQ ID NO: 1011, CDR-L2 of SEQ ID NO: 1553, and CDR-L3 of SEQ ID NO: 2095. In some embodiments, the variable heavy chain comprises a polypeptide consensus sequence having at least 95% sequence identity to the amino acid sequence of SEQ ID NO: 198, and the variable light chain comprises a polypeptide consensus sequence having at least 95% sequence identity to the amino acid sequence of SEQ ID NO: 469. In some embodiments, the antibody or antigen binding fragment thereof binds a human BTBD8, mouse BTBD8, rat BTBD8, bovine BTBD8, or cynomolgus monkey BTBD8. In some embodiments, the human BTBD8 comprises a sequence of SEQ ID NO: 4472.

Provided herein is an antibody that competes with an antibody or antigen binding fragment for binding to BTBD8, wherein the antibody binds to human BTBD8 or mouse BTBD8.

Provided herein is an antibody or an antigen binding fragment thereof that selectively binds to neutrophil cytosolic factor 4, transcript variant 2 (NCF4) or a variant thereof, comprising at least one of: a variable heavy chain region, wherein the variable heavy chain region comprises a complementarity-determining region heavy chain 1 (CDR-H1) of SEQ ID NO: 741, CDR-H2 of SEQ ID NO: 1283, and CDR-H3 of SEQ ID NO: 1825; and/or a variable light chain region, wherein the variable light chain region comprises a complementarity-determining region light chain 1 (CDR-L1) of SEQ ID NO: 1012, CDR-L2 of SEQ ID NO: 1554, and CDR-L3 of SEQ ID NO: 2096. In some embodiments, the variable heavy chain comprises a polypeptide consensus sequence having at least 95% sequence identity to the amino acid sequence of SEQ ID NO: 199, and the variable light chain comprises a polypeptide consensus sequence having at least 95% sequence identity to the amino acid sequence of SEQ ID NO: 470. In some embodiments, the antibody or antigen binding fragment thereof binds a human NCF4, mouse NCF4, rat NCF4, bovine NCF4, or cynomolgus monkey NCF4. In some embodiments, the human NCF4 comprises a sequence of SEQ ID NO: 4473.

Provided herein is an antibody that competes with an antibody or antigen binding fragment for binding to NCF4, wherein the antibody binds to human NCF4 or mouse NCF4.

Provided herein is an antibody or an antigen binding fragment thereof that selectively binds to t-complex 11 like 2, transcript variant X2 (TCP11L2) or a variant thereof, comprising at least one of: a variable heavy chain region, wherein the variable heavy chain region comprises a complementarity-determining region heavy chain 1 (CDR-H1) of SEQ ID NO: 741, CDR-H2 of SEQ ID NO: 1283, and CDR-H3 of SEQ ID NO: 1825; and/or a variable light chain region, wherein the variable light chain region comprises a complementarity-determining region light chain 1 (CDR-L1) of SEQ ID NO: 1012, CDR-L2 of SEQ ID NO: 1554, and CDR-L3 of SEQ ID NO: 2096. In some embodiments, the variable heavy chain comprises a polypeptide consensus sequence having at least 95% sequence identity to the amino acid sequence of SEQ ID NO: 199, and the variable light chain comprises a polypeptide consensus sequence having at least 95% sequence identity to the amino acid sequence of SEQ ID NO: 470. In some embodiments, the antibody or antigen binding fragment thereof binds a human TCP11L2, mouse TCP11L2, rat TCP11L2, bovine TCP11L2, or cynomolgus monkey TCP11L2. In some embodiments, the human TCP11L2 comprises a sequence of SEQ ID NO: 4474.

Provided herein is an antibody that competes with an antibody or antigen binding fragment for binding to TCP11L2, wherein the antibody binds to human TCP11L2 or mouse TCP11L2.

Provided herein is an antibody or an antigen binding fragment thereof that selectively binds to phospholipase C beta 2, transcript variant 4 (PLCB2) or a variant thereof, comprising at least one of: a variable heavy chain region, wherein the variable heavy chain region comprises a complementarity-determining region heavy chain 1 (CDR-H1) of SEQ ID NO: 741, CDR-H2 of SEQ ID NO: 1283, and CDR-H3 of SEQ ID NO: 1825; and/or
a variable light chain region, wherein the variable light chain region comprises a complementarity-determining region light chain 1 (CDR-L1) of SEQ ID NO: 1012, CDR-L2 of SEQ ID NO: 1554, and CDR-L3 of SEQ ID NO: 2096. In some embodiments, the variable heavy chain comprises a polypeptide consensus sequence having at least 95% sequence identity to the amino acid sequence of SEQ ID NO: 199, and the variable light chain comprises a polypeptide consensus sequence having at least 95% sequence identity to the amino acid sequence of SEQ ID NO: 470. In some embodiments, the antibody or antigen binding fragment thereof binds a human PLCB2, mouse PLCB2, rat PLCB2, bovine PLCB2, or cynomolgus monkey PLCB2. In some embodiments, the human PLCB2 comprises a sequence of SEQ ID NO: 4475.

Provided herein is an antibody that competes with an antibody or antigen binding fragment for binding to PLCB2, wherein the antibody binds to human PLCB2 or mouse PLCB2.

Provided herein is an antibody or an antigen binding fragment thereof that selectively binds to microtubule associated protein RP/EB family member 2, transcript variant 1 (MAPRE2) or a variant thereof, comprising at least one of: a variable heavy chain region, wherein the variable heavy chain region comprises a complementarity-determining region heavy chain 1 (CDR-H1) of SEQ ID NO: 742, CDR-H2 of SEQ ID NO: 1284, and CDR-H3 of SEQ ID NO: 1826; and/or a variable light chain region, wherein the variable light chain region comprises a complementarity-determining region light chain 1 (CDR-L1) of SEQ ID NO: 1013, CDR-L2 of SEQ ID NO: 1555, and CDR-L3 of SEQ ID NO: 2097. In some embodiments, the variable heavy chain comprises a polypeptide consensus sequence having at least 95% sequence identity to the amino acid sequence of SEQ ID NO: 200, and the variable light chain comprises a polypeptide consensus sequence having at least 95% sequence identity to the amino acid sequence of SEQ ID NO: 471. In some embodiments, the antibody or antigen binding fragment thereof binds a human MAPRE2, mouse MAPRE2, rat MAPRE2, bovine MAPRE2, or cynomolgus monkey MAPRE2. In some embodiments, the human MAPRE2 comprises a sequence of SEQ ID NO: 4476.

Provided herein is an antibody that competes with an antibody or antigen binding fragment for binding to MAPRE2, wherein the antibody binds to human MAPRE2 or mouse MAPRE2.

Provided herein is an antibody or an antigen binding fragment thereof that selectively binds to DEAD-box helicase 53 (DDX53) or a variant thereof, comprising at least one of: a variable heavy chain region, wherein the variable heavy chain region comprises a complementarity-determining region heavy chain 1 (CDR-H1) of SEQ ID NO: 743, CDR-H2 of SEQ ID NO: 1285, and CDR-H3 of SEQ ID NO: 1827; and/or a variable light chain region, wherein the variable light chain region comprises a complementarity-determining region light chain 1 (CDR-L1) of SEQ ID NO: 1014, CDR-L2 of SEQ ID NO: 1556, and CDR-L3 of SEQ ID NO: 2098. In some embodiments, the variable heavy chain comprises a polypeptide consensus sequence having at least 95% sequence identity to the amino acid sequence of SEQ ID NO: 201, and the variable light chain comprises a polypeptide consensus sequence having at least 95% sequence identity to the amino acid sequence of SEQ ID NO: 472. In some embodiments, the antibody or antigen binding fragment thereof binds a human DDX53, mouse DDX53, rat DDX53, bovine DDX53, or cynomolgus monkey DDX53. In some embodiments, the human DDX53 comprises a sequence of SEQ ID NO: 4477.

Provided herein is an antibody that competes with an antibody or antigen binding fragment for binding to DDX53, wherein the antibody binds to human DDX53 or mouse DDX53.

Provided herein is an antibody or an antigen binding fragment thereof that selectively binds to interleukin 27 receptor subunit alpha (IL27RA) or a variant thereof, comprising at least one of: a variable heavy chain region, wherein the variable heavy chain region comprises a complementarity-determining region heavy chain 1 (CDR-H1) of SEQ ID NO: 744, CDR-H2 of SEQ ID NO: 1286, and CDR-H3 of SEQ ID NO: 1828; and/or a variable light chain region, wherein the variable light chain region comprises a complementarity-determining region light chain 1 (CDR-L1) of SEQ ID NO: 1015, CDR-L2 of SEQ ID NO: 1557, and CDR-L3 of SEQ ID NO: 2099. In some embodiments, the variable heavy chain comprises a polypeptide consensus sequence having at least 95% sequence identity to the amino acid sequence of SEQ ID NO: 202, and the variable light chain comprises a polypeptide consensus sequence having at least 95% sequence identity to the amino acid sequence of SEQ ID NO: 473. In some embodiments, the antibody or antigen binding fragment thereof binds a human IL27RA, mouse IL27RA, rat IL27RA, bovine IL27RA, or cynomolgus monkey IL27RA. In some embodiments, the human IL27RA comprises a sequence of SEQ ID NO: 4478.

Provided herein is an antibody that competes with an antibody or antigen binding fragment for binding to IL27RA, wherein the antibody binds to human IL27RA or mouse IL27RA.

Provided herein is an antibody or an antigen binding fragment thereof that selectively binds to Deoxyhypusine synthase (DHPS) or a variant thereof, comprising at least one of: a variable heavy chain region, wherein the variable heavy chain region comprises a complementarity-determining region heavy chain 1 (CDR-H1) of SEQ ID NO: 745, CDR-H2 of SEQ ID NO: 1287, and CDR-H3 of SEQ ID NO: 1829; and/or a variable light chain region, wherein the variable light chain region comprises a complementarity-determining region light chain 1 (CDR-L1) of SEQ ID NO: 1016, CDR-L2 of SEQ ID NO: 1558, and CDR-L3 of SEQ ID NO: 2100. In some embodiments, the variable heavy chain comprises a polypeptide consensus sequence having at least 95% sequence identity to the amino acid sequence of SEQ ID NO: 203, and the variable light chain comprises a polypeptide consensus sequence having at least 95% sequence identity to the amino acid sequence of SEQ ID NO: 474. In some embodiments, the antibody or antigen binding fragment thereof binds a human DHPS, mouse DHPS, rat DHPS, bovine DHPS, or cynomolgus monkey DHPS. In some embodiments, the human DHPS comprises a sequence of SEQ ID NO: 4479.

Provided herein is an antibody that competes with an antibody or antigen binding fragment for binding to DHPS, wherein the antibody binds to human DHPS or mouse DHPS.

Provided herein is an antibody or an antigen binding fragment thereof that selectively binds to HEAT repeat containing 3, transcript variant 1 (HEATR3) or a variant thereof, comprising at least one of:
a variable heavy chain region, wherein the variable heavy chain region comprises a complementarity-determining region heavy chain 1 (CDR-H1) of SEQ ID NO: 746, CDR-H2 of SEQ ID NO: 1288, and CDR-H3 of SEQ ID NO: 1830; and/or a variable light chain region, wherein the variable light chain region comprises a complementarity-determining region light chain 1 (CDR-L1) of SEQ ID NO: 1017, CDR-L2 of SEQ ID NO: 1559, and CDR-L3 of SEQ ID NO: 2101. In some embodiments, the variable heavy chain comprises a polypeptide consensus sequence having at least 95% sequence identity to the amino acid sequence of SEQ ID NO: 204, and the variable light chain comprises a polypeptide consensus sequence having at least 95% sequence identity to the amino acid sequence of SEQ ID NO: 475. In some embodiments, the antibody or antigen binding fragment thereof binds a human HEATR3, mouse HEATR3, rat HEATR3, bovine HEATR3, or cynomolgus monkey HEATR3. In some embodiments, the human HEATR3 comprises a sequence of SEQ ID NO: 4480.

Provided herein is an antibody that competes with an antibody or antigen binding fragment for binding to HEATR3, wherein the antibody binds to human HEATR3 or mouse HEATR3.

Provided herein is an antibody or an antigen binding fragment thereof that selectively binds to DEAD-box helicase 53 (DDX53) or a variant thereof, comprising at least one of: a variable heavy chain region, wherein the variable heavy chain region comprises a complementarity-determining region heavy chain 1 (CDR-H1) of SEQ ID NO: 747, CDR-H2 of SEQ ID NO: 1289, and CDR-H3 of SEQ ID NO: 1831; and/or a variable light chain region, wherein the variable light chain region comprises a complementarity-determining region light chain 1 (CDR-L1) of SEQ ID NO: 1018, CDR-L2 of SEQ ID NO: 1560, and CDR-L3 of SEQ ID NO: 2102. In some embodiments, the variable heavy chain comprises a polypeptide consensus sequence having at least 95% sequence identity to the amino acid sequence of SEQ ID NO: 205, and the variable light chain comprises a polypeptide consensus sequence having at least 95% sequence identity to the amino acid sequence of SEQ ID NO: 476. In some embodiments, the antibody or antigen binding fragment thereof binds a human DDX53, mouse DDX53, rat DDX53, bovine DDX53, or cynomolgus monkey DDX53. In some embodiments, the human DDX53 comprises a sequence of SEQ ID NO: 4477.

Provided herein is an antibody that competes with an antibody or antigen binding fragment for binding to DDX53, wherein the antibody binds to human DDX53 or mouse DDX53.

Provided herein is an antibody or an antigen binding fragment thereof that selectively binds to Vezatin, adherens junctions transmembrane protein (VEZT) or a variant thereof, comprising at least one of: a variable heavy chain region, wherein the variable heavy chain region comprises a complementarity-determining region heavy chain 1 (CDR-H1) of SEQ ID NO: 747, CDR-H2 of SEQ ID NO: 1289, and CDR-H3 of SEQ ID NO: 1831; and/or a variable light chain region, wherein the variable light chain region comprises a complementarity-determining region light chain 1 (CDR-L1) of SEQ ID NO: 1018, CDR-L2 of SEQ ID NO: 1560, and CDR-L3 of SEQ ID NO: 2102. In some embodiments, the variable heavy chain comprises a polypeptide consensus sequence having at least 95% sequence identity to the amino acid sequence of SEQ ID NO: 205, and the variable light chain comprises a polypeptide consensus sequence having at least 95% sequence identity to the amino acid sequence of SEQ ID NO: 476. In some embodiments, the antibody or antigen binding fragment thereof binds a human VEZT, mouse VEZT, rat VEZT, bovine VEZT, or cynomolgus monkey VEZT. In some embodiments, the human VEZT comprises a sequence of SEQ ID NO: 4481.

Provided herein is an antibody that competes with an antibody or antigen binding fragment for binding to VEZT, wherein the antibody binds to human VEZT or mouse VEZT.

Provided herein is an antibody or an antigen binding fragment thereof that selectively binds to Wd repeat domain 3 (WDR3) or a variant thereof, comprising at least one of: a variable heavy chain region, wherein the variable heavy chain region comprises a complementarity-determining region heavy chain 1 (CDR-H1) of SEQ ID NO: 747, CDR-H2 of SEQ ID NO: 1289, and CDR-H3 of SEQ ID NO: 1831; and/or a variable light chain region, wherein the variable light chain region comprises a complementarity-determining region light chain 1 (CDR-L1) of SEQ ID NO: 1018, CDR-L2 of SEQ ID NO: 1560, and CDR-L3 of SEQ ID NO: 2102. In some embodiments, the variable heavy chain comprises a polypeptide consensus sequence having at least 95% sequence identity to the amino acid sequence of SEQ ID NO: 205, and the variable light chain comprises a polypeptide consensus sequence having at least 95% sequence identity to the amino acid sequence of SEQ ID NO: 476. In some embodiments, the antibody or antigen binding fragment thereof binds a human WDR3, mouse WDR3, rat WDR3, bovine WDR3, or cynomolgus monkey WDR3. In some embodiments, the human WDR3 comprises a sequence of SEQ ID NO: 4482.

Provided herein is an antibody that competes with an antibody or antigen binding fragment for binding to WDR3, wherein the antibody binds to human WDR3 or mouse WDR3.

Provided herein is an antibody or an antigen binding fragment thereof that selectively binds to DExD/H-box helicase 58 (DDX58) or a variant thereof, comprising at least one of: a variable heavy chain region, wherein the variable heavy chain region comprises a complementarity-determining region heavy chain 1 (CDR-H1) of SEQ ID NO: 748, CDR-H2 of SEQ ID NO: 1290, and CDR-H3 of SEQ ID NO: 1832; and/or a variable light chain region, wherein the variable light chain region comprises a complementarity-determining region light chain 1 (CDR-L1) of SEQ ID NO: 1019, CDR-L2 of SEQ ID NO: 1561, and CDR-L3 of SEQ ID NO: 2103. In some embodiments, the variable heavy chain comprises a polypeptide consensus sequence having at least 95% sequence identity to the amino acid sequence of SEQ ID NO: 206, and the variable light chain comprises a polypeptide consensus sequence having at least 95% sequence identity to the amino acid sequence of SEQ ID NO: 477. In some embodiments, the antibody or antigen binding fragment thereof binds a human DDX58, mouse DDX58, rat DDX58, bovine DDX58, or cynomolgus monkey DDX58. In some embodiments, the human DDX58 comprises a sequence of SEQ ID NO: 4483.

Provided herein is an antibody that competes with an antibody or antigen binding fragment for binding to DDX58, wherein the antibody binds to human DDX58 or mouse DDX58.

Provided herein is an antibody or an antigen binding fragment thereof that selectively binds to DExD/H-box helicase 58 (DDX58) or a variant thereof, comprising at least one of: a variable heavy chain region, wherein the variable heavy chain region comprises a complementarity-determining region heavy chain 1 (CDR-H1) of SEQ ID NO: 748, CDR-H2 of SEQ ID NO: 1290, and CDR-H3 of SEQ ID NO: 1832; and/or a variable light chain region, wherein the variable light chain region comprises a complementarity-determining region light chain 1 (CDR-L1) of SEQ ID NO: 1019, CDR-L2 of SEQ ID NO: 1561, and CDR-L3 of SEQ ID NO: 2103. In some embodiments, the variable heavy chain comprises a polypeptide consensus sequence having at least 95% sequence identity to the amino acid sequence of SEQ ID NO: 206, and the variable light chain comprises a polypeptide consensus sequence having at least 95% sequence identity to the amino acid sequence of SEQ ID NO: 477. In some embodiments, the antibody or antigen binding fragment thereof binds a human DDX58, mouse DDX58, rat DDX58, bovine DDX58, or cynomolgus monkey DDX58. In some embodiments, the human DDX58 comprises a sequence of SEQ ID NO: 4483.

Provided herein is an antibody that competes with an antibody or antigen binding fragment for binding to DDX58, wherein the antibody binds to human DDX58 or mouse DDX58.

Provided herein is an antibody or an antigen binding fragment thereof that selectively binds to nudix hydrolase 22, transcript variant 2 (NUDT22) or a variant thereof, comprising at least one of: a variable heavy chain region, wherein the variable heavy chain region comprises a complementarity-determining region heavy chain 1 (CDR-H1) of SEQ ID NO: 749, CDR-H2 of SEQ ID NO: 1291, and CDR-H3 of SEQ ID NO: 1833; and/or a variable light chain region, wherein the variable light chain region comprises a complementarity-determining region light chain 1 (CDR-L1) of SEQ ID NO: 1020, CDR-L2 of SEQ ID NO: 1562, and CDR-L3 of SEQ ID NO: 2104. In some embodiments, the variable heavy chain comprises a polypeptide consensus sequence having at least 95% sequence identity to the amino acid sequence of SEQ ID NO: 207, and the variable light chain comprises a polypeptide consensus sequence having at least 95% sequence identity to the amino acid sequence of SEQ ID NO: 478. In some embodiments, the antibody or antigen binding fragment thereof binds a human NUDT22, mouse NUDT22, rat NUDT22, bovine NUDT22, or cynomolgus monkey NUDT22. In some embodiments, the human NUDT22 comprises a sequence of SEQ ID NO: 4484.

Provided herein is an antibody that competes with an antibody or antigen binding fragment for binding to NUDT22, wherein the antibody binds to human NUDT22 or mouse NUDT22.

Provided herein is an antibody or an antigen binding fragment thereof that selectively binds to Jupiter microtubule associated homolog 2 (HN1L) or a variant thereof, comprising at least one of: a variable heavy chain region, wherein the variable heavy chain region comprises a complementarity-determining region heavy chain 1 (CDR-H1) of SEQ ID NO: 750, CDR-H2 of SEQ ID NO: 1292, and CDR-H3 of SEQ ID NO: 1834; and/or a variable light chain region, wherein the variable light chain region comprises a complementarity-determining region light chain 1 (CDR-L1) of SEQ ID NO: 1021, CDR-L2 of SEQ ID NO: 1563, and CDR-L3 of SEQ ID NO: 2105. In some embodiments, the variable heavy chain comprises a polypeptide consensus sequence having at least 95% sequence identity to the amino acid sequence of SEQ ID NO: 208, and
the variable light chain comprises a polypeptide consensus sequence having at least 95% sequence identity to the amino acid sequence of SEQ ID NO: 479. In some embodiments, the antibody or antigen binding fragment thereof binds a human HN1L, mouse HN1L, rat HN1L, bovine HN1L, or cynomolgus monkey HN1L. In some embodiments, the human HN1L comprises a sequence of SEQ ID NO: 4395.

Provided herein is an antibody that competes with an antibody or antigen binding fragment for binding to HN1L, wherein the antibody binds to human HN1L or mouse HN1L.

Provided herein is an antibody or an antigen binding fragment thereof that selectively binds to grancalcin, transcript variant 4 (GCA) or a variant thereof, comprising at least one of: a variable heavy chain region, wherein the variable heavy chain region comprises a complementarity-determining region heavy chain 1 (CDR-H1) of SEQ ID NO: 751, CDR-H2 of SEQ ID NO: 1293, and CDR-H3 of SEQ ID NO: 1835; and/or a variable light chain region, wherein the variable light chain region comprises a complementarity-determining region light chain 1 (CDR-L1) of SEQ ID NO: 1022, CDR-L2 of SEQ ID NO: 1564, and CDR-L3 of SEQ ID NO: 2106. In some embodiments, the variable heavy chain comprises a polypeptide consensus sequence having at least 95% sequence identity to the amino acid sequence of SEQ ID NO: 209, and the variable light chain comprises a polypeptide consensus sequence having at least 95% sequence identity to the amino acid sequence of SEQ ID NO: 480. In some embodiments, the antibody or antigen binding fragment thereof binds a human GCA, mouse GCA, rat GCA, bovine GCA, or cynomolgus monkey GCA. In some embodiments, the human GCA comprises a sequence of SEQ ID NO: 4485.

Provided herein is an antibody that competes with an antibody or antigen binding fragment for binding to GCA, wherein the antibody binds to human GCA or mouse GCA.

Provided herein is an antibody or an antigen binding fragment thereof that selectively binds to endoplasmic reticulum protein 27, transcript variant 1 (ERP27) or a variant thereof, comprising at least one of: a variable heavy chain region, wherein the variable heavy chain region comprises a complementarity-determining region heavy chain 1 (CDR-H1) of SEQ ID NO: 752, CDR-H2 of SEQ ID NO: 1294, and CDR-H3 of SEQ ID NO: 1836; and/or a variable light chain region, wherein the variable light chain region comprises a complementarity-determining region light chain 1 (CDR-L1) of SEQ ID NO: 1023, CDR-L2 of SEQ ID NO: 1565, and CDR-L3 of SEQ ID NO: 2107. In some embodiments, the variable heavy chain comprises a polypeptide consensus sequence having at least 95% sequence identity to the amino acid sequence of SEQ ID NO: 210, and the variable light chain comprises a polypeptide consensus sequence having at least 95% sequence identity to the amino acid sequence of SEQ ID NO: 481. In some embodiments, the antibody or antigen binding fragment thereof binds a human ERP27, mouse ERP27, rat ERP27, bovine ERP27, or cynomolgus monkey ERP27. In some embodiments, the human ERP27 comprises a sequence of SEQ ID NO: 4469.

Provided herein is an antibody that competes with an antibody or antigen binding fragment for binding to ERP27, wherein the antibody binds to human ERP27 or mouse ERP27.

Provided herein is an antibody or an antigen binding fragment thereof that selectively binds to Rna polymerase iii subunit g (POLR3G) or a variant thereof, comprising at least one of: a variable heavy chain region, wherein the variable heavy chain region comprises a complementarity-determining region heavy chain 1 (CDR-H1) of SEQ ID NO: 753, CDR-H2 of SEQ ID NO: 1295, and CDR-H3 of SEQ ID NO: 1837; and/or a variable light chain region, wherein the variable light chain region comprises a complementarity-determining region light chain 1 (CDR-L1) of SEQ ID NO: 1024, CDR-L2 of SEQ ID NO: 1566, and CDR-L3 of SEQ ID NO: 2108. In some embodiments, the variable heavy chain comprises a polypeptide consensus sequence having at least 95% sequence identity to the amino acid sequence of SEQ ID NO: 211, and the variable light chain comprises a polypeptide consensus sequence having at least 95% sequence identity to the amino acid sequence of SEQ ID NO: 482. In some embodiments, the antibody or antigen binding fragment thereof binds a human POLR3G, mouse POLR3G, rat POLR3G, bovine POLR3G, or cynomolgus monkey POLR3G. In some embodiments, the human POLR3G comprises a sequence of SEQ ID NO: 4486.

Provided herein is an antibody that competes with an antibody or antigen binding fragment for binding to POLR3G, wherein the antibody binds to human POLR3G or mouse POLR3G.

Provided herein is an antibody or an antigen binding fragment thereof that selectively binds to sorting nexin 1, transcript variant 1 (SNX1) or a variant thereof, comprising at least one of: a variable heavy chain region, wherein the variable heavy chain region comprises a complementarity-determining region heavy chain 1 (CDR-H1) of SEQ ID NO: 754, CDR-H2 of SEQ ID NO: 1296, and CDR-H3 of SEQ ID NO: 1838; and/or a variable light chain region, wherein the variable light chain region comprises a complementarity-determining region light chain 1 (CDR-L1) of SEQ ID NO: 1025, CDR-L2 of SEQ ID NO: 1567, and CDR-L3 of SEQ ID NO: 2109. In some embodiments, the variable heavy chain comprises a polypeptide consensus sequence having at least 95% sequence identity to the amino acid sequence of SEQ ID NO: 212, and the variable light chain comprises a polypeptide consensus sequence having at least 95% sequence identity to the amino acid sequence of SEQ ID NO: 483. In some embodiments, the antibody or antigen binding fragment thereof binds a human SNX1, mouse SNX1, rat SNX1, bovine SNX1, or cynomolgus monkey SNX1. In some embodiments, the human SNX1 comprises a sequence of SEQ ID NO: 4487.

Provided herein is an antibody that competes with an antibody or antigen binding fragment for binding to SNX1, wherein the antibody binds to human SNX1 or mouse SNX1.

Provided herein is an antibody or an antigen binding fragment thereof that selectively binds to SAA2-SAA3 (AB937783.1_frag) or a variant thereof, comprising at least one of: a variable heavy chain region, wherein the variable heavy chain region comprises a complementarity-determining region heavy chain 1 (CDR-H1) of SEQ ID NO: 755, CDR-H2 of SEQ ID NO: 1297, and CDR-H3 of SEQ ID NO: 1839; and/or a variable light chain region, wherein the variable light chain region comprises a complementarity-determining region light chain 1 (CDR-L1) of SEQ ID NO: 1026, CDR-L2 of SEQ ID NO: 1568, and CDR-L3 of SEQ ID NO: 2110. In some embodiments, the variable heavy chain comprises a polypeptide consensus sequence having at least 95% sequence identity to the amino acid sequence of SEQ ID NO: 213, and the variable light chain comprises a polypeptide consensus sequence having at least 95% sequence identity to the amino acid sequence of SEQ ID NO: 484. In some embodiments, the antibody or antigen binding fragment thereof binds a human AB937783.1_frag, mouse AB937783.1_frag, rat AB937783.1_frag, bovine AB937783.1_frag, or cynomolgus monkey AB937783.1_frag. In some embodiments, the human AB937783.1_frag comprises a sequence of SEQ ID NO: 4488.

Provided herein is an antibody that competes with an antibody or antigen binding fragment for binding to AB937783.1_frag, wherein the antibody binds to human AB937783.1_frag or mouse AB937783.1_frag.

Provided herein is an antibody or an antigen binding fragment thereof that selectively binds to proteasome 26S subunit, non-ATPase 3 (PSMD3) or a variant thereof, comprising at least one of: a variable heavy chain region, wherein the variable heavy chain region comprises a complementarity-determining region heavy chain 1 (CDR-H1) of SEQ ID NO: 755, CDR-H2 of SEQ ID NO: 1297, and CDR-H3 of SEQ ID NO: 1839; and/or a variable light chain region, wherein the variable light chain region comprises a complementarity-determining region light chain 1 (CDR-L1) of SEQ ID NO: 1026, CDR-L2 of SEQ ID NO: 1568, and CDR-L3 of SEQ ID NO: 2110. In some embodiments, the variable heavy chain comprises a polypeptide consensus sequence having at least 95% sequence identity to the amino acid sequence of SEQ ID NO: 213, and the variable light chain comprises a polypeptide consensus sequence having at least 95% sequence identity to the amino acid sequence of SEQ ID NO: 484. In some embodiments, the antibody or antigen binding fragment thereof binds a human PSMD3, mouse PSMD3, rat PSMD3, bovine PSMD3, or cynomolgus monkey PSMD3. In some embodiments, the human PSMD3 comprises a sequence of SEQ ID NO: 4489.

Provided herein is an antibody that competes with an antibody or antigen binding fragment for binding to PSMD3, wherein the antibody binds to human PSMD3 or mouse PSMD3.

Provided herein is an antibody or an antigen binding fragment thereof that selectively binds to CRK like proto-oncogene, adaptor protein, transcript variant 1 (CRKL) or a variant thereof, comprising at least one of: a variable heavy chain region, wherein the variable heavy chain region comprises a complementarity-determining region heavy chain 1 (CDR-H1) of SEQ ID NO: 756, CDR-H2 of SEQ ID NO: 1298, and CDR-H3 of SEQ ID NO: 1840; and/or a variable light chain region, wherein the variable light chain region comprises a complementarity-determining region light chain 1 (CDR-L1) of SEQ ID NO: 1027, CDR-L2 of SEQ ID NO: 1569, and CDR-L3 of SEQ ID NO: 2111. In some embodiments, the variable heavy chain comprises a polypeptide consensus sequence having at least 95% sequence identity to the amino acid sequence of SEQ ID NO: 214, and the variable light chain comprises a polypeptide consensus sequence having at least 95% sequence identity to the amino acid sequence of SEQ ID NO: 485. In some embodiments, wherein the antibody or antigen binding fragment thereof binds a human CRKL, mouse CRKL, rat CRKL, bovine CRKL, or cynomolgus monkey CRKL. In some embodiments, the human CRKL comprises a sequence of SEQ ID NO: 4490.

Provided herein is an antibody that competes with an antibody or antigen binding fragment for binding to CRKL, wherein the antibody binds to human CRKL or mouse CRKL.

Provided herein is an antibody or an antigen binding fragment thereof that selectively binds to F-box protein 2 (FBXO2) or a variant thereof, comprising at least one of: a variable heavy chain region, wherein the variable heavy chain region comprises a complementarity-determining region heavy chain 1 (CDR-H1) of SEQ ID NO: 757, CDR-H2 of SEQ ID NO: 1299, and CDR-H3 of SEQ ID NO: 1841; and/or a variable light chain region, wherein the variable light chain region comprises a complementarity-determining region light chain 1 (CDR-L1) of SEQ ID NO: 1028, CDR-L2 of SEQ ID NO: 1570, and CDR-L3 of SEQ ID NO: 2112. In some embodiments, the variable heavy chain comprises a polypeptide consensus sequence having at least 95% sequence identity to the amino acid sequence of SEQ ID NO: 215, and the variable light chain comprises a polypeptide consensus sequence having at least 95% sequence identity to the amino acid sequence of SEQ ID NO: 486. In some embodiments, the antibody or antigen binding fragment thereof binds a human FBXO2, mouse FBXO2, rat FBXO2, bovine FBXO2, or cynomolgus monkey FBXO2. In some embodiments, the human FBXO2 comprises a sequence of SEQ ID NO: 4491.

Provided herein is an antibody that competes with an antibody or antigen binding fragment for binding to FBXO2, wherein the antibody binds to human FBXO2 or mouse FBXO2.

Provided herein is an antibody or an antigen binding fragment thereof that selectively binds to tubulin gamma 1 (TUBG1) or a variant thereof, comprising at least one of: a variable heavy chain region, wherein the variable heavy chain region comprises a complementarity-determining region heavy chain 1 (CDR-H1) of SEQ ID NO: 757, CDR-H2 of SEQ ID NO: 1299, and CDR-H3 of SEQ ID NO: 1841; and/or a variable light chain region, wherein the variable light chain region comprises a complementarity-determining region light chain 1 (CDR-L1) of SEQ ID NO: 1028, CDR-L2 of SEQ ID NO: 1570, and CDR-L3 of SEQ ID NO: 2112. In some embodiments, the variable heavy chain comprises a polypeptide consensus sequence having at least 95% sequence identity to the amino acid sequence of SEQ ID NO: 215, and the variable light chain comprises a polypeptide consensus sequence having at least 95% sequence identity to the amino acid sequence of SEQ ID NO: 486. In some embodiments, the antibody or antigen binding fragment thereof binds a human TUBG1, mouse TUBG1, rat TUBG1, bovine TUBG1, or cynomolgus monkey TUBG1. In some embodiments, the human TUBG1 comprises a sequence of SEQ ID NO: 4492.

Provided herein is an antibody that competes with an antibody or antigen binding fragment for binding to TUBG1, wherein the antibody binds to human TUBG1 or mouse TUBG1.

Provided herein is an antibody or an antigen binding fragment thereof that selectively binds to oxidation resistance 1, transcript variant 1 (OXR1) or a variant thereof, comprising at least one of: a variable heavy chain region, wherein the variable heavy chain region comprises a complementarity-determining region heavy chain 1 (CDR-H1) of SEQ ID NO: 759, CDR-H2 of SEQ ID NO: 1301, and CDR-H3 of SEQ ID NO: 1843; and/or a variable light chain region, wherein the variable light chain region comprises a complementarity-determining region light chain 1 (CDR-L1) of SEQ ID NO: 1030, CDR-L2 of SEQ ID NO: 1572, and CDR-L3 of SEQ ID NO: 2114. In some embodiments, the variable heavy chain comprises a polypeptide consensus sequence having at least 95% sequence identity to the amino acid sequence of SEQ ID NO: 217, and the variable light chain comprises a polypeptide consensus sequence having at least 95% sequence identity to the amino acid sequence of SEQ ID NO: 488. In some embodiments, the antibody or antigen binding fragment thereof binds a human OXR1, mouse OXR1, rat OXR1, bovine OXR1, or cynomolgus monkey OXR1. In some embodiments, wherein the human OXR1 comprises a sequence of SEQ ID NO: 4493.

Provided herein is an antibody that competes with an antibody or antigen binding fragment for binding to OXR1, wherein the antibody binds to human OXR1 or mouse OXR1.

Provided herein is an antibody or an antigen binding fragment thereof that selectively binds to Ankyrin repeat domain 20 family member a5, pseudogene (ANKRD20A5P) or a variant thereof, comprising at least one of: a variable heavy chain region, wherein the variable heavy chain region comprises a complementarity-determining region heavy chain 1 (CDR-H1) of SEQ ID NO: 760, CDR-H2 of SEQ ID NO: 1302, and CDR-H3 of SEQ ID NO: 1844; and/or a variable light chain region, wherein the variable light chain region comprises a complementarity-determining region light chain 1 (CDR-L1) of SEQ ID NO: 1031, CDR-L2 of SEQ ID NO: 1573, and CDR-L3 of SEQ ID NO: 2115. In some embodiments, the variable heavy chain comprises a polypeptide consensus sequence having at least 95% sequence identity to the amino acid sequence of SEQ ID NO: 218, and the variable light chain comprises a polypeptide consensus sequence having at least 95% sequence identity to the amino acid sequence of SEQ ID NO: 489. In some embodiments, the antibody or antigen binding fragment thereof binds a human ANKRD20A5P, mouse ANKRD20A5P, rat ANKRD20A5P, bovine ANKRD20A5P, or cynomolgus monkey ANKRD20A5P. In some embodiments, the human ANKRD20A5P comprises a sequence of SEQ ID NO: 4494.

Provided herein is an antibody that competes with an antibody or antigen binding fragment for binding to ANKRD20A5P, wherein the antibody binds to human ANKRD20A5P or mouse ANKRD20A5P.

Provided herein is an antibody or an antigen binding fragment thereof that selectively binds to Kirre like nephrin family adhesion molecule 1 (KIRREL) or a variant thereof, comprising at least one of: a variable heavy chain region, wherein the variable heavy chain region comprises a complementarity-determining region heavy chain 1 (CDR-H1) of SEQ ID NO: 760, CDR-H2 of SEQ ID NO: 1302, and CDR-H3 of SEQ ID NO: 1844; and/or a variable light chain region, wherein the variable light chain region comprises a complementarity-determining region light chain 1 (CDR-L1) of SEQ ID NO: 1031, CDR-L2 of SEQ ID NO: 1573, and CDR-L3 of SEQ ID NO: 2115. In some embodiments, the variable heavy chain comprises a polypeptide consensus sequence having at least 95% sequence identity to the amino acid sequence of SEQ ID NO: 218, and the variable light chain comprises a polypeptide consensus sequence having at least 95% sequence identity to the amino acid sequence of SEQ ID NO: 489. In some embodiments, the antibody or antigen binding fragment thereof binds a human KIRREL, mouse KIRREL, rat KIRREL, bovine KIRREL, or cynomolgus monkey KIRREL. In some embodiments, the human KIRREL comprises a sequence of SEQ ID NO: 4495.

Provided herein is an antibody that competes with an antibody or antigen binding fragment for binding to KIR-REL, wherein the antibody binds to human KIRREL or mouse KIRREL.

Provided herein is an antibody or an antigen binding fragment thereof that selectively binds to GRB10 interacting GYF protein 1, transcript variant X10 (GIGYF1) or a variant thereof, comprising at least one of: a variable heavy chain region, wherein the variable heavy chain region comprises a complementarity-determining region heavy chain 1 (CDR-H1) of SEQ ID NO: 760, CDR-H2 of SEQ ID NO: 1302, and CDR-H3 of SEQ ID NO: 1844; and/or a variable light chain region, wherein the variable light chain region comprises a complementarity-determining region light chain 1 (CDR-L1) of SEQ ID NO: 1031, CDR-L2 of SEQ ID NO: 1573, and CDR-L3 of SEQ ID NO: 2115. In some embodiments, the variable heavy chain comprises a polypeptide consensus sequence having at least 95% sequence identity to the amino acid sequence of SEQ ID NO: 218, and the variable light chain comprises a polypeptide consensus sequence having at least 95% sequence identity to the amino acid sequence of SEQ ID NO: 489. In some embodiments, the antibody or antigen binding fragment thereof binds a human GIGYF1, mouse GIGYF1, rat GIGYF1, bovine GIGYF1, or cynomolgus monkey GIGYF1. In some embodiments, the human GIGYF1 comprises a sequence of SEQ ID NO: 4496.

Provided herein is an antibody that competes with an antibody or antigen binding fragment for binding to GIGYF1, wherein the antibody binds to human GIGYF1 or mouse GIGYF1.

Provided herein is an antibody or an antigen binding fragment thereof that selectively binds to defensin alpha 3 (DEFA3) or a variant thereof, comprising at least one of: a variable heavy chain region, wherein the variable heavy chain region comprises a complementarity-determining region heavy chain 1 (CDR-H1) of SEQ ID NO: 761, CDR-H2 of SEQ ID NO: 1303, and CDR-H3 of SEQ ID NO: 1845; and/or a variable light chain region, wherein the variable light chain region comprises a complementarity-determining region light chain 1 (CDR-L1) of SEQ ID NO: 1032, CDR-L2 of SEQ ID NO: 1574, and CDR-L3 of SEQ ID NO: 2116. In some embodiments, the variable heavy chain comprises a polypeptide consensus sequence having at least 95% sequence identity to the amino acid sequence of SEQ ID NO: 219, and the variable light chain comprises a polypeptide consensus sequence having at least 95% sequence identity to the amino acid sequence of SEQ ID NO: 490. In some embodiments, the antibody or antigen binding fragment thereof binds a human DEFA3, mouse DEFA3, rat DEFA3, bovine DEFA3, or cynomolgus monkey DEFA3. In some embodiments, the human DEFA3 comprises a sequence of SEQ ID NO: 4497.

Provided herein is an antibody that competes with an antibody or antigen binding fragment for binding to DEFA3, wherein the antibody binds to human DEFA3 or mouse DEFA3.

Provided herein is an antibody or an antigen binding fragment thereof that selectively binds to radial spoke head 14 homolog (RSPH14) or a variant thereof, comprising at least one of: a variable heavy chain region, wherein the variable heavy chain region comprises a complementarity-determining region heavy chain 1 (CDR-H1) of SEQ ID NO: 762, CDR-H2 of SEQ ID NO: 1304, and CDR-H3 of SEQ ID NO: 1846; and/or a variable light chain region, wherein the variable light chain region comprises a complementarity-determining region light chain 1 (CDR-L1) of SEQ ID NO: 1033, CDR-L2 of SEQ ID NO: 1575, and CDR-L3 of SEQ ID NO: 2117. In some embodiments, the variable heavy chain comprises a polypeptide consensus sequence having at least 95% sequence identity to the amino acid sequence of SEQ ID NO: 220, and the variable light chain comprises a polypeptide consensus sequence having at least 95% sequence identity to the amino acid sequence of SEQ ID NO: 491. In some embodiments, the antibody or antigen binding fragment thereof binds a human RSPH14, mouse RSPH14, rat RSPH14, bovine RSPH14, or cynomolgus monkey RSPH14. In some embodiments, the human RSPH14 comprises a sequence of SEQ ID NO: 4498.

Provided herein is an antibody that competes with an antibody or antigen binding fragment for binding to RSPH14, wherein the antibody binds to human RSPH14 or mouse RSPH14.

Provided herein is an antibody or an antigen binding fragment thereof that selectively binds to C-C motif chemokine ligand 2 (CCL2) or a variant thereof, comprising at least one of: a variable heavy chain region, wherein the variable heavy chain region comprises a complementarity-determining region heavy chain 1 (CDR-H1) of SEQ ID NO: 763, CDR-H2 of SEQ ID NO: 1305, and CDR-H3 of SEQ ID NO: 1847; and/or a variable light chain region, wherein the variable light chain region comprises a complementarity-determining region light chain 1 (CDR-L1) of SEQ ID NO: 1034, CDR-L2 of SEQ ID NO: 1576, and CDR-L3 of SEQ ID NO: 2118. In some embodiments, the variable heavy chain comprises a polypeptide consensus sequence having at least 95% sequence identity to the amino acid sequence of SEQ ID NO: 221, and the variable light chain comprises a polypeptide consensus sequence having at least 95% sequence identity to the amino acid sequence of SEQ ID NO: 492. In some embodiments, the antibody or antigen binding fragment thereof binds a human CCL2, mouse CCL2, rat CCL2, bovine CCL2, or cynomolgus monkey CCL2. In some embodiments, the human CCL2 comprises a sequence of SEQ ID NO: 4499.

Provided herein is an antibody that competes with an antibody or antigen binding fragment for binding to CCL2, wherein the antibody binds to human CCL2 or mouse CCL2.

Provided herein is an antibody or an antigen binding fragment thereof that selectively binds to killer cell lectin like receptor C1, transcript variant 3 (KLRC1) or a variant thereof, comprising at least one of: a variable heavy chain region, wherein the variable heavy chain region comprises a complementarity-determining region heavy chain 1 (CDR-H1) of SEQ ID NO: 764, CDR-H2 of SEQ ID NO: 1306, and CDR-H3 of SEQ ID NO: 1848; and/or a variable light chain region, wherein the variable light chain region comprises a complementarity-determining region light chain 1 (CDR-L1) of SEQ ID NO: 1035, CDR-L2 of SEQ ID NO: 1577, and CDR-L3 of SEQ ID NO: 2119. In some embodiments, the variable heavy chain comprises a polypeptide consensus sequence having at least 95% sequence identity to the amino acid sequence of SEQ ID NO: 222, and the variable light chain comprises a polypeptide consensus sequence having at least 95% sequence identity to the amino acid sequence of SEQ ID NO: 493. In some embodiments, the antibody or antigen binding fragment thereof binds a human KLRC1, mouse KLRC1, rat KLRC1, bovine KLRC1, or cynomolgus monkey KLRC1. In some embodiments, the human KLRC1 comprises a sequence of SEQ ID NO: 4500.

Provided herein is an antibody that competes with an antibody or antigen binding fragment for binding to KLRC1, wherein the antibody binds to human KLRC1 or mouse KLRC1.

Provided herein is an antibody that competes with an antibody or antigen binding fragment of kelch like family member 12, transcript variant 2 (KLHL12) or a variant thereof, comprising at least one of: a variable heavy chain region, wherein the variable heavy chain region comprises a complementarity-determining region heavy chain 1 (CDR-H1) of SEQ ID NO: 764, CDR-H2 of SEQ ID NO: 1306, and CDR-H3 of SEQ ID NO: 1848; and/or a variable light chain region, wherein the variable light chain region comprises a complementarity-determining region light chain 1 (CDR-L1) of SEQ ID NO: 1035, CDR-L2 of SEQ ID NO: 1577, and CDR-L3 of SEQ ID NO: 2119. In some embodiments, the variable heavy chain comprises a polypeptide consensus sequence having at least 95% sequence identity to the amino acid sequence of SEQ ID NO: 222, and the variable light chain comprises a polypeptide consensus sequence having at least 95% sequence identity to the amino acid sequence of SEQ ID NO: 493. In some embodiments, the antibody or antigen binding fragment thereof binds a human KLHL12, mouse KLHL12, rat KLHL12, bovine KLHL12, or cynomolgus monkey KLHL12. In some embodiments, the human KLHL12 comprises a sequence of SEQ ID NO: 4501.

Provided herein is an antibody that competes with an antibody or antigen binding fragment for binding to KLHL12, wherein the antibody binds to human KLHL12 or mouse KLHL12.

Provided herein is an antibody or an antigen binding fragment thereof that selectively binds to neural retina leucine zipper, transcript variant X4 (NRL) or a variant thereof, comprising at least one of: a variable heavy chain region, wherein the variable heavy chain region comprises a complementarity-determining region heavy chain 1 (CDR-H1) of SEQ ID NO: 765, CDR-H2 of SEQ ID NO: 1307, and CDR-H3 of SEQ ID NO: 1849; and/or a variable light chain region, wherein the variable light chain region comprises a complementarity-determining region light chain 1 (CDR-L1) of SEQ ID NO: 1036, CDR-L2 of SEQ ID NO: 1578, and CDR-L3 of SEQ ID NO: 2120. In some embodiments, the variable heavy chain comprises a polypeptide consensus sequence having at least 95% sequence identity to the amino acid sequence of SEQ ID NO: 223, and the variable light chain comprises a polypeptide consensus sequence having at least 95% sequence identity to the amino acid sequence of SEQ ID NO: 494. In some embodiments, the antibody or antigen binding fragment thereof binds a human NRL, mouse NRL, rat NRL, bovine NRL, or cynomolgus monkey NRL. In some embodiments, the human NRL comprises a sequence of SEQ ID NO: 4502.

Provided herein is an antibody that competes with an antibody or antigen binding fragment for binding to NRL, wherein the antibody binds to human NRL or mouse NRL.

Provided herein is an antibody or an antigen binding fragment thereof that selectively binds to phospholipase C delta 4 (PLCD4) or a variant thereof, comprising at least one of: a variable heavy chain region, wherein the variable heavy chain region comprises a complementarity-determining region heavy chain 1 (CDR-H1) of SEQ ID NO: 766, CDR-H2 of SEQ ID NO: 1308, and CDR-H3 of SEQ ID NO: 1850; and/or a variable light chain region, wherein the variable light chain region comprises a complementarity-determining region light chain 1 (CDR-L1) of SEQ ID NO: 1037, CDR-L2 of SEQ ID NO: 1579, and CDR-L3 of SEQ ID NO: 2121. In some embodiments, the variable heavy chain comprises a polypeptide consensus sequence having at least 95% sequence identity to the amino acid sequence of SEQ ID NO: 224, and the variable light chain comprises a polypeptide consensus sequence having at least 95% sequence identity to the amino acid sequence of SEQ ID NO: 495. In some embodiments, the antibody or antigen binding fragment thereof binds a human PLCD4, mouse PLCD4, rat PLCD4, bovine PLCD4, or cynomolgus monkey PLCD4. In some embodiments, the human PLCD4 comprises a sequence of SEQ ID NO: 4503.

Provided herein is an antibody that competes with an antibody or antigen binding fragment for binding to PLCD4, wherein the antibody binds to human PLCD4 or mouse PLCD4.

Provided herein is an antibody or an antigen binding fragment thereof that selectively binds to coiled-coil domain containing 74B, transcript variant 2 (CCDC74B) or a variant thereof, comprising at least one of: a variable heavy chain region, wherein the variable heavy chain region comprises a complementarity-determining region heavy chain 1 (CDR-H1) of SEQ ID NO: 767, CDR-H2 of SEQ ID NO: 1309, and CDR-H3 of SEQ ID NO: 1851; and/or a variable light chain region, wherein the variable light chain region comprises a complementarity-determining region light chain 1 (CDR-L1) of SEQ ID NO: 1038, CDR-L2 of SEQ ID NO: 1580, and CDR-L3 of SEQ ID NO: 2122. In some embodiments, the variable heavy chain comprises a polypeptide consensus sequence having at least 95% sequence identity to the amino acid sequence of SEQ ID NO: 225, and the variable light chain comprises a polypeptide consensus sequence having at least 95% sequence identity to the amino acid sequence of SEQ ID NO: 496. In some embodiments, the antibody or antigen binding fragment thereof binds a human CCDC74B, mouse CCDC74B, rat CCDC74B, bovine CCDC74B, or cynomolgus monkey CCDC74B. In some embodiments, the human CCDC74B comprises a sequence of SEQ ID NO: 4504.

Provided herein is an antibody that competes with an antibody or antigen binding fragment for binding to CCDC74B, wherein the antibody binds to human CCDC74B or mouse CCDC74B.

Provided herein is an antibody or an antigen binding fragment thereof that selectively binds to DEAD-box helicase 53 (DDX53) or a variant thereof, comprising at least one of: a variable heavy chain region, wherein the variable heavy chain region comprises a complementarity-determining region heavy chain 1 (CDR-H1) of SEQ ID NO: 768, CDR-H2 of SEQ ID NO: 1310, and CDR-H3 of SEQ ID NO: 1852; and/or a variable light chain region, wherein the variable light chain region comprises a complementarity-determining region light chain 1 (CDR-L1) of SEQ ID NO: 1039, CDR-L2 of SEQ ID NO: 1581, and CDR-L3 of SEQ ID NO: 2123. In some embodiments, the variable heavy chain comprises a polypeptide consensus sequence having at least 95% sequence identity to the amino acid sequence of SEQ ID NO: 226, and the variable light chain comprises a polypeptide consensus sequence having at least 95% sequence identity to the amino acid sequence of SEQ ID NO: 497. In some embodiments, the antibody or antigen binding fragment thereof binds a human DDX53, mouse DDX53, rat DDX53, bovine DDX53, or cynomolgus monkey DDX53. In some embodiments, the human DDX53 comprises a sequence of SEQ ID NO: 4477.

Provided herein is an antibody that competes with an antibody or antigen binding fragment for binding to DDX53, wherein the antibody binds to human DDX53 or mouse DDX53.

Provided herein is an antibody or an antigen binding fragment thereof that selectively binds to HSPA (Hsp70) binding protein 1, transcript variant 2 (HSPBP1) or a variant thereof, comprising at least one of: a variable heavy chain region, wherein the variable heavy chain region comprises a complementarity-determining region heavy chain 1 (CDR-H1) of SEQ ID NO: 769, CDR-H2 of SEQ ID NO: 1311, and CDR-H3 of SEQ ID NO: 1853; and/or a variable light chain region, wherein the variable light chain region comprises a complementarity-determining region light chain 1 (CDR-L1) of SEQ ID NO: 1040, CDR-L2 of SEQ ID NO: 1582, and CDR-L3 of SEQ ID NO: 2124. In some embodiments, the variable heavy chain comprises a polypeptide consensus sequence having at least 95% sequence identity to the amino acid sequence of SEQ ID NO: 227, and the variable light chain comprises a polypeptide consensus sequence having at least 95% sequence identity to the amino acid sequence of SEQ ID NO: 498. In some embodiments, the antibody or antigen binding fragment thereof binds a human HSPBP1, mouse HSPBP1, rat HSPBP1, bovine HSPBP1, or cynomolgus monkey HSPBP1. In some embodiments, the human HSPBP1 comprises a sequence of SEQ ID NO: 4505.

Provided herein is an antibody that competes with an antibody or antigen binding fragment for binding to HSPBP1, wherein the antibody binds to human HSPBP1 or mouse HSPBP1.

Provided herein is an antibody or an antigen binding fragment thereof that selectively binds to heat shock protein family A (Hsp70) member 2 (HSPA2) or a variant thereof, comprising at least one of: a variable heavy chain region, wherein the variable heavy chain region comprises a complementarity-determining region heavy chain 1 (CDR-H1) of SEQ ID NO: 769, CDR-H2 of SEQ ID NO: 1311, and CDR-H3 of SEQ ID NO: 1853; and/or a variable light chain region, wherein the variable light chain region comprises a complementarity-determining region light chain 1 (CDR-L1) of SEQ ID NO: 1040, CDR-L2 of SEQ ID NO: 1582, and CDR-L3 of SEQ ID NO: 2124. In some embodiments, the variable heavy chain comprises a polypeptide consensus sequence having at least 95% sequence identity to the amino acid sequence of SEQ ID NO: 227, and the variable light chain comprises a polypeptide consensus sequence having at least 95% sequence identity to the amino acid sequence of SEQ ID NO: 498. In some embodiments, the antibody or antigen binding fragment thereof binds a human HSPA2, mouse HSPA2, rat HSPA2, bovine HSPA2, or cynomolgus monkey HSPA2. In some embodiments, the human HSPA2 comprises a sequence of SEQ ID NO: 4506.

Provided herein is an antibody that competes with an antibody or antigen binding fragment for binding to HSPA2, wherein the antibody binds to human HSPA2 or mouse HSPA2.

Provided herein is an antibody or an antigen binding fragment thereof that selectively binds to BCL2 associated athanogene 2 (BAG2) or a variant thereof, comprising at least one of: a variable heavy chain region, wherein the variable heavy chain region comprises a complementarity-determining region heavy chain 1 (CDR-H1) of SEQ ID NO: 769, CDR-H2 of SEQ ID NO: 1311, and CDR-H3 of SEQ ID NO: 1853; and/or a variable light chain region, wherein the variable light chain region comprises a complementarity-determining region light chain 1 (CDR-L1) of SEQ ID NO: 1040, CDR-L2 of SEQ ID NO: 1582, and CDR-L3 of SEQ ID NO: 2124. In some embodiments, the variable heavy chain comprises a polypeptide consensus sequence having at least 95% sequence identity to the amino acid sequence of SEQ ID NO: 227, and the variable light chain comprises a polypeptide consensus sequence having at least 95% sequence identity to the amino acid sequence of SEQ ID NO: 498. In some embodiments, the antibody or antigen binding fragment thereof binds a human BAG2, mouse BAG2, rat BAG2, bovine BAG2, or cynomolgus monkey BAG2. In some embodiments, the human BAG2 comprises a sequence of SEQ ID NO: 4507.

Provided herein is an antibody that competes with an antibody or antigen binding fragment for binding to BAG2, wherein the antibody binds to human BAG2 or mouse BAG2.

Provided herein is an antibody or an antigen binding fragment thereof that selectively binds to C-X-C motif chemokine receptor 4, transcript variant 2 (CXCR4) or a variant thereof, comprising at least one of: a variable heavy chain region, wherein the variable heavy chain region comprises a complementarity-determining region heavy chain 1 (CDR-H1) of SEQ ID NO: 770, CDR-H2 of SEQ ID NO: 1312, and CDR-H3 of SEQ ID NO: 1854; and/or a variable light chain region, wherein the variable light chain region comprises a complementarity-determining region light chain 1 (CDR-L1) of SEQ ID NO: 1041, CDR-L2 of SEQ ID NO: 1583, and CDR-L3 of SEQ ID NO: 2125. In some embodiments, the variable heavy chain comprises a polypeptide consensus sequence having at least 95% sequence identity to the amino acid sequence of SEQ ID NO: 228, and the variable light chain comprises a polypeptide consensus sequence having at least 95% sequence identity to the amino acid sequence of SEQ ID NO: 499. In some embodiments, the antibody or antigen binding fragment thereof binds a human CXCR4, mouse CXCR4, rat CXCR4, bovine CXCR4, or cynomolgus monkey CXCR4. In some embodiments, the human CXCR4 comprises a sequence of SEQ ID NO: 4508.

Provided herein is an antibody that competes with an antibody or antigen binding fragment for binding to CXCR4, wherein the antibody binds to human CXCR4 or mouse CXCR4.

Provided herein is an antibody or an antigen binding fragment thereof that selectively binds to Long intergenic non-protein coding rna 242 (LINC00242) or a variant thereof, comprising at least one of: a variable heavy chain region, wherein the variable heavy chain region comprises a complementarity-determining region heavy chain 1 (CDR-H1) of SEQ ID NO: 770, CDR-H2 of SEQ ID NO: 1312, and CDR-H3 of SEQ ID NO: 1854; and/or a variable light chain region, wherein the variable light chain region comprises a complementarity-determining region light chain 1 (CDR-L1) of SEQ ID NO: 1041, CDR-L2 of SEQ ID NO: 1583, and CDR-L3 of SEQ ID NO: 2125. In some embodiments, the variable heavy chain comprises a polypeptide consensus sequence having at least 95% sequence identity to the amino acid sequence of SEQ ID NO: 228, and the variable light chain comprises a polypeptide consensus sequence having at least 95% sequence identity to the amino acid sequence of SEQ ID NO: 499. In some embodiments, the antibody or antigen binding fragment thereof binds a human LINC00242, mouse LINC00242, rat LINC00242, bovine LINC00242, or cynomolgus monkey LINC00242. In some embodiments, the human LINC00242 comprises a sequence of SEQ ID NO: 4509.

Provided herein is an antibody that competes with an antibody or antigen binding fragment for binding to LINC00242, wherein the antibody binds to human LINC00242 or mouse LINC00242.

Provided herein is an antibody or an antigen binding fragment thereof that selectively binds to signal transducer and activator of transcription 5A, transcript variant 2 (STAT5A) or a variant thereof, comprising at least one of: a variable heavy chain region, wherein the variable heavy chain region comprises a complementarity-determining region heavy chain 1 (CDR-H1) of SEQ ID NO: 771, CDR-H2 of SEQ ID NO: 1313, and CDR-H3 of SEQ ID NO: 1855; and/or a variable light chain region, wherein the variable light chain region comprises a complementarity-determining region light chain 1 (CDR-L1) of SEQ ID NO: 1042, CDR-L2 of SEQ ID NO: 1584, and CDR-L3 of SEQ ID NO: 2126. In some embodiments, the variable heavy chain comprises a polypeptide consensus sequence having at least 95% sequence identity to the amino acid sequence of SEQ ID NO: 229, and the variable light chain comprises a polypeptide consensus sequence having at least 95% sequence identity to the amino acid sequence of SEQ ID NO: 500. In some embodiments, the antibody or antigen binding fragment thereof binds a human STAT5A, mouse STAT5A, rat STAT5A, bovine STAT5A, or cynomolgus monkey STAT5A. In some embodiments, the human STAT5A comprises a sequence of SEQ ID NO: 4510.

Provided herein is an antibody that competes with an antibody or antigen binding fragment for binding to STAT5A, wherein the antibody binds to human STAT5A or mouse STAT5A.

Provided herein is an antibody or an antigen binding fragment thereof that selectively binds to quinoid dihydropteridine reductase, transcript variant 1 (QDPR) or a variant thereof, comprising at least one of: a variable heavy chain region, wherein the variable heavy chain region comprises a complementarity-determining region heavy chain 1 (CDR-H1) of SEQ ID NO: 771, CDR-H2 of SEQ ID NO: 1313, and CDR-H3 of SEQ ID NO: 1855; and/or a variable light chain region, wherein the variable light chain region comprises a complementarity-determining region light chain 1 (CDR-L1) of SEQ ID NO: 1042, CDR-L2 of SEQ ID NO: 1584, and CDR-L3 of SEQ ID NO: 2126. In some embodiments, the variable heavy chain comprises a polypeptide consensus sequence having at least 95% sequence identity to the amino acid sequence of SEQ ID NO: 229, and the variable light chain comprises a polypeptide consensus sequence having at least 95% sequence identity to the amino acid sequence of SEQ ID NO: 500. In some embodiments, the antibody or antigen binding fragment thereof binds a human QDPR, mouse QDPR, rat QDPR, bovine QDPR, or cynomolgus monkey QDPR. In some embodiments, the human QDPR comprises a sequence of SEQ ID NO: 4438.

Provided herein is an antibody that competes with an antibody or antigen binding fragment for binding to QDPR, wherein the antibody binds to human QDPR or mouse QDPR.

Provided herein is an antibody or an antigen binding fragment thereof that selectively binds to calcium and integrin binding 1, transcript variant b (CIB1) or a variant thereof, comprising at least one of: a variable heavy chain region, wherein the variable heavy chain region comprises a complementarity-determining region heavy chain 1 (CDR-H1) of SEQ ID NO: 773, CDR-H2 of SEQ ID NO: 1315, and CDR-H3 of SEQ ID NO: 1857; and/or a variable light chain region, wherein the variable light chain region comprises a complementarity-determining region light chain 1 (CDR-L1) of SEQ ID NO: 1044, CDR-L2 of SEQ ID NO: 1586, and CDR-L3 of SEQ ID NO: 2128. In some embodiments, the variable heavy chain comprises a polypeptide consensus sequence having at least 95% sequence identity to the amino acid sequence of SEQ ID NO: 231, and the variable light chain comprises a polypeptide consensus sequence having at least 95% sequence identity to the amino acid sequence of SEQ ID NO: 502. In some embodiments, the antibody or antigen binding fragment thereof binds a human CIB1, mouse CIB1, rat CIB1, bovine CIB1, or cynomolgus monkey CIB1. In some embodiments, the human CIB1 comprises a sequence of SEQ ID NO: 4511.

Provided herein is an antibody that competes with an antibody or antigen binding fragment for binding to CIB1, wherein the antibody binds to human CIB1 or mouse CIB1.

Provided herein is an antibody or an antigen binding fragment thereof that selectively binds to t-SNARE domain containing 1, transcript variant 1 (TSNARE1) or a variant thereof, comprising at least one of: a variable heavy chain region, wherein the variable heavy chain region comprises a complementarity-determining region heavy chain 1 (CDR-H1) of SEQ ID NO: 773, CDR-H2 of SEQ ID NO: 1315, and CDR-H3 of SEQ ID NO: 1857; and/or a variable light chain region, wherein the variable light chain region comprises a complementarity-determining region light chain 1 (CDR-L1) of SEQ ID NO: 1044, CDR-L2 of SEQ ID NO: 1586, and CDR-L3 of SEQ ID NO: 2128. In some embodiments, the variable heavy chain comprises a polypeptide consensus sequence having at least 95% sequence identity to the amino acid sequence of SEQ ID NO: 231, and the variable light chain comprises a polypeptide consensus sequence having at least 95% sequence identity to the amino acid sequence of SEQ ID NO: 502. In some embodiments, the antibody or antigen binding fragment thereof binds a human TSNARE1, mouse TSNARE1, rat TSNARE1, bovine TSNARE1, or cynomolgus monkey TSNARE1. In some embodiments, the human TSNARE1 comprises a sequence of SEQ ID NO: 4512.

Provided herein is an antibody that competes with an antibody or antigen binding fragment for binding to TSNARE1, wherein the antibody binds to human TSNARE1 or mouse TSNARE1.

Provided herein is an antibody or an antigen binding fragment thereof that selectively binds to HAUS augmin like complex subunit 1, transcript variant 1 (HAUS1) or a variant thereof, comprising at least one of: a variable heavy chain region, wherein the variable heavy chain region comprises a complementarity-determining region heavy chain 1 (CDR-H1) of SEQ ID NO: 774, CDR-H2 of SEQ ID NO: 1316, and CDR-H3 of SEQ ID NO: 1858; and/or a variable light chain region, wherein the variable light chain region comprises a complementarity-determining region light chain 1 (CDR-L1) of SEQ ID NO: 1045, CDR-L2 of SEQ ID NO: 1587, and CDR-L3 of SEQ ID NO: 2129. In some embodiments, the variable heavy chain comprises a polypeptide consensus sequence having at least 95% sequence identity to the amino acid sequence of SEQ ID NO: 232, and the variable light chain comprises a polypeptide consensus sequence having at least 95% sequence identity to the amino acid sequence of SEQ ID NO: 503. In some embodiments, the antibody or antigen binding fragment thereof binds a human HAUS1, mouse HAUS1, rat HAUS1, bovine HAUS1, or cynomolgus monkey HAUS1. In some embodiments, the human HAUS1 comprises a sequence of SEQ ID NO: 4513.

Provided herein is an antibody that competes with an antibody or antigen binding fragment for binding to HAUS1, wherein the antibody binds to human HAUS1 or mouse HAUS1.

Provided herein is an antibody or an antigen binding fragment thereof that selectively binds to DPY30 domain containing 1, transcript variant X4 (DYDC1) or a variant thereof, comprising at least one of: a variable heavy chain region, wherein the variable heavy chain region comprises a complementarity-determining region heavy chain 1 (CDR-H1) of SEQ ID NO: 774, CDR-H2 of SEQ ID NO: 1316, and CDR-H3 of SEQ ID NO: 1858; and/or a variable light chain region, wherein the variable light chain region comprises a complementarity-determining region light chain 1 (CDR-L1) of SEQ ID NO: 1045, CDR-L2 of SEQ ID NO: 1587, and CDR-L3 of SEQ ID NO: 2129. In some embodiments, the variable heavy chain comprises a polypeptide consensus sequence having at least 95% sequence identity to the amino acid sequence of SEQ ID NO: 232, and the variable light chain comprises a polypeptide consensus sequence having at least 95% sequence identity to the amino acid sequence of SEQ ID NO: 503. In some embodiments, the antibody or antigen binding fragment thereof binds a human DYDC1, mouse DYDC1, rat DYDC1, bovine DYDC1, or cynomolgus monkey DYDC1. In some embodiments, the human DYDC1 comprises a sequence of SEQ ID NO: 4514.

Provided herein is an antibody that competes with an antibody or antigen binding fragment for binding to DYDC1, wherein the antibody binds to human DYDC1 or mouse DYDC1.

Provided herein is an antibody or an antigen binding fragment thereof that selectively binds to Transforming growth factor beta 3 (TGFB3) or a variant thereof, comprising at least one of: a variable heavy chain region, wherein the variable heavy chain region comprises a complementarity-determining region heavy chain 1 (CDR-H1) of SEQ ID NO: 775, CDR-H2 of SEQ ID NO: 1317, and CDR-H3 of SEQ ID NO: 1859; and/or a variable light chain region, wherein the variable light chain region comprises a complementarity-determining region light chain 1 (CDR-L1) of SEQ ID NO: 1046, CDR-L2 of SEQ ID NO: 1588, and CDR-L3 of SEQ ID NO: 2130. In some embodiments, the variable heavy chain comprises a polypeptide consensus sequence having at least 95% sequence identity to the amino acid sequence of SEQ ID NO: 233, and the variable light chain comprises a polypeptide consensus sequence having at least 95% sequence identity to the amino acid sequence of SEQ ID NO: 504. In some embodiments, the antibody or antigen binding fragment thereof binds a human TGFB3, mouse TGFB3, rat TGFB3, bovine TGFB3, or cynomolgus monkey TGFB3. In some embodiments, the human TGFB3 comprises a sequence of SEQ ID NO: 4515.

Provided herein is an antibody that competes with an antibody or antigen binding fragment for binding to TGFB3, wherein the antibody binds to human TGFB3 or mouse TGFB3.

Provided herein is an antibody or an antigen binding fragment thereof that selectively binds to chymotrypsinogen B2 (CTRB2) or a variant thereof, comprising at least one of: a variable heavy chain region, wherein the variable heavy chain region comprises a complementarity-determining region heavy chain 1 (CDR-H1) of SEQ ID NO: 776, CDR-H2 of SEQ ID NO: 1318, and CDR-H3 of SEQ ID NO: 1860; and/or a variable light chain region, wherein the variable light chain region comprises a complementarity-determining region light chain 1 (CDR-L1) of SEQ ID NO: 1047, CDR-L2 of SEQ ID NO: 1589, and CDR-L3 of SEQ ID NO: 2131. In some embodiments, the variable heavy chain comprises a polypeptide consensus sequence having at least 95% sequence identity to the amino acid sequence of SEQ ID NO: 234, and the variable light chain comprises a polypeptide consensus sequence having at least 95% sequence identity to the amino acid sequence of SEQ ID NO: 505. In some embodiments, the antibody or antigen binding fragment thereof binds a human CTRB2, mouse CTRB2, rat CTRB2, bovine CTRB2, or cynomolgus monkey CTRB2. In some embodiments, the human CTRB2 comprises a sequence of SEQ ID NO: 4516.

Provided herein is an antibody that competes with an antibody or antigen binding fragment for binding to CTRB2, wherein the antibody binds to human CTRB2 or mouse CTRB2. Provided herein is an antibody or an antigen binding fragment thereof that selectively binds to NFKB inhibitor beta, transcript variant 1 (NFKBIB) or a variant thereof, comprising at least one of: a variable heavy chain region, wherein the variable heavy chain region comprises a complementarity-determining region heavy chain 1 (CDR-H1) of SEQ ID NO: 777, CDR-H2 of SEQ ID NO: 1319, and CDR-H3 of SEQ ID NO: 1861; and/or a variable light chain region, wherein the variable light chain region comprises a complementarity-determining region light chain 1 (CDR-L1) of SEQ ID NO: 1048, CDR-L2 of SEQ ID NO: 1590, and CDR-L3 of SEQ ID NO: 2132. In some embodiments, the variable heavy chain comprises a polypeptide consensus sequence having at least 95% sequence identity to the amino acid sequence of SEQ ID NO: 235, and the variable light chain comprises a polypeptide consensus sequence having at least 95% sequence identity to the amino acid sequence of SEQ ID NO: 506.

In some embodiments, the antibody or antigen binding fragment thereof binds a human NFKBIB, mouse NFKBIB, rat NFKBIB, bovine NFKBIB, or cynomolgus monkey NFKBIB. In some embodiments, the human NFKBIB comprises a sequence of SEQ ID NO: 4517.

Provided herein is an antibody that competes with an antibody or antigen binding fragment for binding to NFKBIB, wherein the antibody binds to human NFKBIB or mouse NFKBIB.

Provided herein is an antibody or an antigen binding fragment thereof that selectively binds to cyclin dependent kinase 2 associated protein 2, transcript variant 1 (CDK2AP2) or a variant thereof, comprising at least one of: a variable heavy chain region, wherein the variable heavy chain region comprises a complementarity-determining region heavy chain 1 (CDR-H1) of SEQ ID NO: 777, CDR-H2 of SEQ ID NO: 1319, and CDR-H3 of SEQ ID NO: 1861; and/or a variable light chain region, wherein the variable light chain region comprises a complementarity-determining region light chain 1 (CDR-L1) of SEQ ID NO: 1048, CDR-L2 of SEQ ID NO: 1590, and CDR-L3 of SEQ ID NO: 2132. In some embodiments, the variable heavy chain comprises a polypeptide consensus sequence having at least 95% sequence identity to the amino acid sequence of SEQ ID NO: 235, and the variable light chain comprises a polypeptide consensus sequence having at least 95% sequence identity to the amino acid sequence of SEQ ID NO: 506. In some embodiments, the antibody or antigen binding fragment thereof binds a human CDK2AP2, mouse CDK2AP2, rat CDK2AP2, bovine CDK2AP2, or cynomolgus monkey CDK2AP2. In some embodiments, the human CDK2AP2 comprises a sequence of SEQ ID NO: 4518.

Provided herein is an antibody that competes with an antibody or antigen binding fragment for binding to CDK2AP2, wherein the antibody binds to human CDK2AP2 or mouse CDK2AP2.

Provided herein is an antibody or an antigen binding fragment thereof that selectively binds to lipase family member N, transcript variant X1 (LIPN) or a variant thereof, comprising at least one of: a variable heavy chain region, wherein the variable heavy chain region comprises a complementarity-determining region heavy chain 1 (CDR-H1) of SEQ ID NO: 778, CDR-H2 of SEQ ID NO: 1320, and CDR-H3 of SEQ ID NO: 1862; and/or a variable light chain region, wherein the variable light chain region comprises a complementarity-determining region light chain 1 (CDR- L1) of SEQ ID NO: 1049, CDR-L2 of SEQ ID NO: 1591, and CDR-L3 of SEQ ID NO: 2133. In some embodiments, the variable heavy chain comprises a polypeptide consensus sequence having at least 95% sequence identity to the amino acid sequence of SEQ ID NO: 236, and the variable light chain comprises a polypeptide consensus sequence having at least 95% sequence identity to the amino acid sequence of SEQ ID NO: 507. In some embodiments, the antibody or antigen binding fragment thereof binds a human LIPN, mouse LIPN, rat LIPN, bovine LIPN, or cynomolgus monkey LIPN. In some embodiments, the human LIPN comprises a sequence of SEQ ID NO: 4519.

Provided herein is an antibody that competes with an antibody or antigen binding fragment for binding to LIPN, wherein the antibody binds to human LIPN or mouse LIPN.

Provided herein is an antibody or an antigen binding fragment thereof that selectively binds to regulator of G protein signaling 14, transcript variant 1 (RGS14) or a variant thereof, comprising at least one of: a variable heavy chain region, wherein the variable heavy chain region comprises a complementarity-determining region heavy chain 1 (CDR-H1) of SEQ ID NO: 779, CDR-H2 of SEQ ID NO: 1321, and CDR-H3 of SEQ ID NO: 1863; and/or a variable light chain region, wherein the variable light chain region comprises a complementarity-determining region light chain 1 (CDR-L1) of SEQ ID NO: 1050, CDR-L2 of SEQ ID NO: 1592, and CDR-L3 of SEQ ID NO: 2134. In some embodiments, the variable heavy chain comprises a polypeptide consensus sequence having at least 95% sequence identity to the amino acid sequence of SEQ ID NO: 237, and the variable light chain comprises a polypeptide consensus sequence having at least 95% sequence identity to the amino acid sequence of SEQ ID NO: 508. In some embodiments, the antibody or antigen binding fragment thereof binds a human RGS14, mouse RGS14, rat RGS14, bovine RGS14, or cynomolgus monkey RGS14. In some embodiments, the human RGS14 comprises a sequence of SEQ ID NO: 4520.

Provided herein is an antibody that competes with an antibody or antigen binding fragment for binding to RGS14, wherein the antibody binds to human RGS14 or mouse RGS14.

Provided herein is an antibody or an antigen binding fragment thereof that selectively binds to leucine rich repeat containing 14, transcript variant 1 (LRRC14) or a variant thereof, comprising at least one of: a variable heavy chain region, wherein the variable heavy chain region comprises a complementarity-determining region heavy chain 1 (CDR-H1) of SEQ ID NO: 779, CDR-H2 of SEQ ID NO: 1321, and CDR-H3 of SEQ ID NO: 1863; and/or a variable light chain region, wherein the variable light chain region comprises a complementarity-determining region light chain 1 (CDR-L1) of SEQ ID NO: 1050, CDR-L2 of SEQ ID NO: 1592, and CDR-L3 of SEQ ID NO: 2134. In some embodiments, the variable heavy chain comprises a polypeptide consensus sequence having at least 95% sequence identity to the amino acid sequence of SEQ ID NO: 237, and the variable light chain comprises a polypeptide consensus sequence having at least 95% sequence identity to the amino acid sequence of SEQ ID NO: 508. In some embodiments, the antibody or antigen binding fragment thereof binds a human LRRC14, mouse LRRC14, rat LRRC14, bovine LRRC14, or cynomolgus monkey LRRC14. In some embodiments, the human LRRC14 comprises a sequence of SEQ ID NO: 4521.

Provided herein is an antibody that competes with an antibody or antigen binding fragment for binding to LRRC14, wherein the antibody binds to human LRRC14 or mouse LRRC14.

Provided herein is an antibody or an antigen binding fragment thereof that selectively binds to transforming growth factor beta induced (TGFBI) or a variant thereof, comprising at least one of: a variable heavy chain region, wherein the variable heavy chain region comprises a complementarity-determining region heavy chain 1 (CDR-H1) of SEQ ID NO: 780, CDR-H2 of SEQ ID NO: 1322, and CDR-H3 of SEQ ID NO: 1864; and/or a variable light chain region, wherein the variable light chain region comprises a complementarity-determining region light chain 1 (CDR-L1) of SEQ ID NO: 1051, CDR-L2 of SEQ ID NO: 1593, and CDR-L3 of SEQ ID NO: 2135. In some embodiments, the variable heavy chain comprises a polypeptide consensus sequence having at least 95% sequence identity to the amino acid sequence of SEQ ID NO: 238, and the variable light chain comprises a polypeptide consensus sequence having at least 95% sequence identity to the amino acid sequence of SEQ ID NO: 509. In some embodiments, the antibody or antigen binding fragment thereof binds a human TGFBI, mouse TGFBI, rat TGFBI, bovine TGFBI, or cynomolgus monkey TGFBI. In some embodiments, the human TGFBI comprises a sequence of SEQ ID NO: 4522.

Provided herein is an antibody that competes with an antibody or antigen binding fragment for binding to TGFBI, wherein the antibody binds to human TGFBI or mouse TGFBI.

Provided herein is an antibody or an antigen binding fragment thereof that selectively binds to BCL2 apoptosis regulator, transcript variant alpha (BCL2) or a variant thereof, comprising at least one of: a variable heavy chain region, wherein the variable heavy chain region comprises a complementarity-determining region heavy chain 1 (CDR-H1) of SEQ ID NO: 782, CDR-H2 of SEQ ID NO: 1324, and CDR-H3 of SEQ ID NO: 1866; and/or a variable light chain region, wherein the variable light chain region comprises a complementarity-determining region light chain 1 (CDR-L1) of SEQ ID NO: 1053, CDR-L2 of SEQ ID NO: 1595, and CDR-L3 of SEQ ID NO: 2137. In some embodiments, the variable heavy chain comprises a polypeptide consensus sequence having at least 95% sequence identity to the amino acid sequence of SEQ ID NO: 240, and the variable light chain comprises a polypeptide consensus sequence having at least 95% sequence identity to the amino acid sequence of SEQ ID NO: 511. In some embodiments, the antibody or antigen binding fragment thereof binds a human BCL2, mouse BCL2, rat BCL2, bovine BCL2, or cynomolgus monkey BCL2. In some embodiments, the human BCL2 comprises a sequence of SEQ ID NO: 4523.

Provided herein is an antibody that competes with an antibody or antigen binding fragment for binding to BCL2, wherein the antibody binds to human BCL2 or mouse BCL2.

Provided herein is an antibody or an antigen binding fragment thereof that selectively binds to DIX domain containing 1, transcript variant 2 (DIXDC1) or a variant thereof, comprising at least one of: a variable heavy chain region, wherein the variable heavy chain region comprises a complementarity-determining region heavy chain 1 (CDR-H1) of SEQ ID NO: 783, CDR-H2 of SEQ ID NO: 1325, and CDR-H3 of SEQ ID NO: 1867; and/or a variable light chain region, wherein the variable light chain region comprises a complementarity-determining region light chain 1 (CDR-L1) of SEQ ID NO: 1054, CDR-L2 of SEQ ID NO: 1596, and CDR-L3 of SEQ ID NO: 2138. In some embodiments, the variable heavy chain comprises a polypeptide consensus sequence having at least 95% sequence identity to the amino acid sequence of SEQ ID NO: 241, and the variable light chain comprises a polypeptide consensus sequence having at least 95% sequence identity to the amino acid sequence of SEQ ID NO: 512. In some embodiments, the antibody or antigen binding fragment thereof binds a human DIXDC1, mouse DIXDC1, rat DIXDC1, bovine DIXDC1, or cynomolgus monkey DIXDC1. In some embodiments, the human DIXDC1 comprises a sequence of SEQ ID NO: 4524.

Provided herein is an antibody that competes with an antibody or antigen binding fragment for binding to DIXDC1, wherein the antibody binds to human DIXDC1 or mouse DIXDC1.

Provided herein is an antibody or an antigen binding fragment thereof that selectively binds to Caspase 8 (CASP8) or a variant thereof, comprising at least one of: a variable heavy chain region, wherein the variable heavy chain region comprises a complementarity-determining region heavy chain 1 (CDR-H1) of SEQ ID NO: 784, CDR-H2 of SEQ ID NO: 1326, and CDR-H3 of SEQ ID NO: 1868; and/or a variable light chain region, wherein the variable light chain region comprises a complementarity-determining region light chain 1 (CDR-L1) of SEQ ID NO: 1055, CDR-L2 of SEQ ID NO: 1597, and CDR-L3 of SEQ ID NO: 2139. In some embodiments, the variable heavy chain comprises a polypeptide consensus sequence having at least 95% sequence identity to the amino acid sequence of SEQ ID NO: 242, and the variable light chain comprises a polypeptide consensus sequence having at least 95% sequence identity to the amino acid sequence of SEQ ID NO: 513. In some embodiments, the antibody or antigen binding fragment thereof binds a human CASP8, mouse CASP8, rat CASP8, bovine CASP8, or cynomolgus monkey CASP8. In some embodiments, the human CASP8 comprises a sequence of SEQ ID NO: 4525.

Provided herein is an antibody that competes with an antibody or antigen binding fragment for binding to CASP8, wherein the antibody binds to human CASP8 or mouse CASP8.

Provided herein is an antibody or an antigen binding fragment thereof that selectively binds to phosphoglucomutase 2 like 1 (PGM2L1) or a variant thereof, comprising at least one of: a variable heavy chain region, wherein the variable heavy chain region comprises a complementarity-determining region heavy chain 1 (CDR-H1) of SEQ ID NO: 784, CDR-H2 of SEQ ID NO: 1326, and CDR-H3 of SEQ ID NO: 1868; and/or a variable light chain region, wherein the variable light chain region comprises a complementarity-determining region light chain 1 (CDR-L1) of SEQ ID NO: 1055, CDR-L2 of SEQ ID NO: 1597, and CDR-L3 of SEQ ID NO: 2139. In some embodiments, the variable heavy chain comprises a polypeptide consensus sequence having at least 95% sequence identity to the amino acid sequence of SEQ ID NO: 242, and the variable light chain comprises a polypeptide consensus sequence having at least 95% sequence identity to the amino acid sequence of SEQ ID NO: 513. In some embodiments, the antibody or antigen binding fragment thereof binds a human PGM2L1, mouse PGM2L1, rat PGM2L1, bovine PGM2L1, or cynomolgus monkey PGM2L1. In some embodiments, the human PGM2L1 comprises a sequence of SEQ ID NO: 4526.

Provided herein is an antibody that competes with an antibody or antigen binding fragment for binding to PGM2L1, wherein the antibody binds to human PGM2L1 or mouse PGM2L1.

Provided herein is an antibody or an antigen binding fragment thereof that selectively binds to programmed cell death 1 (PDCD1) or a variant thereof, comprising at least one of: a variable heavy chain region, wherein the variable heavy chain region comprises a complementarity-determining region heavy chain 1 (CDR-H1) of SEQ ID NO: 785, CDR-H2 of SEQ ID NO: 1327, and CDR-H3 of SEQ ID NO: 1869; and/or a variable light chain region, wherein the variable light chain region comprises a complementarity-determining region light chain 1 (CDR-L1) of SEQ ID NO: 1056, CDR-L2 of SEQ ID NO: 1598, and CDR-L3 of SEQ ID NO: 2140. In some embodiments, the variable heavy chain comprises a polypeptide consensus sequence having at least 95% sequence identity to the amino acid sequence of SEQ ID NO: 243, and the variable light chain comprises a polypeptide consensus sequence having at least 95% sequence identity to the amino acid sequence of SEQ ID NO: 514. In some embodiments, the antibody or antigen binding fragment thereof binds a human PDCD1, mouse PDCD1, rat PDCD1, bovine PDCD1, or cynomolgus monkey PDCD1. In some embodiments, the human PDCD1 comprises a sequence of SEQ ID NO: 4527.

Provided herein is an antibody that competes with an antibody or antigen binding fragment for binding to PDCD1, wherein the antibody binds to human PDCD1 or mouse PDCD1.

Provided herein is an antibody or an antigen binding fragment thereof that selectively binds to glyoxylate and hydroxypyruvate reductase (GRHPR) or a variant thereof, comprising at least one of: a variable heavy chain region, wherein the variable heavy chain region comprises a complementarity-determining region heavy chain 1 (CDR-H1) of SEQ ID NO: 786, CDR-H2 of SEQ ID NO: 1328, and CDR-H3 of SEQ ID NO: 1870; and/or a variable light chain region, wherein the variable light chain region comprises a complementarity-determining region light chain 1 (CDR-L1) of SEQ ID NO: 1057, CDR-L2 of SEQ ID NO: 1599, and CDR-L3 of SEQ ID NO: 2141. In some embodiments, the variable heavy chain comprises a polypeptide consensus sequence having at least 95% sequence identity to the amino acid sequence of SEQ ID NO: 244, and the variable light chain comprises a polypeptide consensus sequence having at least 95% sequence identity to the amino acid sequence of SEQ ID NO: 515. In some embodiments, the antibody or antigen binding fragment thereof binds a human GRHPR, mouse GRHPR, rat GRHPR, bovine GRHPR, or cynomolgus monkey GRHPR. In some embodiments, the human GRHPR comprises a sequence of SEQ ID NO: 4528.

Provided herein is an antibody that competes with an antibody or antigen binding fragment for binding to GRHPR, wherein the antibody binds to human GRHPR or mouse GRHPR.

Provided herein is an antibody or an antigen binding fragment thereof that selectively binds to Cytochrome b5 reductase 2 (CYB5R2) or a variant thereof, comprising at least one of: a variable heavy chain region, wherein the variable heavy chain region comprises a complementarity-determining region heavy chain 1 (CDR-H1) of SEQ ID NO: 787, CDR-H2 of SEQ ID NO: 1329, and CDR-H3 of SEQ ID NO: 1871; and/or a variable light chain region, wherein the variable light chain region comprises a complementarity-determining region light chain 1 (CDR-L1) of SEQ ID NO: 1058, CDR-L2 of SEQ ID NO: 1600, and CDR-L3 of SEQ ID NO: 2142. In some embodiments, the variable heavy chain comprises a polypeptide consensus sequence having at least 95% sequence identity to the amino acid sequence of SEQ ID NO: 245, and the variable light chain comprises a polypeptide consensus sequence having at least 95% sequence identity to the amino acid sequence of SEQ ID NO: 516. In some embodiments, the antibody or antigen binding fragment thereof binds a human CYB5R2, mouse CYB5R2, rat CYB5R2, bovine CYB5R2, or cynomolgus monkey CYB5R2. In some embodiments, the human CYB5R2 comprises a sequence of SEQ ID NO: 4529.

Provided herein is an antibody that competes with an antibody or antigen binding fragment for binding to CYB5R2, wherein the antibody binds to human CYB5R2 or mouse CYB5R2.

Provided herein is an antibody or an antigen binding fragment thereof that selectively binds to acyl-CoA binding domain containing 6 (ACBD6) or a variant thereof, comprising at least one of: a variable heavy chain region, wherein the variable heavy chain region comprises a complementarity-determining region heavy chain 1 (CDR-H1) of SEQ ID NO: 788, CDR-H2 of SEQ ID NO: 1330, and CDR-H3 of SEQ ID NO: 1872; and/or a variable light chain region, wherein the variable light chain region comprises a complementarity-determining region light chain 1 (CDR-L1) of SEQ ID NO: 1059, CDR-L2 of SEQ ID NO: 1601, and CDR-L3 of SEQ ID NO: 2143. In some embodiments, the variable heavy chain comprises a polypeptide consensus sequence having at least 95% sequence identity to the amino acid sequence of SEQ ID NO: 246, and the variable light chain comprises a polypeptide consensus sequence having at least 95% sequence identity to the amino acid sequence of SEQ ID NO: 517. In some embodiments, the antibody or antigen binding fragment thereof binds a human ACBD6, mouse ACBD6, rat ACBD6, bovine ACBD6, or cynomolgus monkey ACBD6. In some embodiments, the human ACBD6 comprises a sequence of SEQ ID NO: 4530.

Provided herein is an antibody that competes with an antibody or antigen binding fragment for binding to ACBD6, wherein the antibody binds to human ACBD6 or mouse ACBD6.

Provided herein is an antibody or an antigen binding fragment thereof that selectively binds to phosducin like (PDCL) or a variant thereof, comprising at least one of: a variable heavy chain region, wherein the variable heavy chain region comprises a complementarity-determining region heavy chain 1 (CDR-H1) of SEQ ID NO: 789, CDR-H2 of SEQ ID NO: 1331, and CDR-H3 of SEQ ID NO: 1873; and/or a variable light chain region, wherein the variable light chain region comprises a complementarity-determining region light chain 1 (CDR-L1) of SEQ ID NO: 1060, CDR-L2 of SEQ ID NO: 1602, and CDR-L3 of SEQ ID NO: 2144. In some embodiments, the variable heavy chain comprises a polypeptide consensus sequence having at least 95% sequence identity to the amino acid sequence of SEQ ID NO: 247, and the variable light chain comprises a polypeptide consensus sequence having at least 95% sequence identity to the amino acid sequence of SEQ ID NO: 518. In some embodiments, the antibody or antigen binding fragment thereof binds a human PDCL, mouse PDCL, rat PDCL, bovine PDCL, or cynomolgus monkey PDCL. In some embodiments, the human PDCL comprises a sequence of SEQ ID NO: 4531.

Provided herein is an antibody that competes with an antibody or antigen binding fragment for binding to PDCL, wherein the antibody binds to human PDCL or mouse PDCL.

Provided herein is an antibody or an antigen binding fragment thereof that selectively binds to Dexd-box helicase 52 (DDX52) or a variant thereof, comprising at least one of: a variable heavy chain region, wherein the variable heavy chain region comprises a complementarity-determining region heavy chain 1 (CDR-H1) of SEQ ID NO: 790, CDR-H2 of SEQ ID NO: 1332, and CDR-H3 of SEQ ID NO: 1874; and/or a variable light chain region, wherein the variable light chain region comprises a complementarity-determining region light chain 1 (CDR-L1) of SEQ ID NO: 1061, CDR-L2 of SEQ ID NO: 1603, and CDR-L3 of SEQ ID NO: 2145. In some embodiments, the variable heavy chain comprises a polypeptide consensus sequence having at least 95% sequence identity to the amino acid sequence of SEQ ID NO: 248, and the variable light chain comprises a polypeptide consensus sequence having at least 95% sequence identity to the amino acid sequence of SEQ ID NO: 519. In some embodiments, the antibody or antigen binding fragment thereof binds a human DDX52, mouse DDX52, rat DDX52, bovine DDX52, or cynomolgus monkey DDX52. In some embodiments, the human DDX52 comprises a sequence of SEQ ID NO: 4532.

Provided herein is an antibody that competes with an antibody or antigen binding fragment for binding to DDX52, wherein the antibody binds to human DDX52 or mouse DDX52.

Provided herein is an antibody or an antigen binding fragment thereof that selectively binds to G protein-coupled receptor 4 (GPR4) or a variant thereof, comprising at least one of: a variable heavy chain region, wherein the variable heavy chain region comprises a complementarity-determining region heavy chain 1 (CDR-H1) of SEQ ID NO: 790, CDR-H2 of SEQ ID NO: 1332, and CDR-H3 of SEQ ID NO: 1874; and/or a variable light chain region, wherein the variable light chain region comprises a complementarity-determining region light chain 1 (CDR-L1) of SEQ ID NO: 1061, CDR-L2 of SEQ ID NO: 1603, and CDR-L3 of SEQ ID NO: 2145. In some embodiments, the variable heavy chain comprises a polypeptide consensus sequence having at least 95% sequence identity to the amino acid sequence of SEQ ID NO: 248, and the variable light chain comprises a polypeptide consensus sequence having at least 95% sequence identity to the amino acid sequence of SEQ ID NO: 519. In some embodiments, the antibody or antigen binding fragment thereof binds a human GPR4, mouse GPR4, rat GPR4, bovine GPR4, or cynomolgus monkey GPR4. In some embodiments, the human GPR4 comprises a sequence of SEQ ID NO: 4533.

Provided herein is an antibody that competes with an antibody or antigen binding fragment for binding to GPR4, wherein the antibody binds to human GPR4 or mouse GPR4.

Provided herein is an antibody or an antigen binding fragment thereof that selectively binds to aarF domain containing kinase 5 (ADCK5) or a variant thereof, comprising at least one of: a variable heavy chain region, wherein the variable heavy chain region comprises a complementarity-determining region heavy chain 1 (CDR-H1) of SEQ ID NO: 791, CDR-H2 of SEQ ID NO: 1333, and CDR-H3 of SEQ ID NO: 1875; and/or a variable light chain region, wherein the variable light chain region comprises a complementarity-determining region light chain 1 (CDR-L1) of SEQ ID NO: 1062, CDR-L2 of SEQ ID NO: 1604, and CDR-L3 of SEQ ID NO: 2146. In some embodiments, the variable heavy chain comprises a polypeptide consensus sequence having at least 95% sequence identity to the amino acid sequence of SEQ ID NO: 249, and the variable light chain comprises a polypeptide consensus sequence having at least 95% sequence identity to the amino acid sequence of SEQ ID NO: 520. In some embodiments, the antibody or antigen binding fragment thereof binds a human ADCK5, mouse ADCK5, rat ADCK5, bovine ADCK5, or cynomolgus monkey ADCK5. In some embodiments, the human ADCK5 comprises a sequence of SEQ ID NO: 4423.

Provided herein is an antibody that competes with an antibody or antigen binding fragment for binding to ADCK5, wherein the antibody binds to human ADCK5 or mouse ADCK5.

Provided herein is an antibody or an antigen binding fragment thereof that selectively binds to DIX domain containing 1, transcript variant 2 (DIXDC1) or a variant thereof, comprising at least one of: a variable heavy chain region, wherein the variable heavy chain region comprises a complementarity-determining region heavy chain 1 (CDR-H1) of SEQ ID NO: 792, CDR-H2 of SEQ ID NO: 1334, and CDR-H3 of SEQ ID NO: 1876; and/or a variable light chain region, wherein the variable light chain region comprises a complementarity-determining region light chain 1 (CDR-L1) of SEQ ID NO: 1063, CDR-L2 of SEQ ID NO: 1605, and CDR-L3 of SEQ ID NO: 2147. In some embodiments, the variable heavy chain comprises a polypeptide consensus sequence having at least 95% sequence identity to the amino acid sequence of SEQ ID NO: 250, and the variable light chain comprises a polypeptide consensus sequence having at least 95% sequence identity to the amino acid sequence of SEQ ID NO: 521. In some embodiments, the antibody or antigen binding fragment thereof binds a human DIXDC1, mouse DIXDC1, rat DIXDC1, bovine DIXDC1, or cynomolgus monkey DIXDC1. In some embodiments, the human DIXDC1 comprises a sequence of SEQ ID NO: 4524.

Provided herein is an antibody that competes with an antibody or antigen binding fragment for binding to DIXDC1, wherein the antibody binds to human DIXDC1 or mouse DIXDC1.

Provided herein is an antibody or an antigen binding fragment thereof that selectively binds to Jupiter microtubule associated homolog 2 (HN1L) or a variant thereof, comprising at least one of: a variable heavy chain region, wherein the variable heavy chain region comprises a complementarity-determining region heavy chain 1 (CDR-H1) of SEQ ID NO: 793, CDR-H2 of SEQ ID NO: 1335, and CDR-H3 of SEQ ID NO: 1877; and/or a variable light chain region, wherein the variable light chain region comprises a complementarity-determining region light chain 1 (CDR-L1) of SEQ ID NO: 1064, CDR-L2 of SEQ ID NO: 1606, and CDR-L3 of SEQ ID NO: 2148. In some embodiments, the variable heavy chain comprises a polypeptide consensus sequence having at least 95% sequence identity to the amino acid sequence of SEQ ID NO: 251, and the variable light chain comprises a polypeptide consensus sequence having at least 95% sequence identity to the amino acid sequence of SEQ ID NO: 522. In some embodiments, the antibody or antigen binding fragment thereof binds a human HN1L, mouse HN1L, rat HN1L, bovine HN1L, or cynomolgus monkey HN1L. In some embodiments, the human HN1L comprises a sequence of SEQ ID NO: 4395.

Provided herein is an antibody that competes with an antibody or antigen binding fragment for binding to HN1L, wherein the antibody binds to human HN1L or mouse HN1L.

Provided herein is an antibody or an antigen binding fragment thereof that selectively binds to G antigen 2A (GAGE2A) or a variant thereof, comprising at least one of: a variable heavy chain region, wherein the variable heavy chain region comprises a complementarity-determining region heavy chain 1 (CDR-H1) of SEQ ID NO: 794, CDR-H2 of SEQ ID NO: 1336, and CDR-H3 of SEQ ID NO: 1878; and/or a variable light chain region, wherein the variable light chain region comprises a complementarity-determining region light chain 1 (CDR-L1) of SEQ ID NO: 1065, CDR-L2 of SEQ ID NO: 1607, and CDR-L3 of SEQ ID NO: 2149. In some embodiments, the variable heavy chain comprises a polypeptide consensus sequence having at least 95% sequence identity to the amino acid sequence of SEQ ID NO: 252, and the variable light chain comprises a polypeptide consensus sequence having at least 95% sequence identity to the amino acid sequence of SEQ ID NO: 523. In some embodiments, the antibody or antigen binding fragment thereof binds a human GAGE2A, mouse GAGE2A, rat GAGE2A, bovine GAGE2A, or cynomolgus monkey GAGE2A. In some embodiments, the human GAGE2A comprises a sequence of SEQ ID NO: 4534.

Provided herein is an antibody that competes with an antibody or antigen binding fragment for binding to GAGE2A, wherein the antibody binds to human GAGE2A or mouse GAGE2A.

Provided herein is an antibody or an antigen binding fragment thereof that selectively binds to DIX domain containing 1, transcript variant 2 (DIXDC1) or a variant thereof, comprising at least one of: a variable heavy chain region, wherein the variable heavy chain region comprises a complementarity-determining region heavy chain 1 (CDR-H1) of SEQ ID NO: 795, CDR-H2 of SEQ ID NO: 1337, and CDR-H3 of SEQ ID NO: 1879; and/or a variable light chain region, wherein the variable light chain region comprises a complementarity-determining region light chain 1 (CDR-L1) of SEQ ID NO: 1066, CDR-L2 of SEQ ID NO: 1608, and CDR-L3 of SEQ ID NO: 2150. In some embodiments, the variable heavy chain comprises a polypeptide consensus sequence having at least 95% sequence identity to the amino acid sequence of SEQ ID NO: 253, and the variable light chain comprises a polypeptide consensus sequence having at least 95% sequence identity to the amino acid sequence of SEQ ID NO: 524. In some embodiments, the antibody or antigen binding fragment thereof binds a human DIXDC1, mouse DIXDC1, rat DIXDC1, bovine DIXDC1, or cynomolgus monkey DIXDC1. In some embodiments, the human DIXDC1 comprises a sequence of SEQ ID NO: 4524.

Provided herein is an antibody that competes with an antibody or antigen binding fragment for binding to DIXDC1, wherein the antibody binds to human DIXDC1 or mouse DIXDC1.

Provided herein is an antibody or an antigen binding fragment thereof that selectively binds to RNA polymerase II subunit E, transcript variant 1 (POLR2E) or a variant thereof, comprising at least one of: a variable heavy chain region, wherein the variable heavy chain region comprises a complementarity-determining region heavy chain 1 (CDR-H1) of SEQ ID NO: 795, CDR-H2 of SEQ ID NO: 1337, and CDR-H3 of SEQ ID NO: 1879; and/or a variable light chain region, wherein the variable light chain region comprises a complementarity-determining region light chain 1 (CDR-L1) of SEQ ID NO: 1066, CDR-L2 of SEQ ID NO: 1608, and CDR-L3 of SEQ ID NO: 2150. In some embodiments, the variable heavy chain comprises a polypeptide consensus sequence having at least 95% sequence identity to the amino acid sequence of SEQ ID NO: 253, and the variable light chain comprises a polypeptide consensus sequence having at least 95% sequence identity to the amino acid sequence of SEQ ID NO: 524. In some embodiments, the antibody or antigen binding fragment thereof binds a human POLR2E, mouse POLR2E, rat POLR2E, bovine POLR2E, or cynomolgus monkey POLR2E. In some embodiments, the human POLR2E comprises a sequence of SEQ ID NO: 4535.

Provided herein is an antibody that competes with an antibody or antigen binding fragment for binding to POLR2E, wherein the antibody binds to human POLR2E or mouse POLR2E.

Provided herein is an antibody or an antigen binding fragment thereof that selectively binds to proliferating cell nuclear antigen, transcript variant 1 (PCNA) or a variant thereof, comprising at least one of: a variable heavy chain region, wherein the variable heavy chain region comprises a complementarity-determining region heavy chain 1 (CDR-H1) of SEQ ID NO: 796, CDR-H2 of SEQ ID NO: 1338, and CDR-H3 of SEQ ID NO: 1880; and/or a variable light chain region, wherein the variable light chain region comprises a complementarity-determining region light chain 1 (CDR-L1) of SEQ ID NO: 1067, CDR-L2 of SEQ ID NO: 1609, and CDR-L3 of SEQ ID NO: 2151. In some embodiments, the variable heavy chain comprises a polypeptide consensus sequence having at least 95% sequence identity to the amino acid sequence of SEQ ID NO: 254, and the variable light chain comprises a polypeptide consensus sequence having at least 95% sequence identity to the amino acid sequence of SEQ ID NO: 525. In some embodiments, the antibody or antigen binding fragment thereof binds a human PCNA, mouse PCNA, rat PCNA, bovine PCNA, or cynomolgus monkey PCNA. In some embodiments, the human PCNA comprises a sequence of SEQ ID NO: 4428.

Provided herein is an antibody that competes with an antibody or antigen binding fragment for binding to PCNA, wherein the antibody binds to human PCNA or mouse PCNA.

Provided herein is an antibody or an antigen binding fragment thereof that selectively binds to BAF chromatin remodeling complex subunit BCL7C, transcript variant 2 (BCL7C) or a variant thereof, comprising at least one of: a variable heavy chain region, wherein the variable heavy chain region comprises a complementarity-determining region heavy chain 1 (CDR-H1) of SEQ ID NO: 797, CDR-H2 of SEQ ID NO: 1339, and CDR-H3 of SEQ ID NO: 1881; and/or a variable light chain region, wherein the variable light chain region comprises a complementarity-determining region light chain 1 (CDR-L1) of SEQ ID NO: 1068, CDR-L2 of SEQ ID NO: 1610, and CDR-L3 of SEQ ID NO: 2152. In some embodiments, the variable heavy chain comprises a polypeptide consensus sequence having at least 95% sequence identity to the amino acid sequence of SEQ ID NO: 255, and the variable light chain comprises a polypeptide consensus sequence having at least 95% sequence identity to the amino acid sequence of SEQ ID NO: 526. In some embodiments, the antibody or antigen binding fragment thereof binds a human BCL7C, mouse BCL7C, rat BCL7C, bovine BCL7C, or cynomolgus monkey BCL7C. In some embodiments, the human BCL7C comprises a sequence of SEQ ID NO: 4536.

Provided herein is an antibody that competes with an antibody or antigen binding fragment for binding to BCL7C, wherein the antibody binds to human BCL7C or mouse BCL7C.

Provided herein is an antibody or an antigen binding fragment thereof that selectively binds to influenza virus NS1A binding protein (IVNS1ABP) or a variant thereof, comprising at least one of: a variable heavy chain region, wherein the variable heavy chain region comprises a complementarity-determining region heavy chain 1 (CDR-H1) of SEQ ID NO: 797, CDR-H2 of SEQ ID NO: 1339, and CDR-H3 of SEQ ID NO: 1881; and/or a variable light chain region, wherein the variable light chain region comprises a complementarity-determining region light chain 1 (CDR-L1) of SEQ ID NO: 1068, CDR-L2 of SEQ ID NO: 1610, and CDR-L3 of SEQ ID NO: 2152. In some embodiments, the variable heavy chain comprises a polypeptide consensus sequence having at least 95% sequence identity to the amino acid sequence of SEQ ID NO: 255, and the variable light chain comprises a polypeptide consensus sequence having at least 95% sequence identity to the amino acid sequence of SEQ ID NO: 526. In some embodiments, the antibody or antigen binding fragment thereof binds a human IVNS1ABP, mouse IVNS1ABP, rat IVNS1ABP, bovine IVNS1ABP, or cynomolgus monkey IVNS1ABP. In some embodiments, the human IVNS1ABP comprises a sequence of SEQ ID NO: 4391.

Provided herein is an antibody that competes with an antibody or antigen binding fragment for binding to IVNS1ABP, wherein the antibody binds to human IVNS1ABP or mouse IVNS1ABP.

Provided herein is an antibody or an antigen binding fragment thereof that selectively binds to cancer/testis antigen 1A (CTAG1A) or a variant thereof, comprising at least one of: a variable heavy chain region, wherein the variable heavy chain region comprises a complementarity-determining region heavy chain 1 (CDR-H1) of SEQ ID NO: 798, CDR-H2 of SEQ ID NO: 1340, and CDR-H3 of SEQ ID NO: 1882; and/or a variable light chain region, wherein the variable light chain region comprises a complementarity-determining region light chain 1 (CDR-L1) of SEQ ID NO: 1069, CDR-L2 of SEQ ID NO: 1611, and CDR-L3 of SEQ ID NO: 2153. In some embodiments, the variable heavy chain comprises a polypeptide consensus sequence having at least 95% sequence identity to the amino acid sequence of SEQ ID NO: 256, and the variable light chain comprises a polypeptide consensus sequence having at least 95% sequence identity to the amino acid sequence of SEQ ID NO: 527. In some embodiments, the antibody or antigen binding fragment thereof binds a human CTAG1A, mouse CTAG1A, rat CTAG1A, bovine CTAG1A, or cynomolgus monkey CTAG1A. In some embodiments, the human CTAG1A comprises a sequence of SEQ ID NO: 4349.

Provided herein is an antibody that competes with an antibody or antigen binding fragment for binding to CTAG1A, wherein the antibody binds to human CTAG1A or mouse CTAG1A.

Provided herein is an antibody or an antigen binding fragment thereof that selectively binds to cancer/testis antigen 1A (CTAG1A) or a variant thereof, comprising at least one of: a variable heavy chain region, wherein the variable heavy chain region comprises a complementarity-determining region heavy chain 1 (CDR-H1) of SEQ ID NO: 802, CDR-H2 of SEQ ID NO: 1344, and CDR-H3 of SEQ ID NO: 1886; and/or a variable light chain region, wherein the variable light chain region comprises a complementarity-determining region light chain 1 (CDR-L1) of SEQ ID NO: 1073, CDR-L2 of SEQ ID NO: 1615, and CDR-L3 of SEQ ID NO: 2157. In some embodiments, the variable heavy chain comprises a polypeptide consensus sequence having at least 95% sequence identity to the amino acid sequence of SEQ ID NO: 260, and the variable light chain comprises a polypeptide consensus sequence having at least 95% sequence identity to the amino acid sequence of SEQ ID NO: 531. In some embodiments, the antibody or antigen binding fragment thereof binds a human CTAG1A, mouse CTAG1A, rat CTAG1A, bovine CTAG1A, or cynomolgus monkey CTAG1A. In some embodiments, the human CTAG1A comprises a sequence of SEQ ID NO: 4349.

Provided herein is an antibody that competes with an antibody or antigen binding fragment for binding to CTAG1A, wherein the antibody binds to human CTAG1A or mouse CTAG1A.

Provided herein is an antibody or an antigen binding fragment thereof that selectively binds to UTP6 small subunit processome component (UTP6) or a variant thereof, comprising at least one of: a variable heavy chain region, wherein the variable heavy chain region comprises a complementarity-determining region heavy chain 1 (CDR-H1) of SEQ ID NO: 803, CDR-H2 of SEQ ID NO: 1345, and CDR-H3 of SEQ ID NO: 1887; and/or a variable light chain region, wherein the variable light chain region comprises a complementarity-determining region light chain 1 (CDR-L1) of SEQ ID NO: 1074, CDR-L2 of SEQ ID NO: 1616, and CDR-L3 of SEQ ID NO: 2158. In some embodiments, the variable heavy chain comprises a polypeptide consensus sequence having at least 95% sequence identity to the amino acid sequence of SEQ ID NO: 261, and the variable light chain comprises a polypeptide consensus sequence having at least 95% sequence identity to the amino acid sequence of SEQ ID NO: 532. In some embodiments, the antibody or antigen binding fragment thereof binds a human UTP6, mouse UTP6, rat UTP6, bovine UTP6, or cynomolgus monkey UTP6. In some embodiments, the human UTP6 comprises a sequence of SEQ ID NO: 4537.

Provided herein is an antibody that competes with an antibody or antigen binding fragment for binding to UTP6, wherein the antibody binds to human UTP6 or mouse UTP6.

Provided herein is an antibody or an antigen binding fragment thereof that selectively binds to cancer/testis antigen 1A (CTAG1A) or a variant thereof, comprising at least one of: a variable heavy chain region, wherein the variable heavy chain region comprises a complementarity-determining region heavy chain 1 (CDR-H1) of SEQ ID NO: 811, CDR-H2 of SEQ ID NO: 1353, and CDR-H3 of SEQ ID NO: 1895; and/or a variable light chain region, wherein the variable light chain region comprises a complementarity-determining region light chain 1 (CDR-L1) of SEQ ID NO: 1082, CDR-L2 of SEQ ID NO: 1624, and CDR-L3 of SEQ ID NO: 2166. In some embodiments, the variable heavy chain comprises a polypeptide consensus sequence having at least 95% sequence identity to the amino acid sequence of SEQ ID NO: 269, and the variable light chain comprises a polypeptide consensus sequence having at least 95% sequence identity to the amino acid sequence of SEQ ID NO: 540. In some embodiments, the antibody or antigen binding fragment thereof binds a human CTAG1A, mouse CTAG1A, rat CTAG1A, bovine CTAG1A, or cynomolgus monkey CTAG1A. In some embodiments, the human CTAG1A comprises a sequence of SEQ ID NO: 4349.

Provided herein is an antibody that competes with an antibody or antigen binding fragment for binding to CTAG1A, wherein the antibody binds to human CTAG1A or mouse CTAG1A.

Provided herein is an antibody or an antigen binding fragment thereof that selectively binds to RP2 activator of ARL3 GTPase (RP2) or a variant thereof, comprising at least one of: a variable heavy chain region, wherein the variable heavy chain region comprises a complementarity-determining region heavy chain 1 (CDR-H1) of SEQ ID NO: 812, CDR-H2 of SEQ ID NO: 1354, and CDR-H3 of SEQ ID NO: 1896; and/or a variable light chain region, wherein the variable light chain region comprises a complementarity-determining region light chain 1 (CDR-L1) of SEQ ID NO: 1083, CDR-L2 of SEQ ID NO: 1625, and CDR-L3 of SEQ ID NO: 2167. In some embodiments, the variable heavy chain comprises a polypeptide consensus sequence having at least 95% sequence identity to the amino acid sequence of SEQ ID NO: 270, and the variable light chain comprises a polypeptide consensus sequence having at least 95% sequence identity to the amino acid sequence of SEQ ID NO: 541. In some embodiments, the antibody or antigen binding fragment thereof binds a human RP2, mouse RP2, rat RP2, bovine RP2, or cynomolgus monkey RP2. In some embodiments, the human RP2 comprises a sequence of SEQ ID NO: 4538.

Provided herein is an antibody that competes with an antibody or antigen binding fragment for binding to RP2, wherein the antibody binds to human RP2 or mouse RP2.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DISCLOSURE OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings of which:

FIG. 1 shows an exemplary scheme of computational pipeline used for identifying immunoglobulin clonotypes.

FIG. 2 demonstrates Multivariate Cox proportional hazards regression analysis for the TCGA-SKCM cohort, with covariates including patient gender, age at diagnosis, tumor stage (TMN system) and the expression of MZB1 and FOXM1 genes. Squares represent the hazard ratio (HR) and the horizontal bars extend from the lower limit to the upper limit of the 95% confidence interval of the estimate of the hazard ratio. The plot also shows the number of considered events (N) and Wald test p-values (p) for the interaction between survival and any covariate.

FIGS. 3A-3J show alignment visualization of 5 individual patients and immunoglobulin sequences. Individual reads obtained from RNA-seq are shown for the 5 selected patients. The aligned germline VDJ segments are shown at the bottom of each track. IGV colors paired-end alignments that deviate from expectations (horizontal colored lines) and the mismatched bases are displayed as vertical lines in darker shades of gray.

FIG. 7 shows assembly visualization of a heavy D segment and contains SEQ ID NOs: 4539-4541.

FIGS. 10A-10L show exemplary antibodies identified using the methods described herein, displaying strong evidence of somatic hypermutation.

Figure 13:
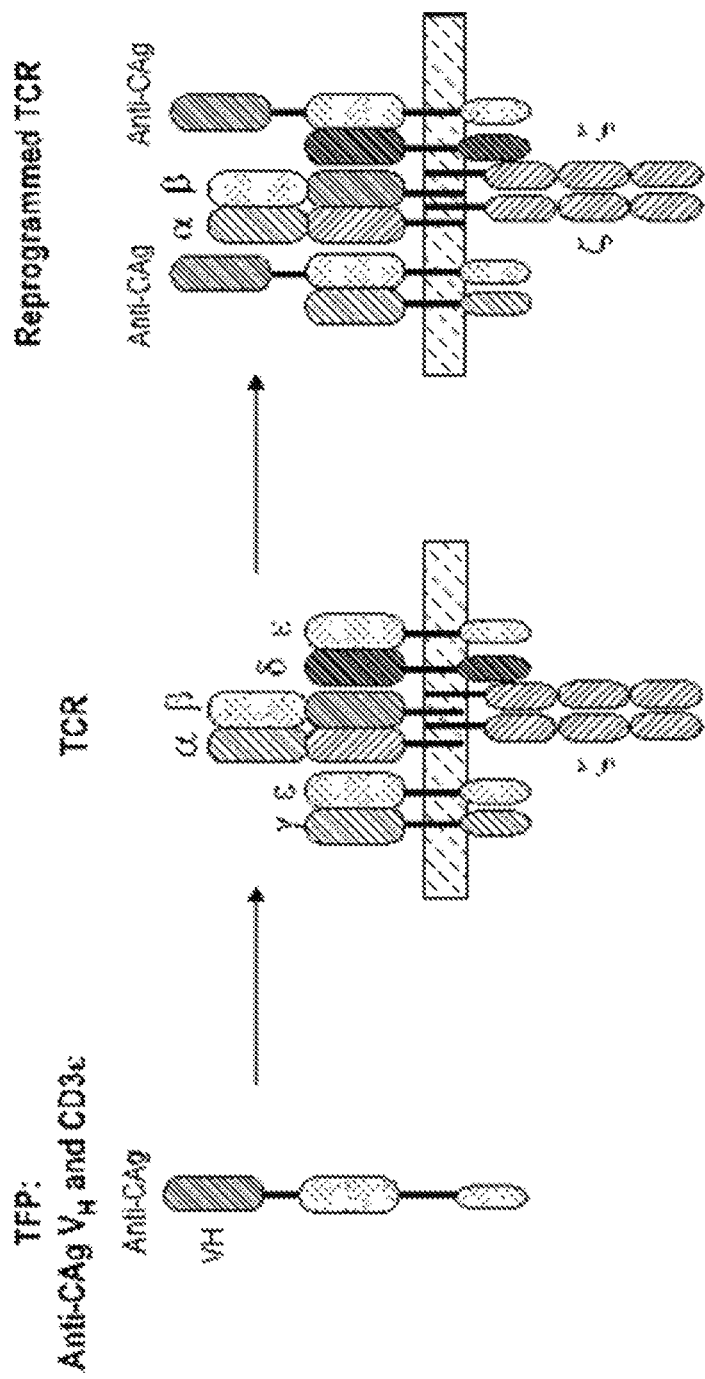

FIG. 13 is a schematic illustration demonstrating the use of T-cell receptor fusion polypeptides (TFPs) of the invention. An exemplary TFP contains an anti-CAg VH domain and a full-length CD3 epsilon polypeptide fused via a (G4S)3 linker sequence. When produced by a T-cell or introduced into a T-cell, the TFP associates with other polypeptides of the endogenous T-cell receptor (TCR) (shown to include two CD3 epsilon polypeptides, one CD3 gamma polypeptide, one CD3 delta polypeptide, two CD3 zeta polypeptides, one TCR alpha subunit and one TCR beta subunit, where the horizontal grey segment represents the plasma membrane) to form a reprogrammed TCR in which one or both of the endogenous CD3 epsilon polypeptides are substituted by the TFP.

Figure 14:
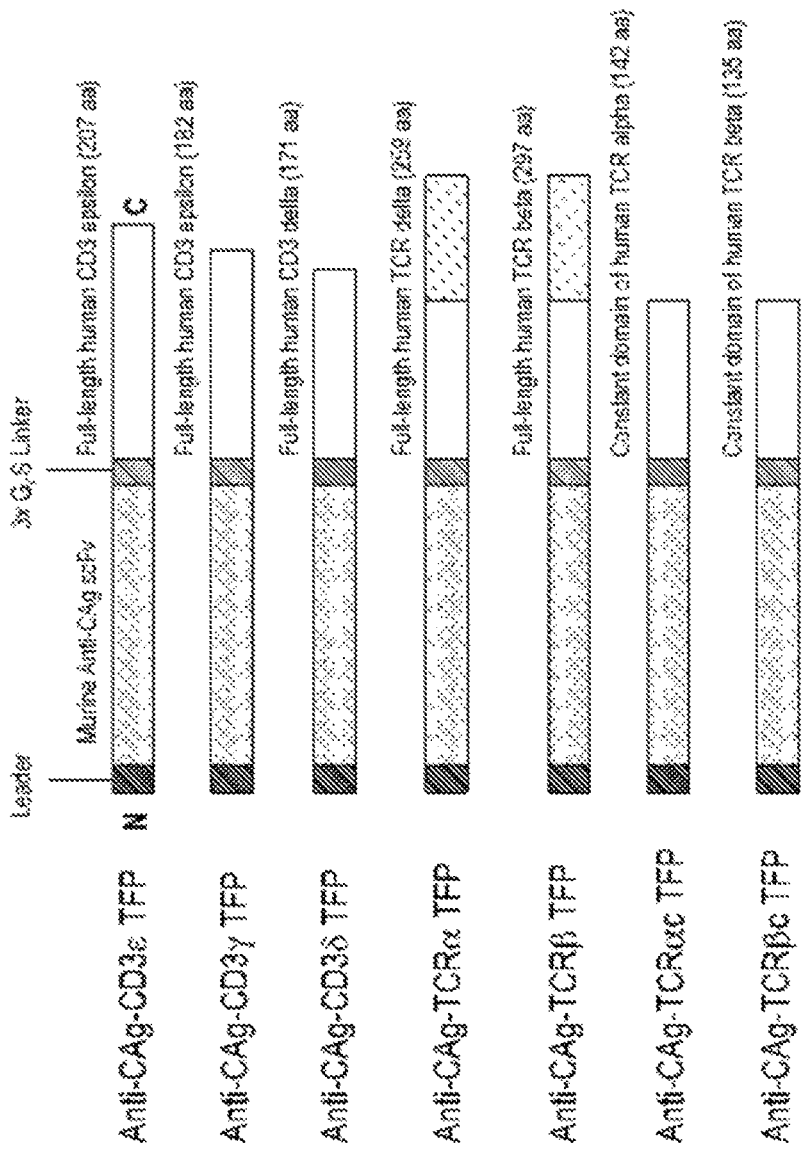

FIG. 14 is a series of schematic illustrations demonstrating DNA constructs encoding various TFPs.

Figure 15:
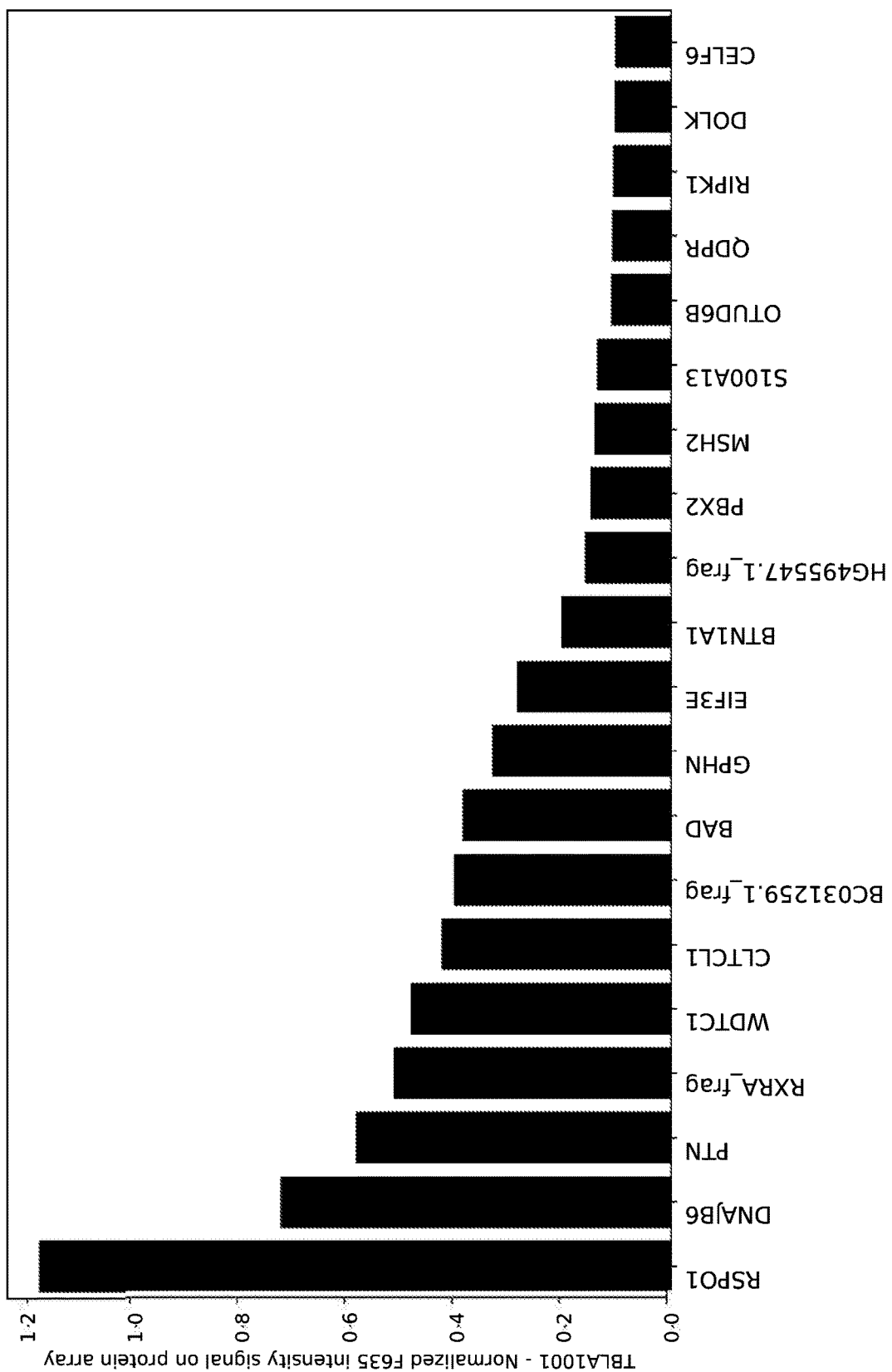

FIG. 15 is protein array data showing specific binding of antigen R-spondin 1, transcript variant 2 by TBLA1001 antibody.

Figure 16:
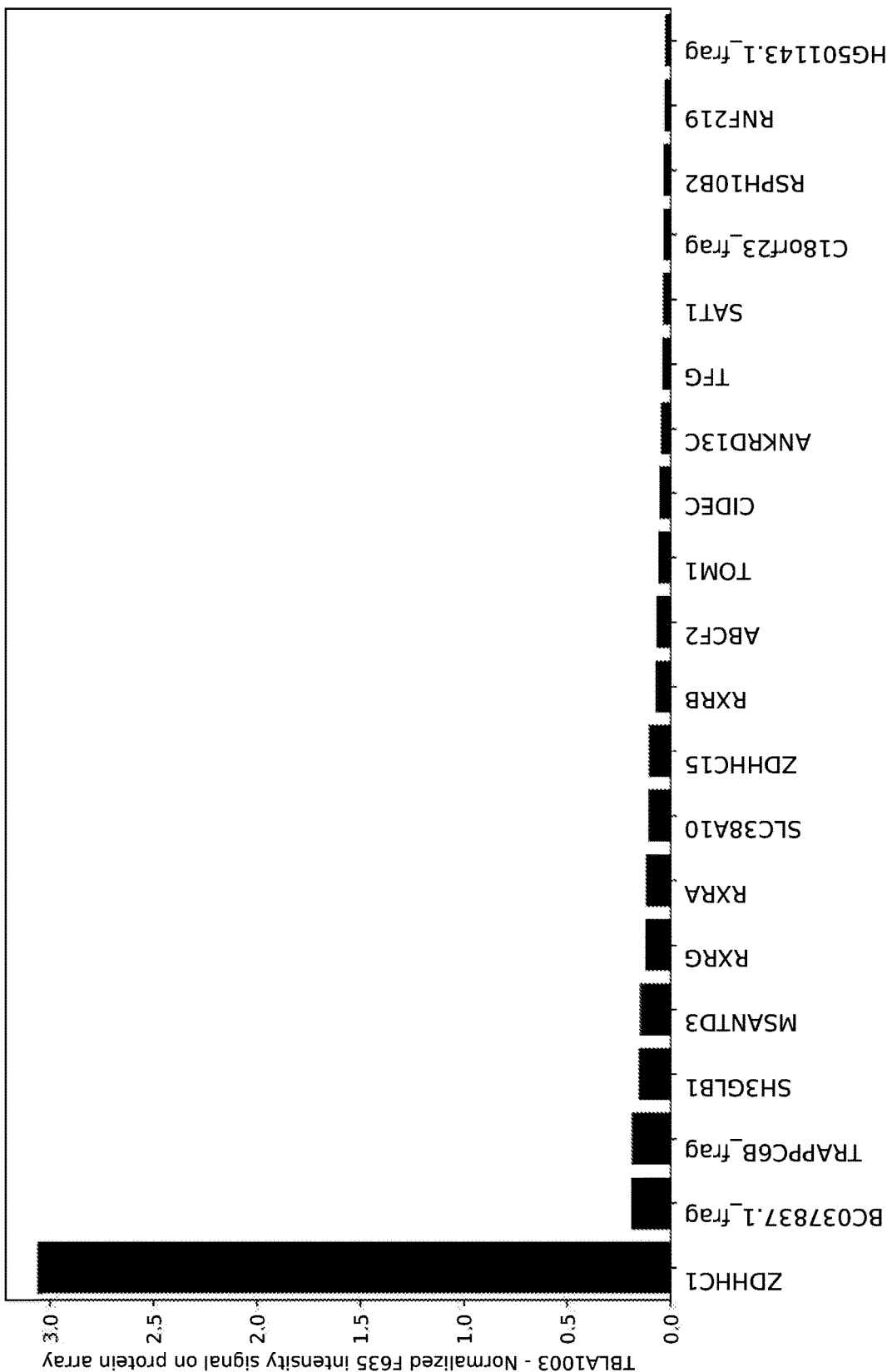

FIG. 16 is protein array data showing specific binding of zinc finger DHHC-type containing 1, transcript variant 1 by TBLA1003 antibody.

Figure 17:
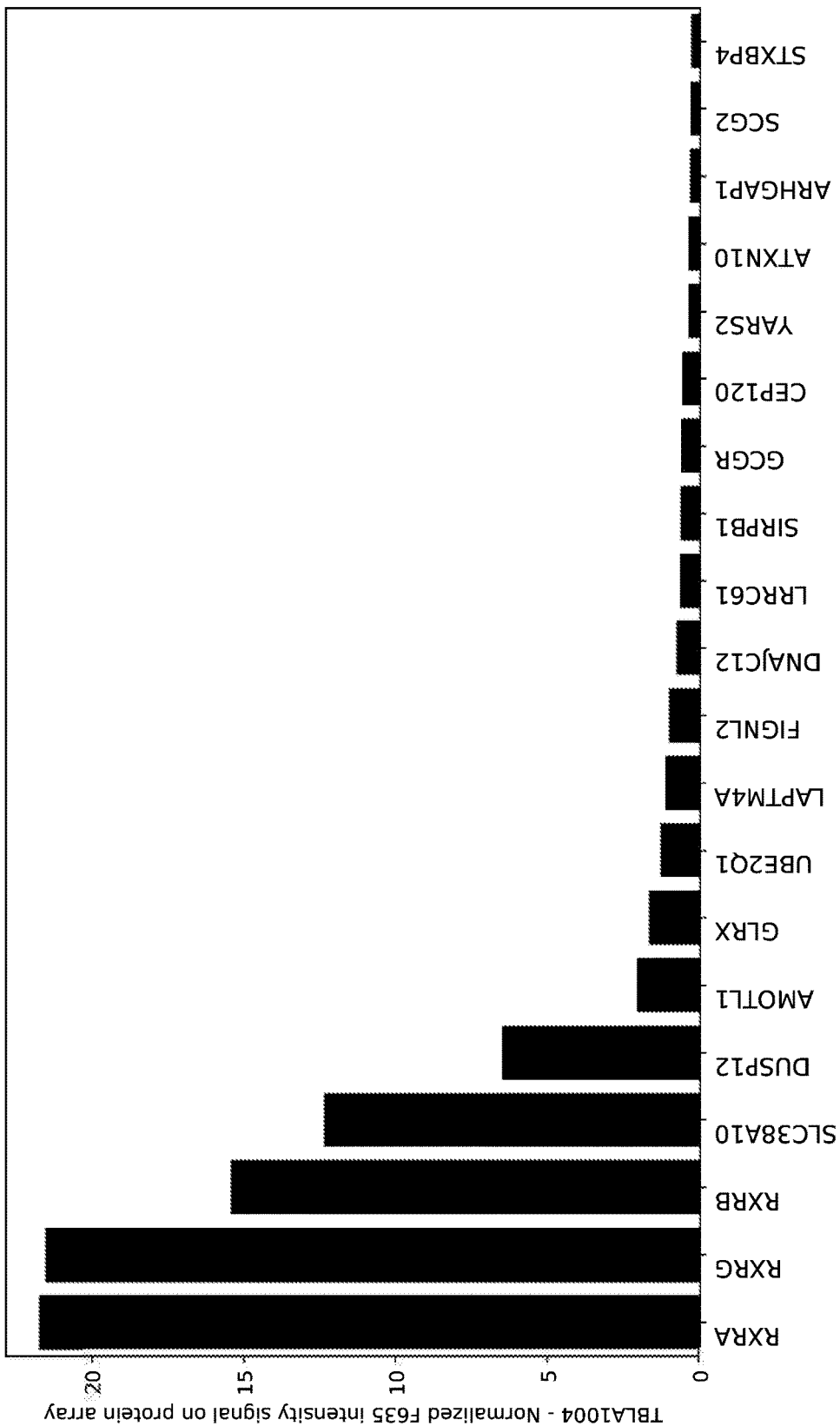

FIG. 17 is protein array data showing specific binding of retinoid X receptor alpha, transcript variant 1, by TBLA1004 antibody.

Figure 18:
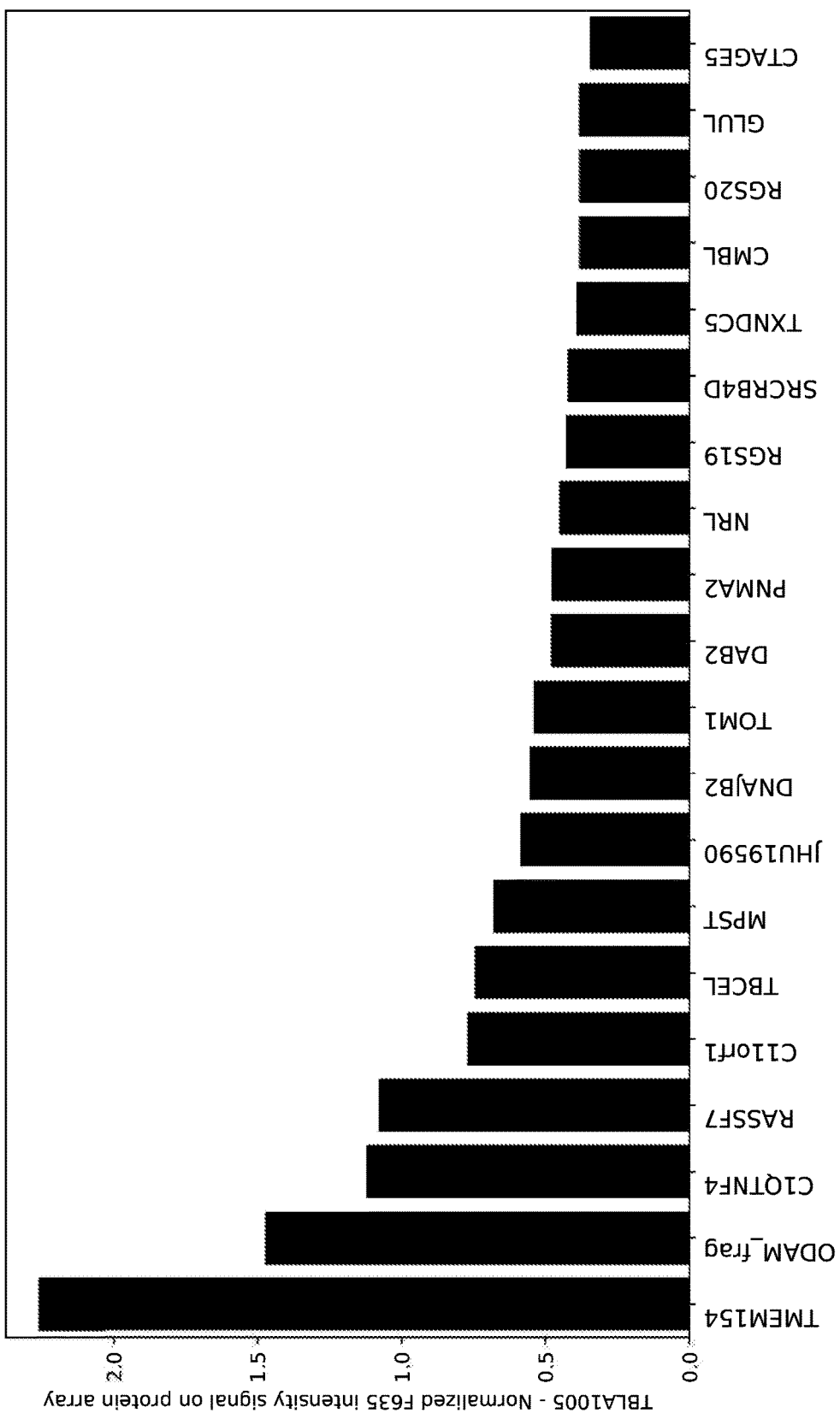

FIG. 18 is protein array data showing specific binding of retinoid X receptor alpha, transcript variant 1, by TBLA1005 antibody.

Figure 19:
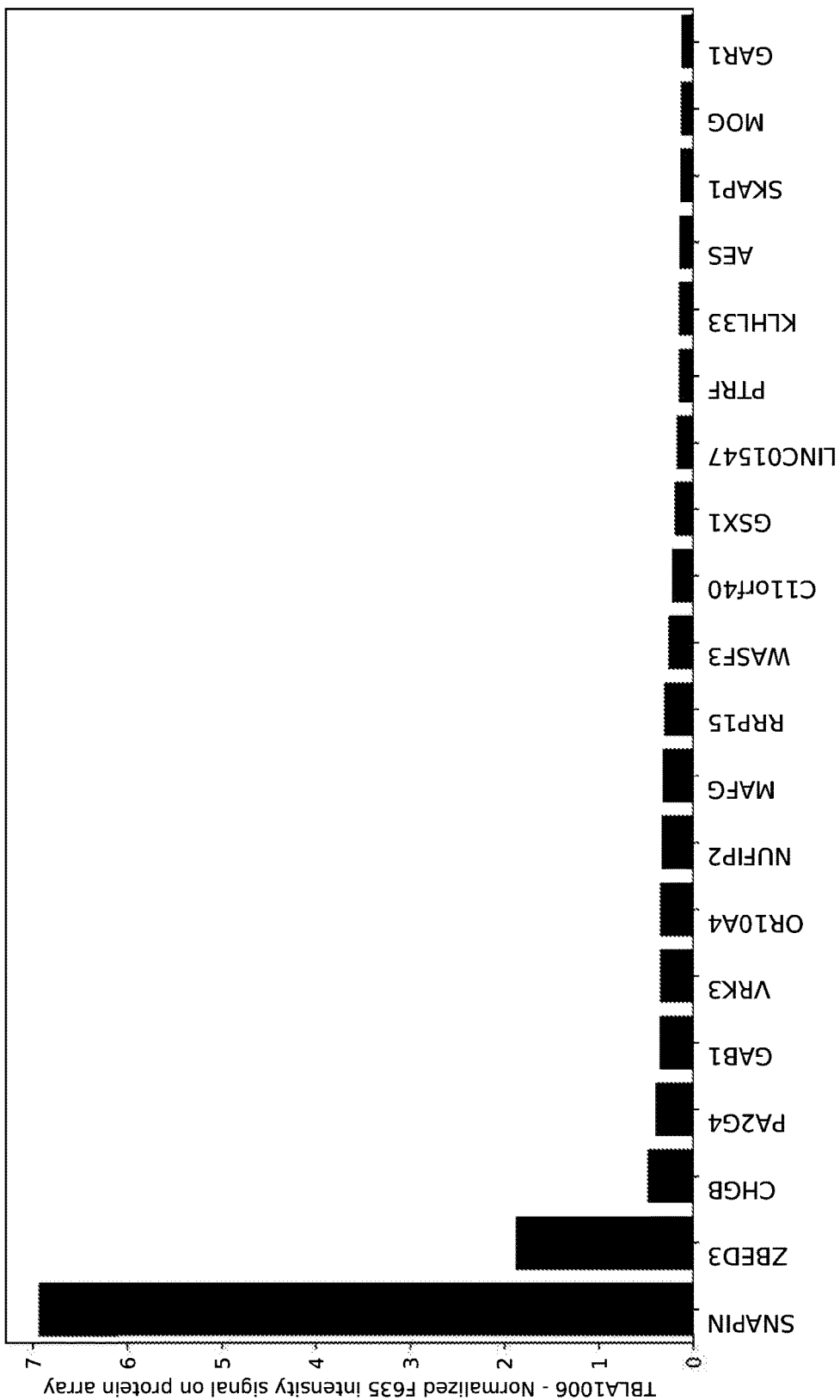

FIG. 19 is protein array data showing specific binding of SNAP associated protein, transcript variant 1, by TBLA1006 antibody.

Figure 20:
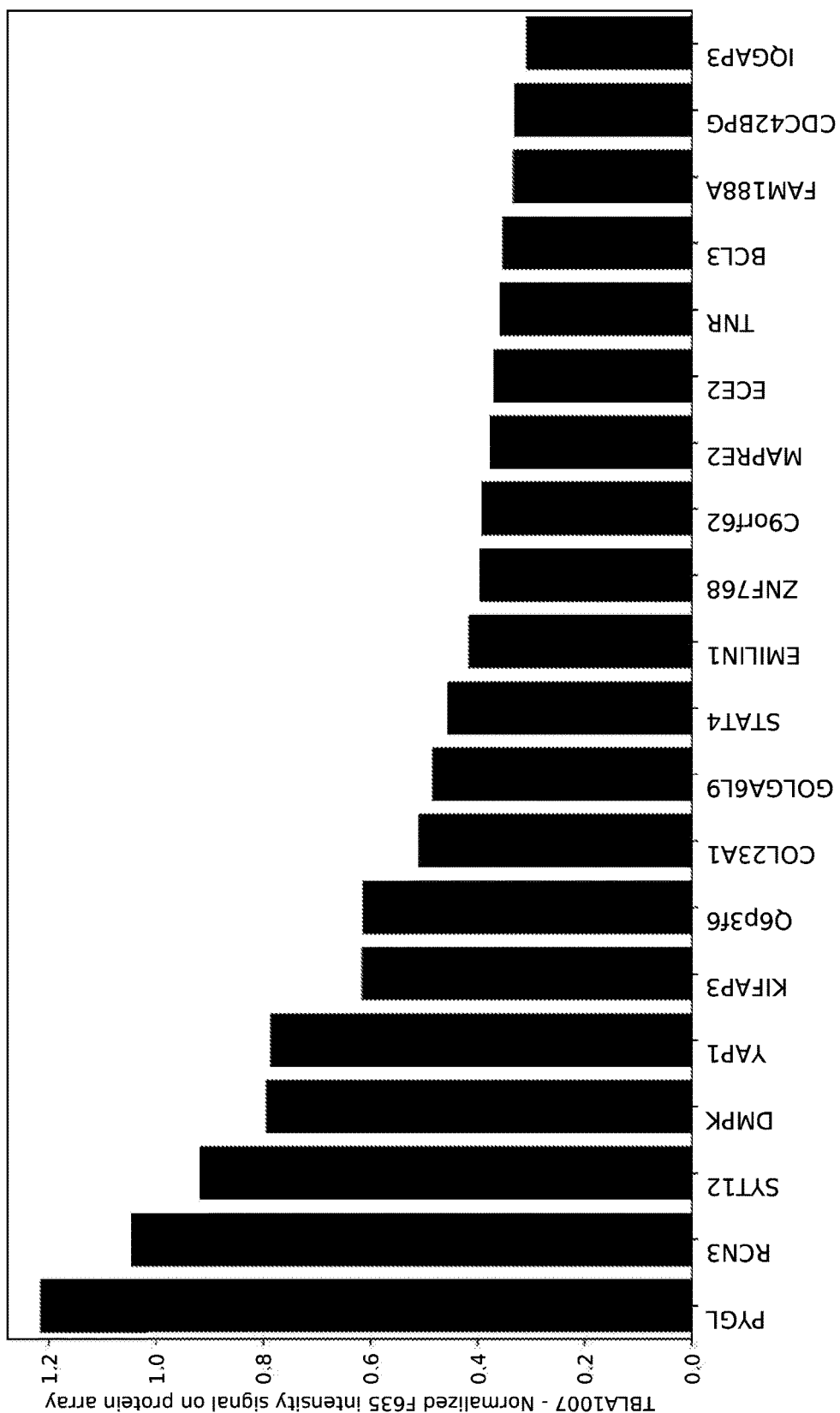

FIG. 20 is protein array data showing specific binding of glycogen phosphorylase L, transcript variant 1, Reticulocalbin 3, and synaptotagmin 12, transcript variant X4 by TBLA1007 antibody.

Figure 21:
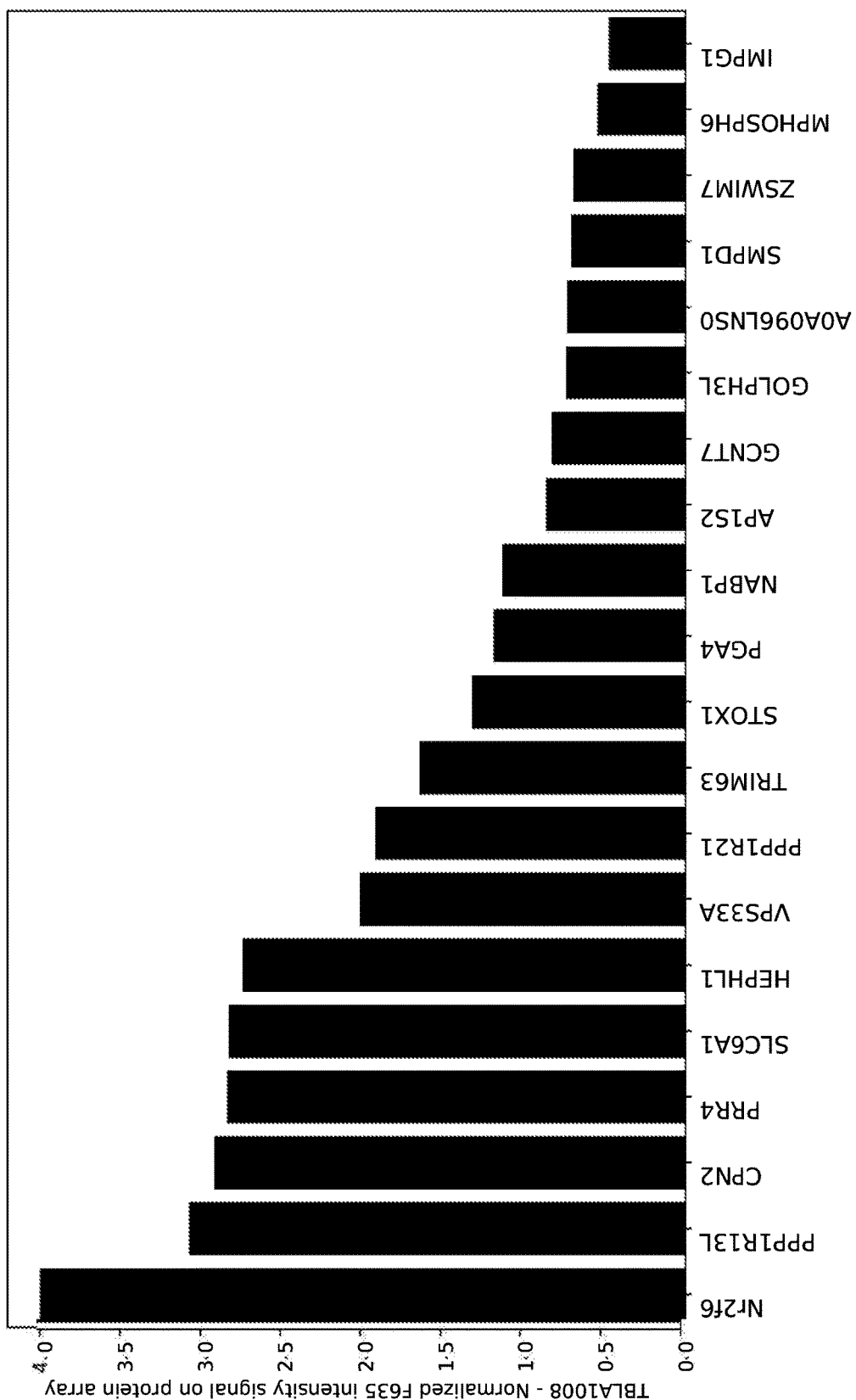

FIG. 21 is protein array data showing specific binding of Nuclear receptor subfamily 2 group f member 6 and protein phosphatase 1 regulatory subunit 13 like, transcript variant 2 by TBLA1008 antibody.

Figure 22:
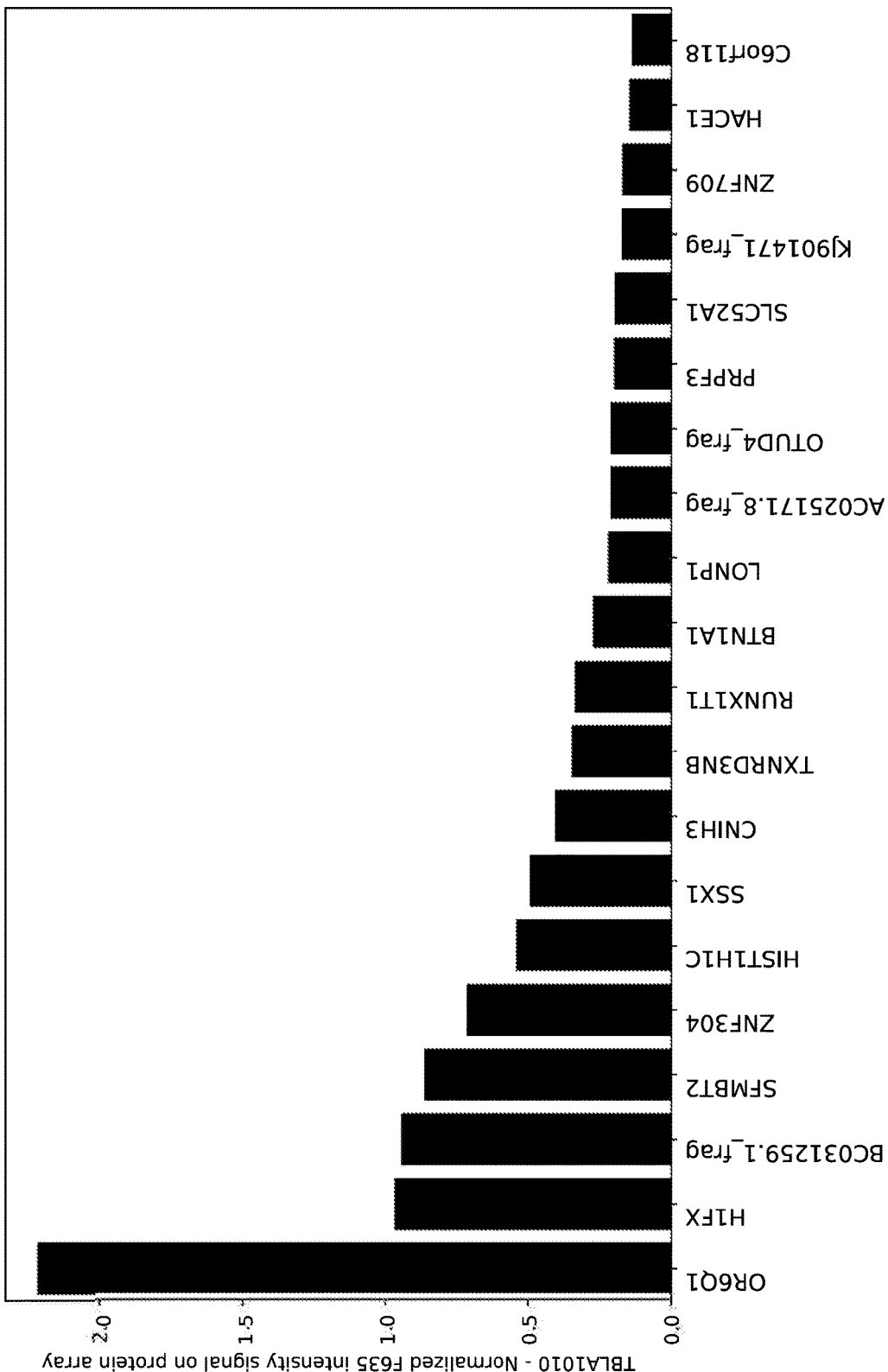

FIG. 22 is protein array data showing specific binding of olfactory receptor family 6 subfamily Q member 1 (gene/pseudogene) by TBLA1010 antibody.

Figure 23:
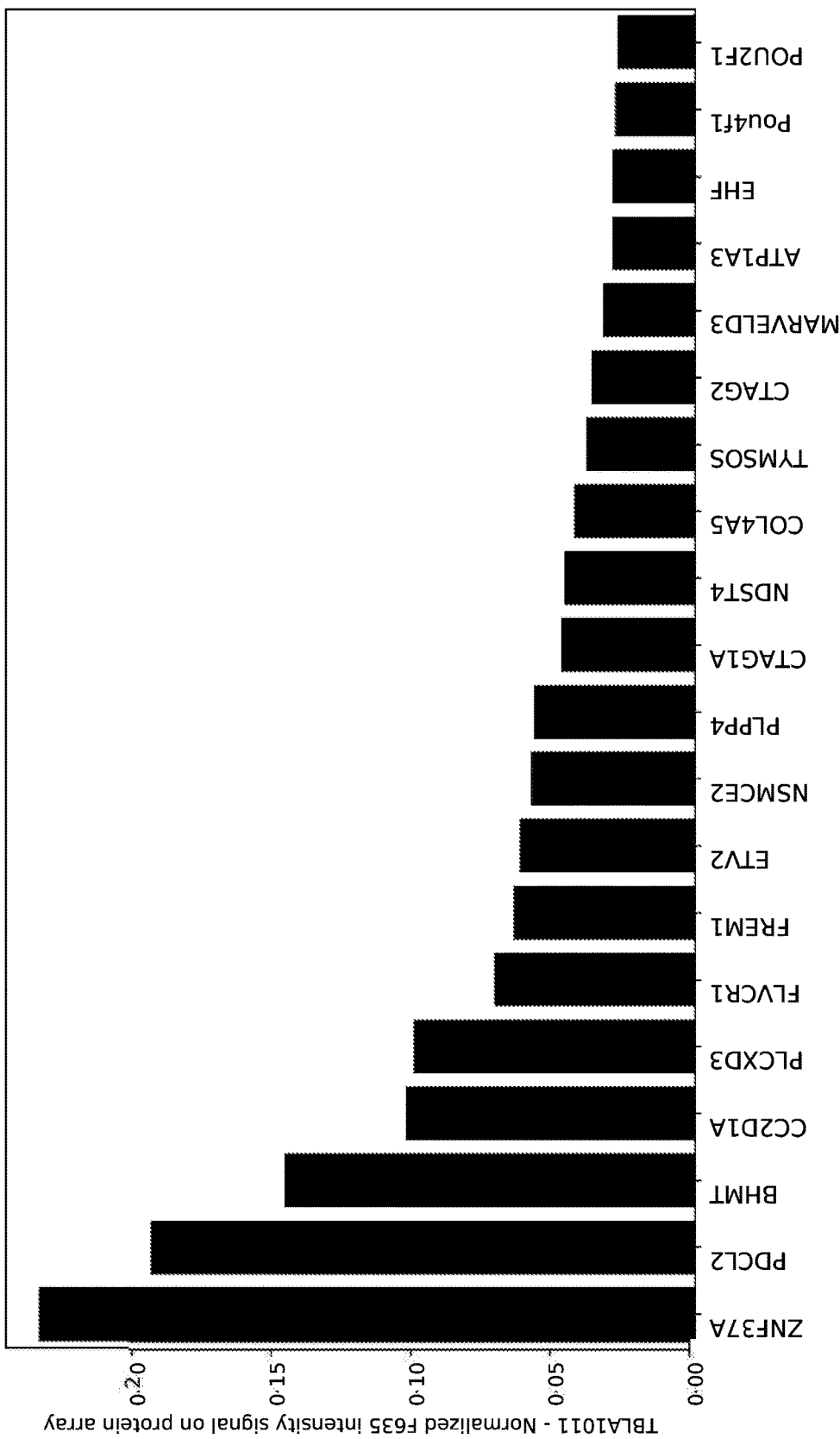

FIG. 23 is protein array data showing specific binding of cancer/testis antigen 1A by TBLA1011 antibody.

Figure 24:
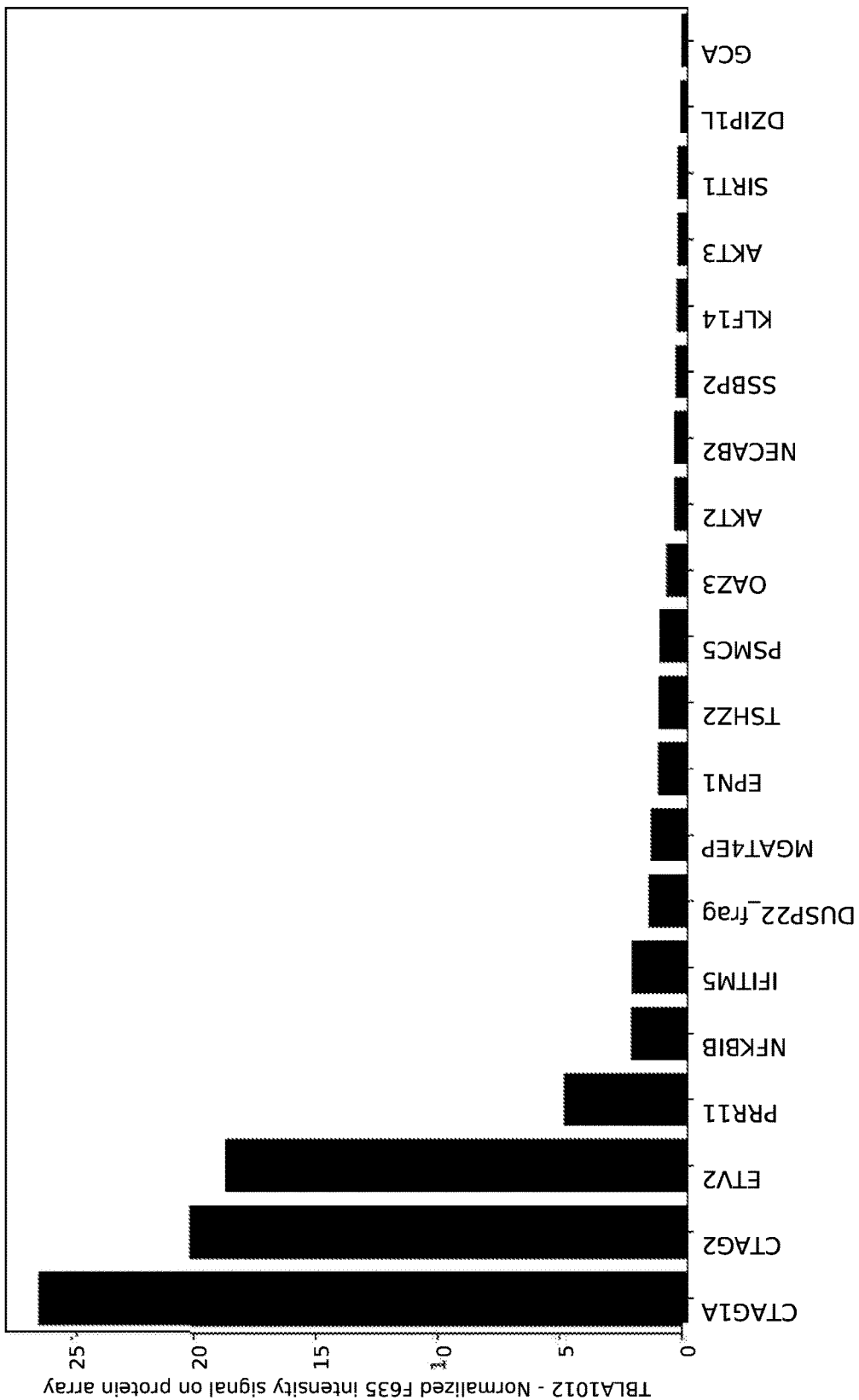

FIG. 24 is protein array data showing specific binding of cancer/testis antigen 1A by TBLA1012 antibody.

Figure 25:
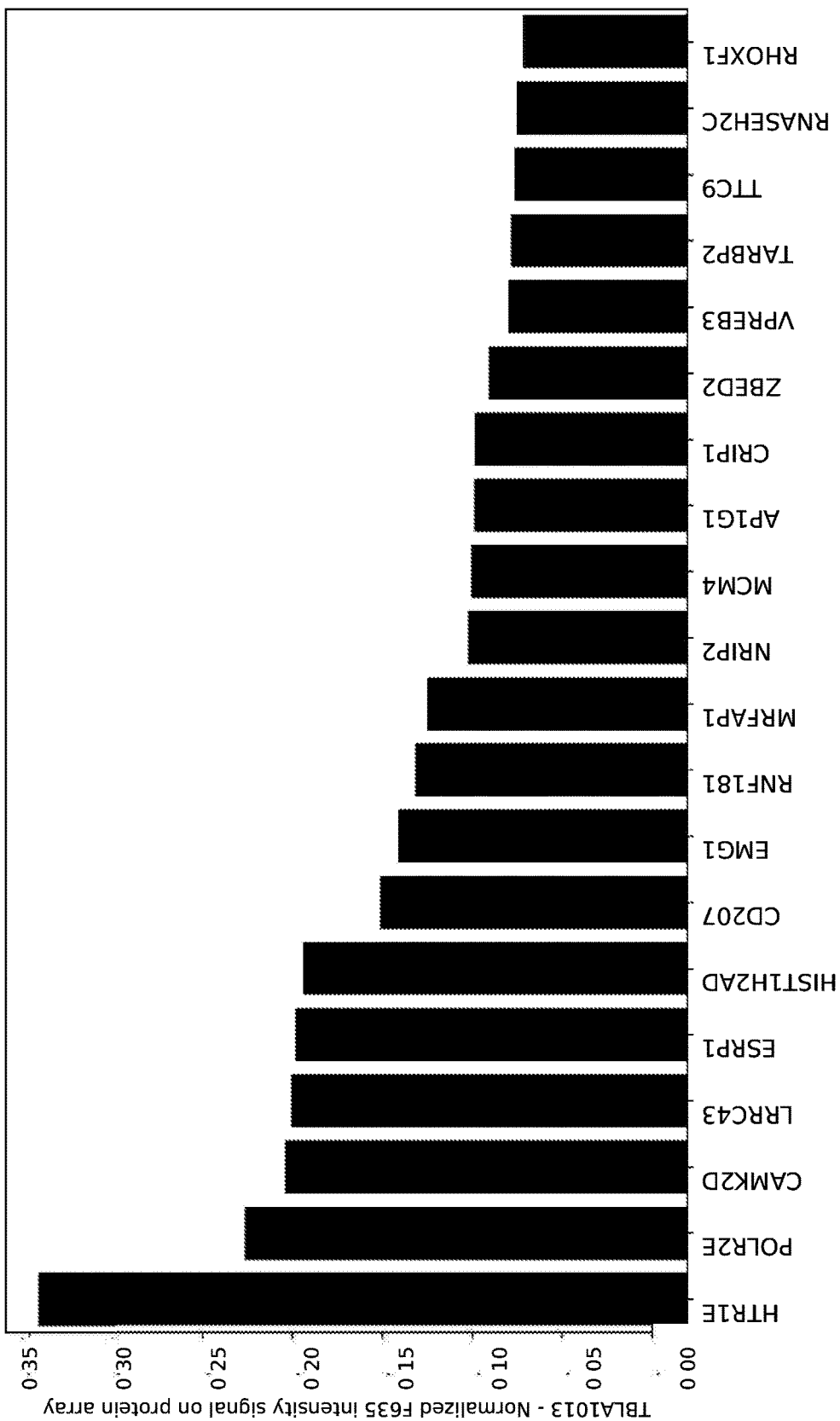

FIG. 25 is protein array data showing specific binding of 5-hydroxytryptamine receptor 1E by TBLA1013 antibody.

Figure 26:
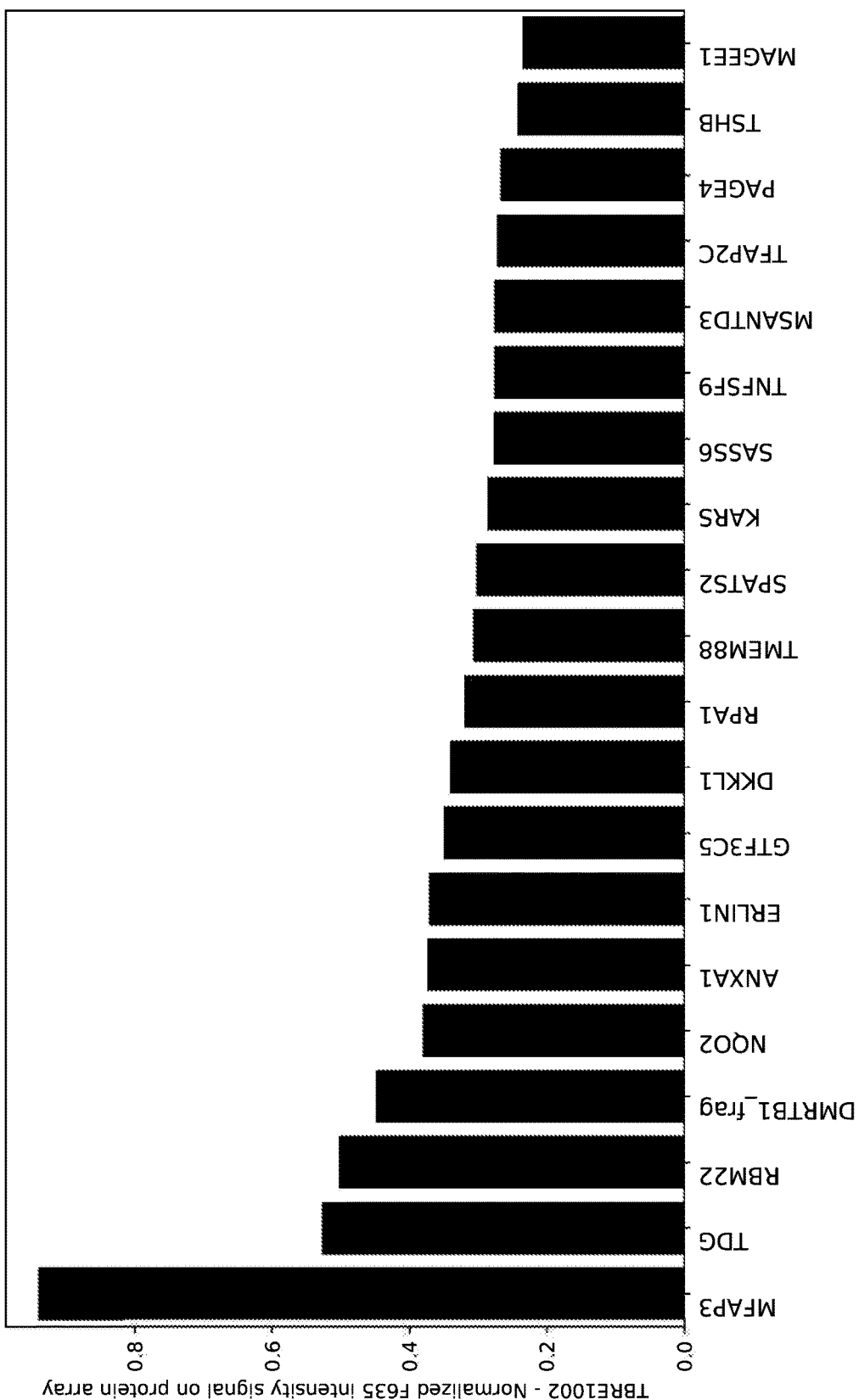

FIG. 26 is protein array data showing specific binding of microfibril associated protein 3, transcript variant 3 by TBRE1002 antibody.

Figure 27:
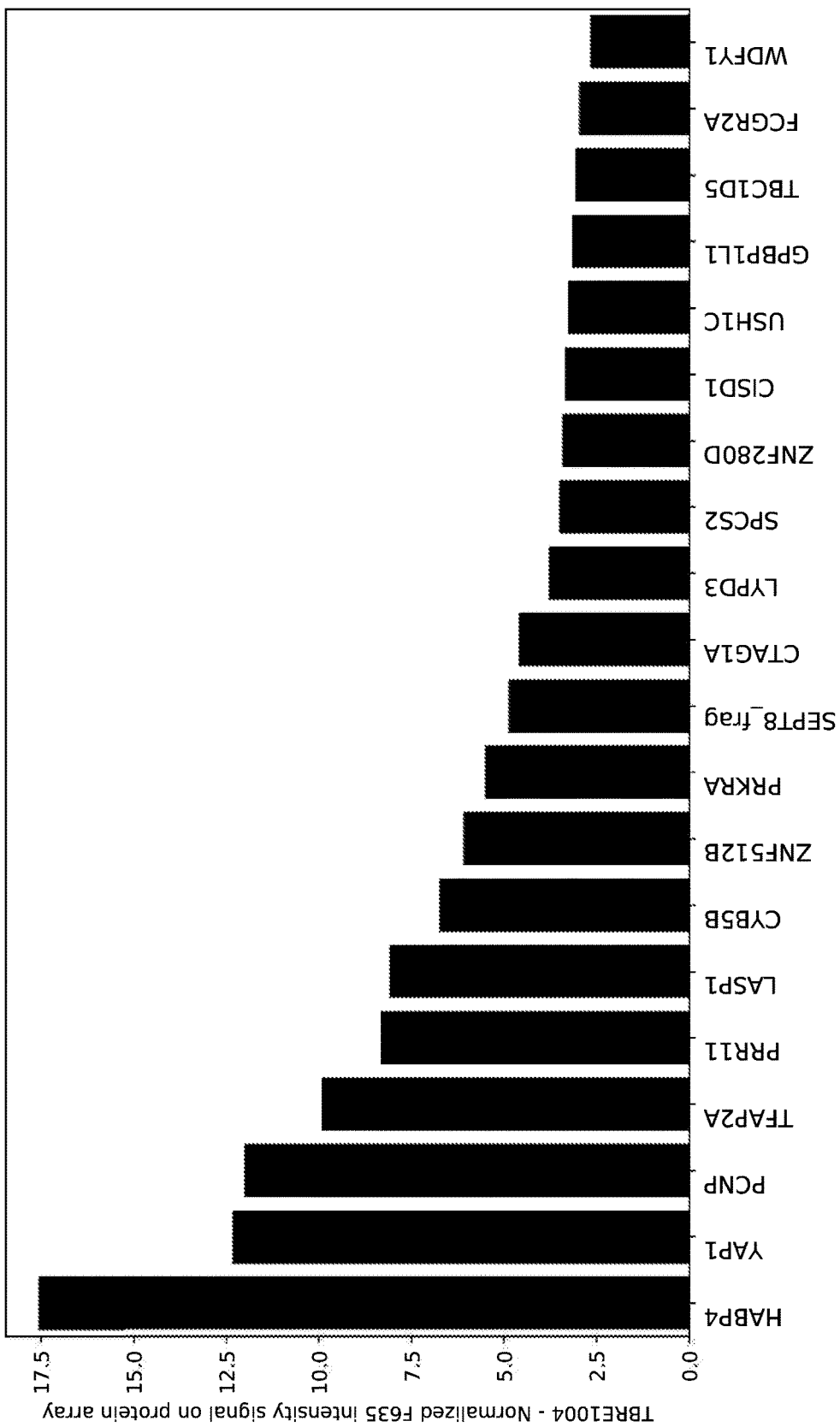

FIG. 27 is protein array data showing specific binding of hyaluronan binding protein 4 by TBRE1004 antibody.

Figure 28:
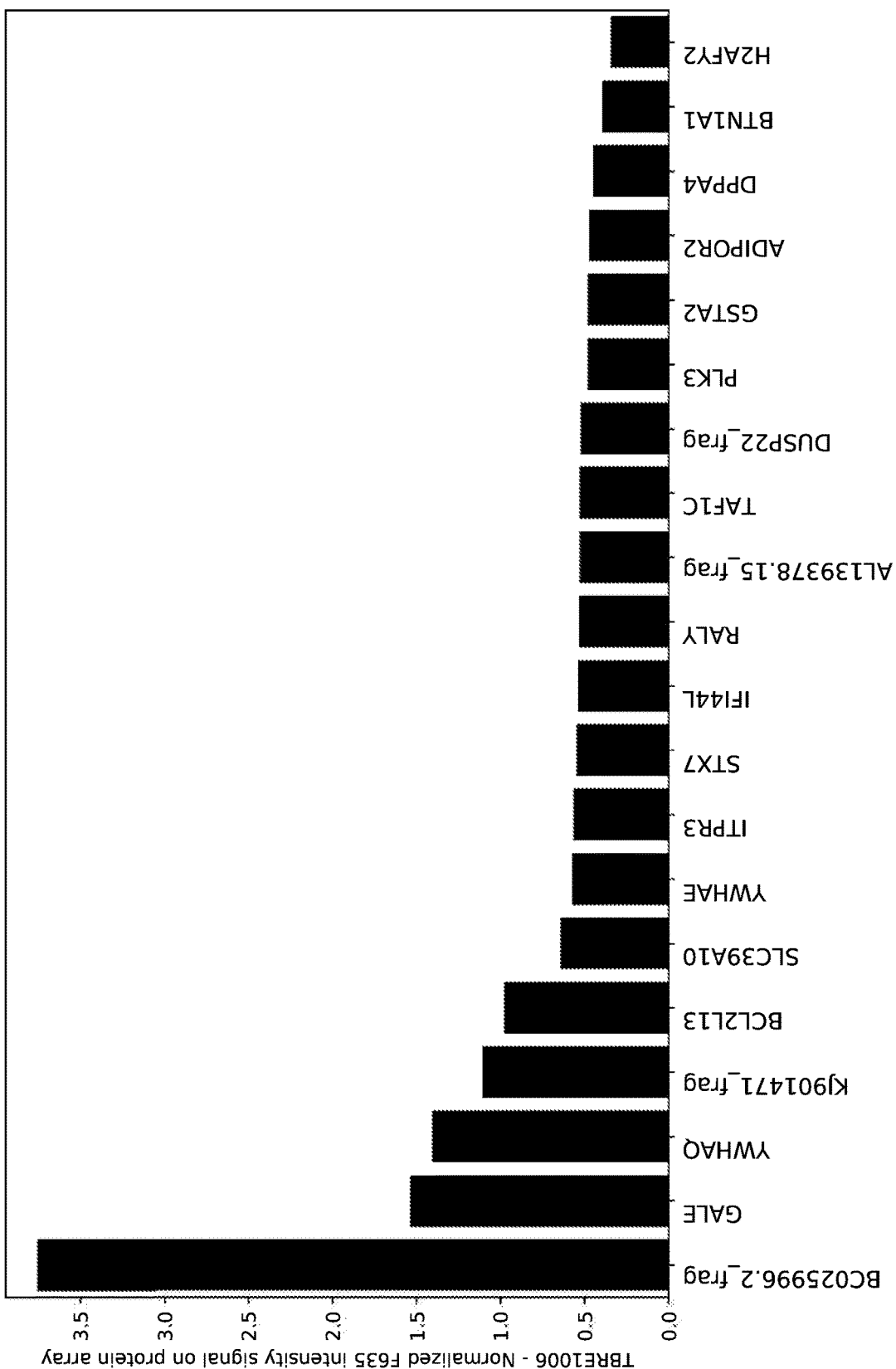

FIG. 28 is protein array data showing specific binding of glucuronidase, beta pseudogene by TBRE1006 antibody.

Figure 29:
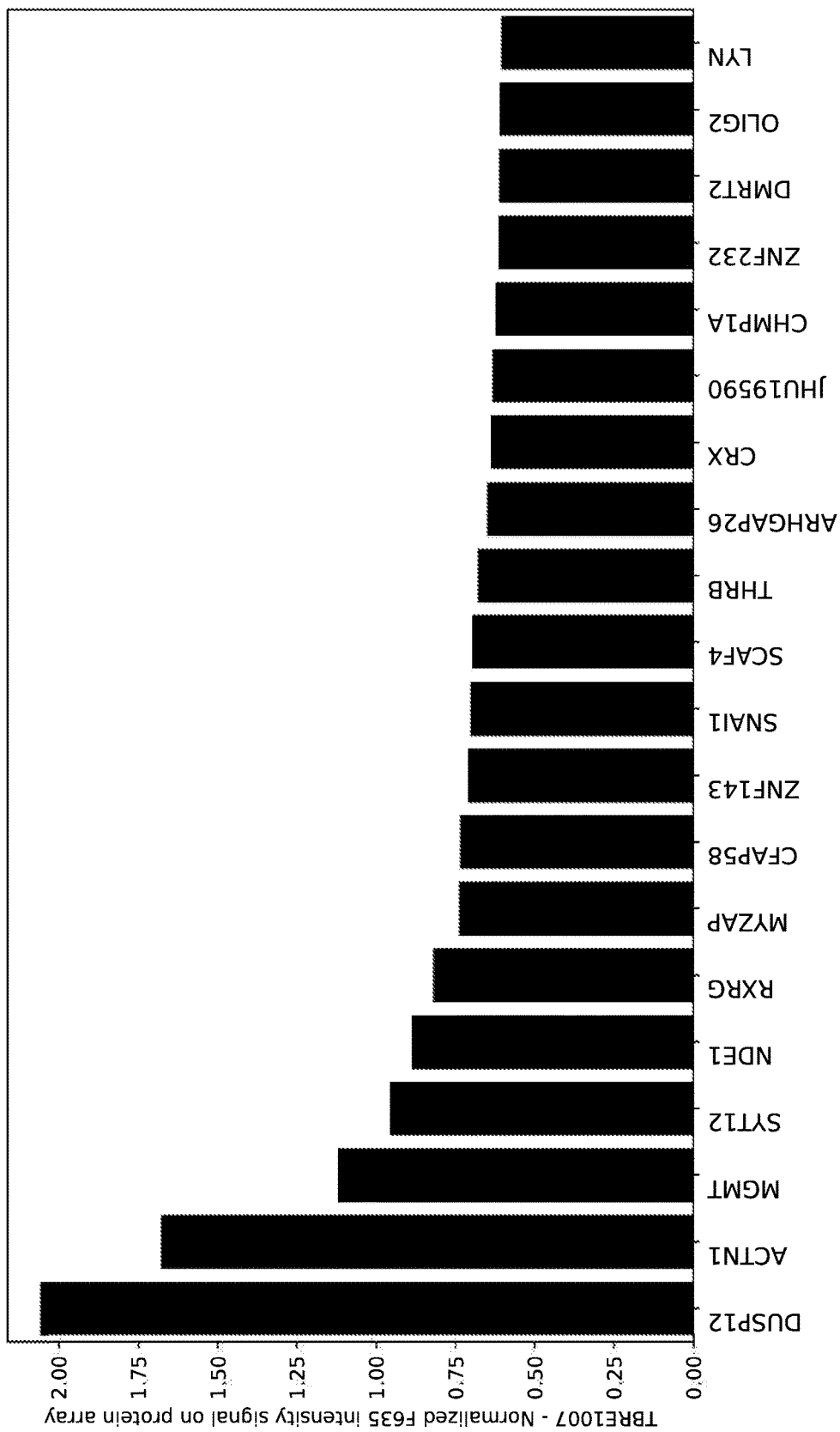

FIG. 29 is protein array data showing specific binding of dual specificity phosphatase 12 and actinin alpha 1, transcript variant 2 by TBRE1007 antibody.

Figure 30:
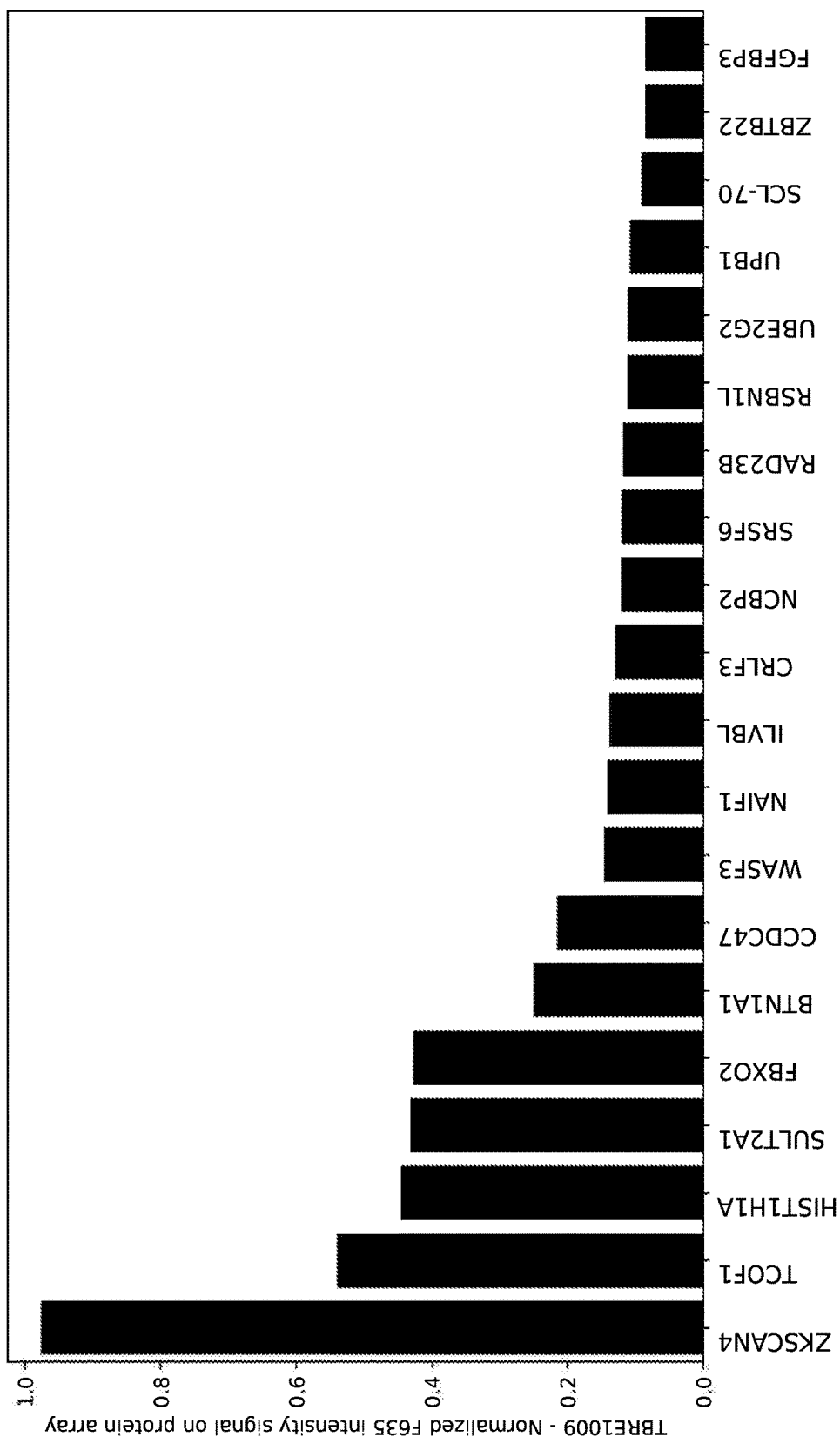

FIG. 30 is protein array data showing specific binding of zinc finger with KRAB and SCAN domains 4, transcript variant X1 by TBRE1009 antibody.

Figure 31:
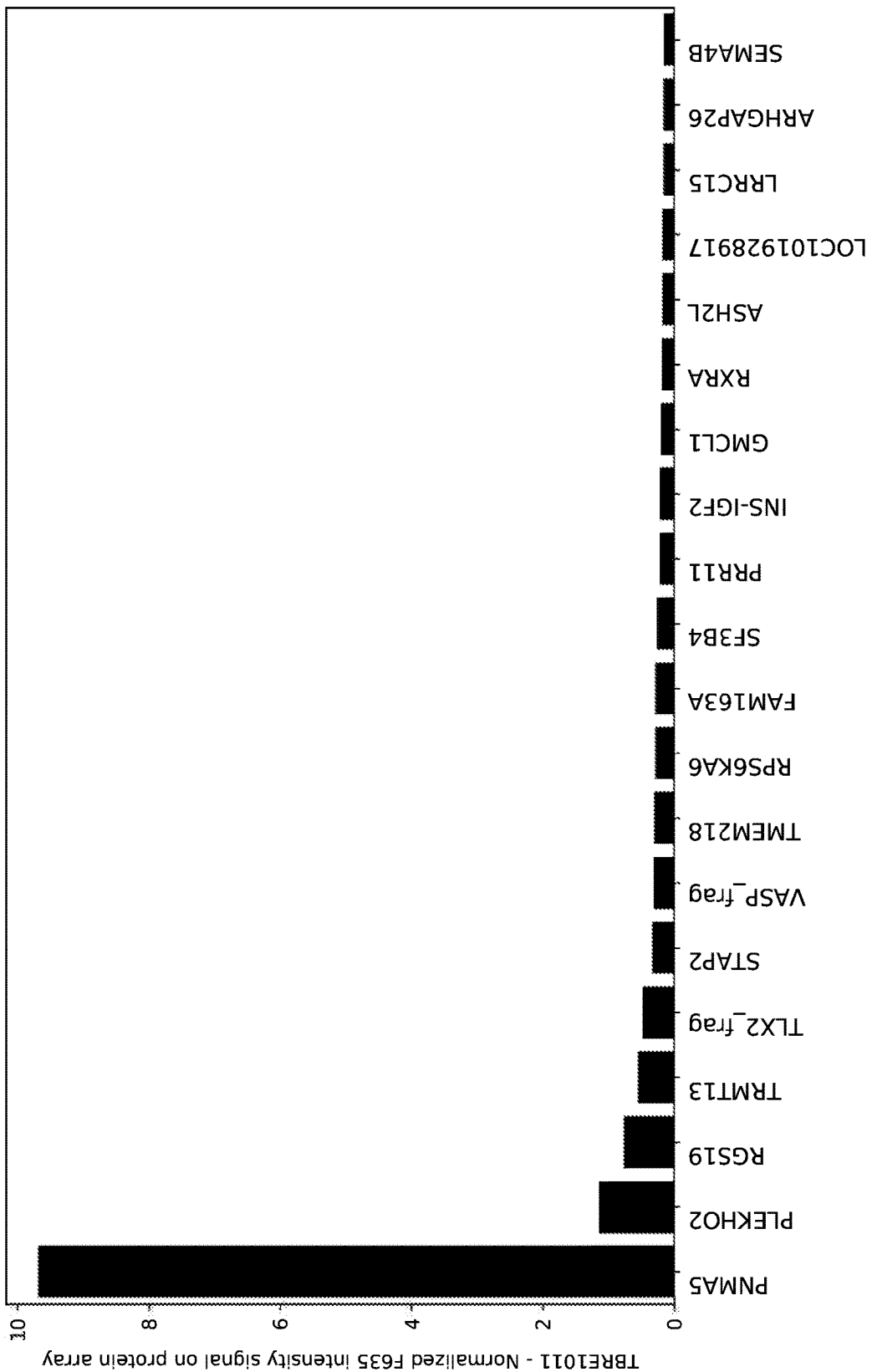

FIG. 31 is protein array data showing specific binding of PNMA family member 5, transcript variant 2 by TBRE1011 antibody.

Figure 32:
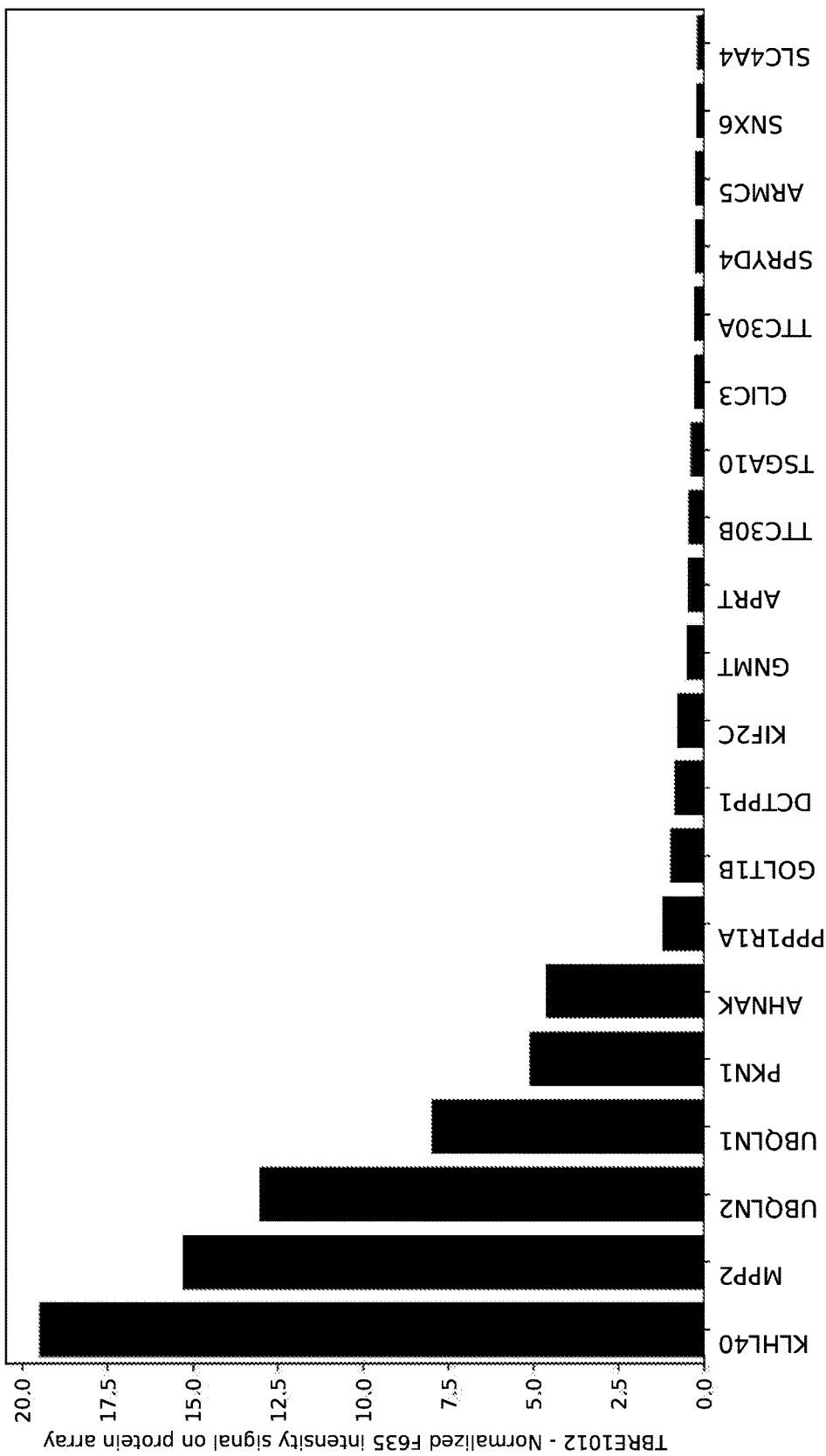

FIG. 32 is protein array data showing specific binding of kelch like family member 40, and membrane palmitoylated protein 2, transcript variant 3 by TBRE1012 antibody.

Figure 33:
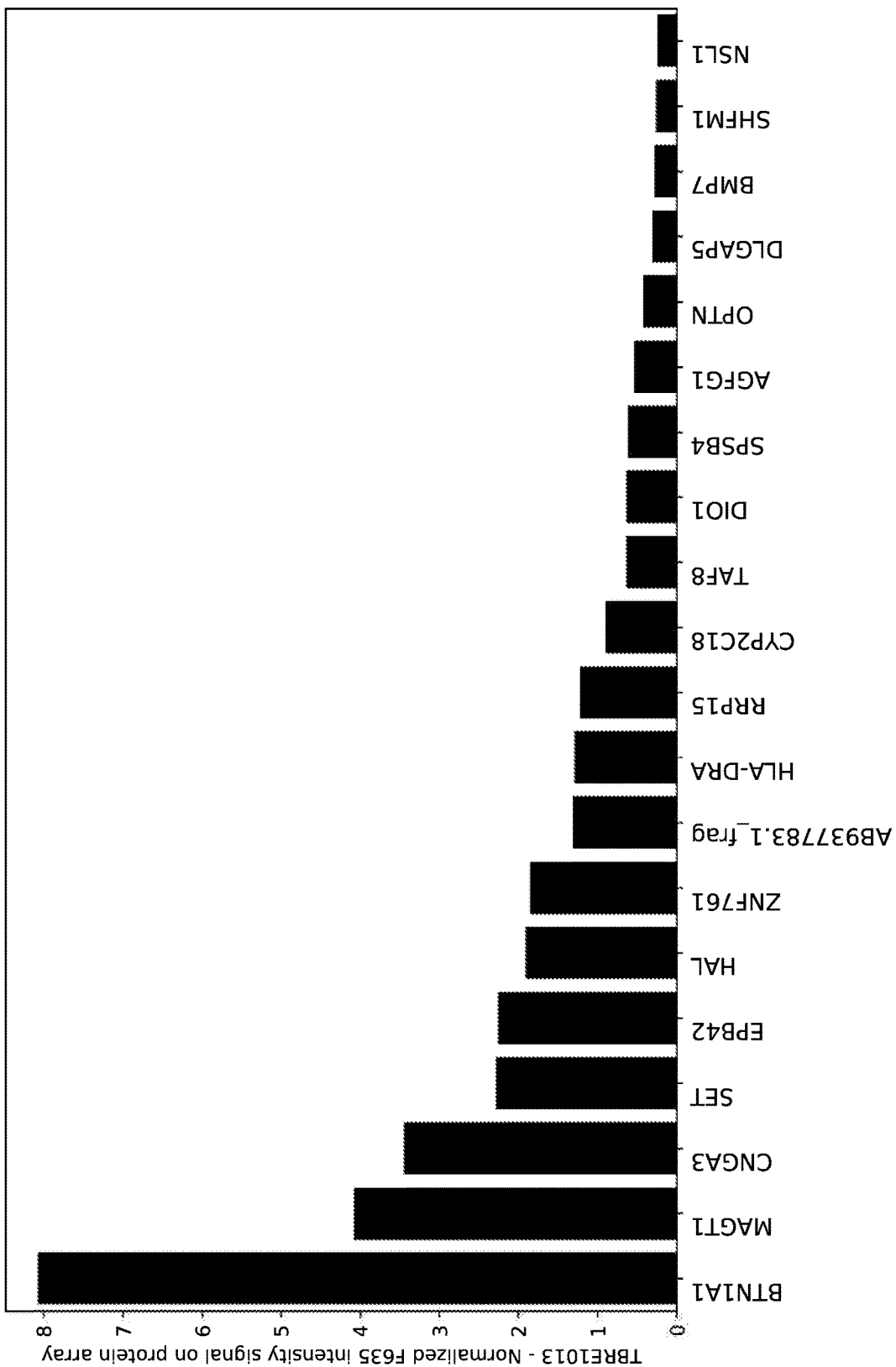

FIG. 33 is protein array data showing specific binding of butyrophilin subfamily 1 member A1 by TBRE1013 antibody.

Figure 34:
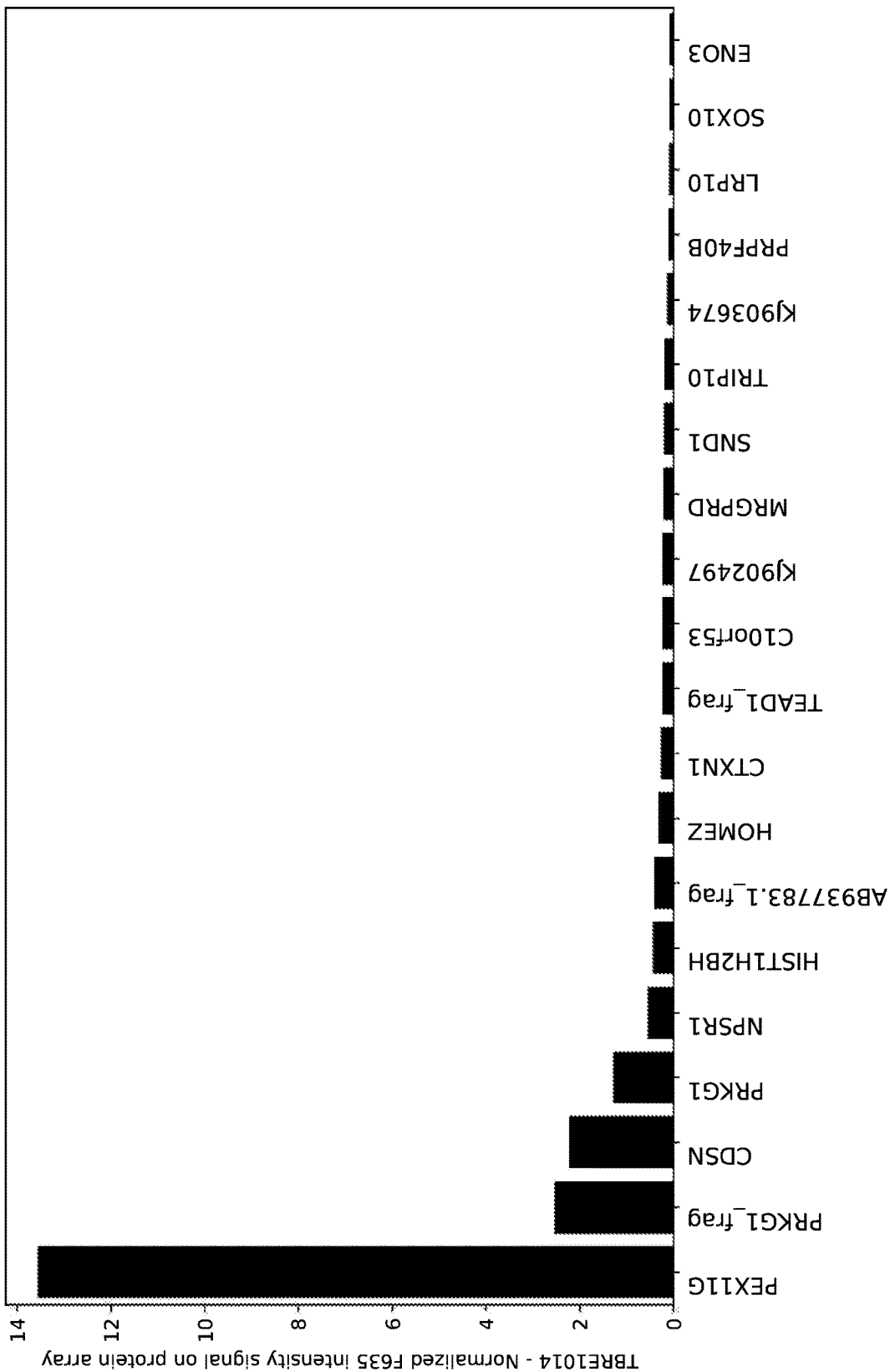

FIG. 34 is protein array data showing specific binding of peroxisomal biogenesis factor 11 gamma, transcript variant 1 by TBRE1014 antibody.

Figure 35:
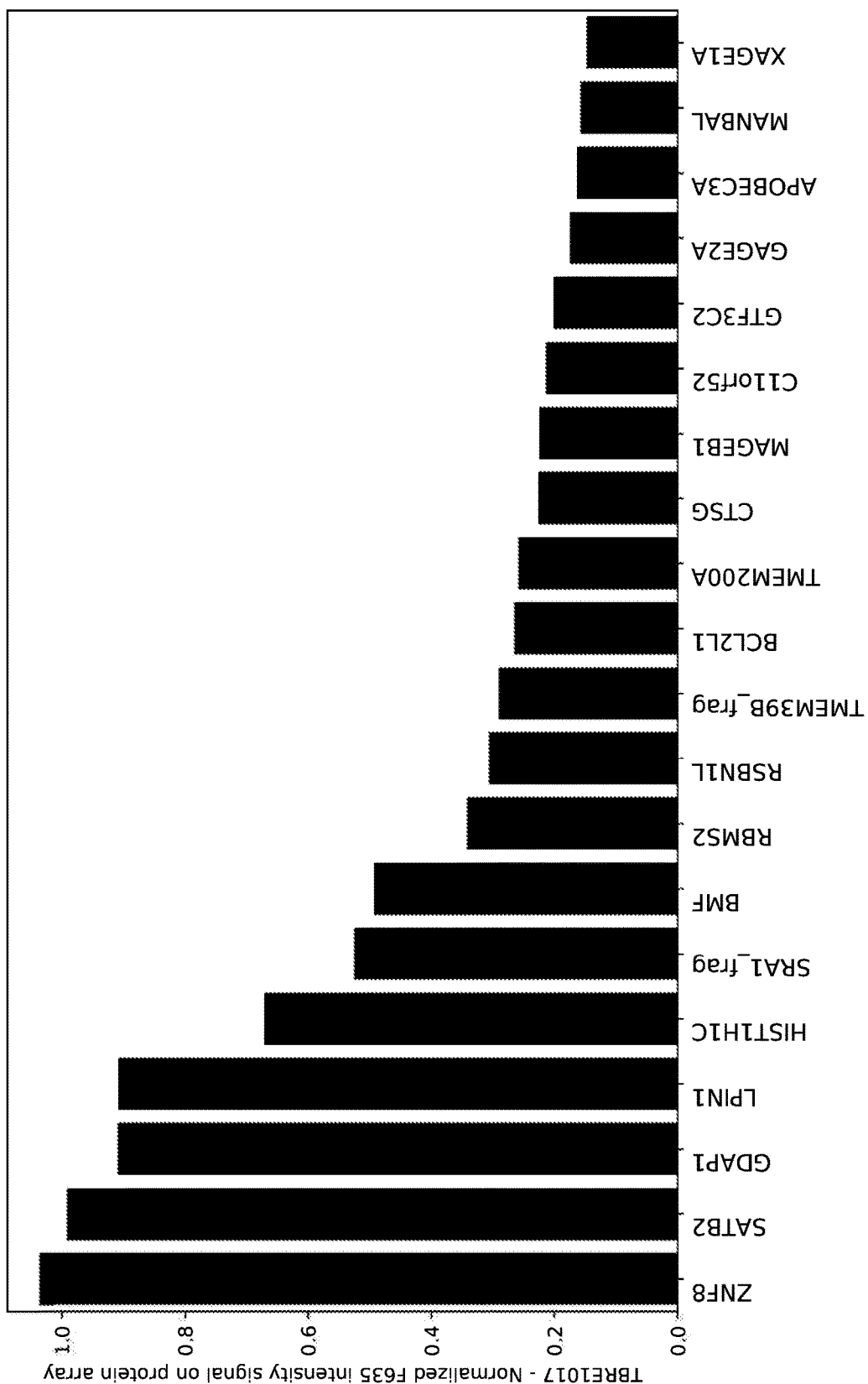

FIG. 35 is protein array data showing specific binding of zinc finger protein 8, SATB homeobox 2 transcript variant 2, and ganglioside induced differentiation associated protein 1 transcript variant 2 by TBRE1017 antibody.

Figure 36:
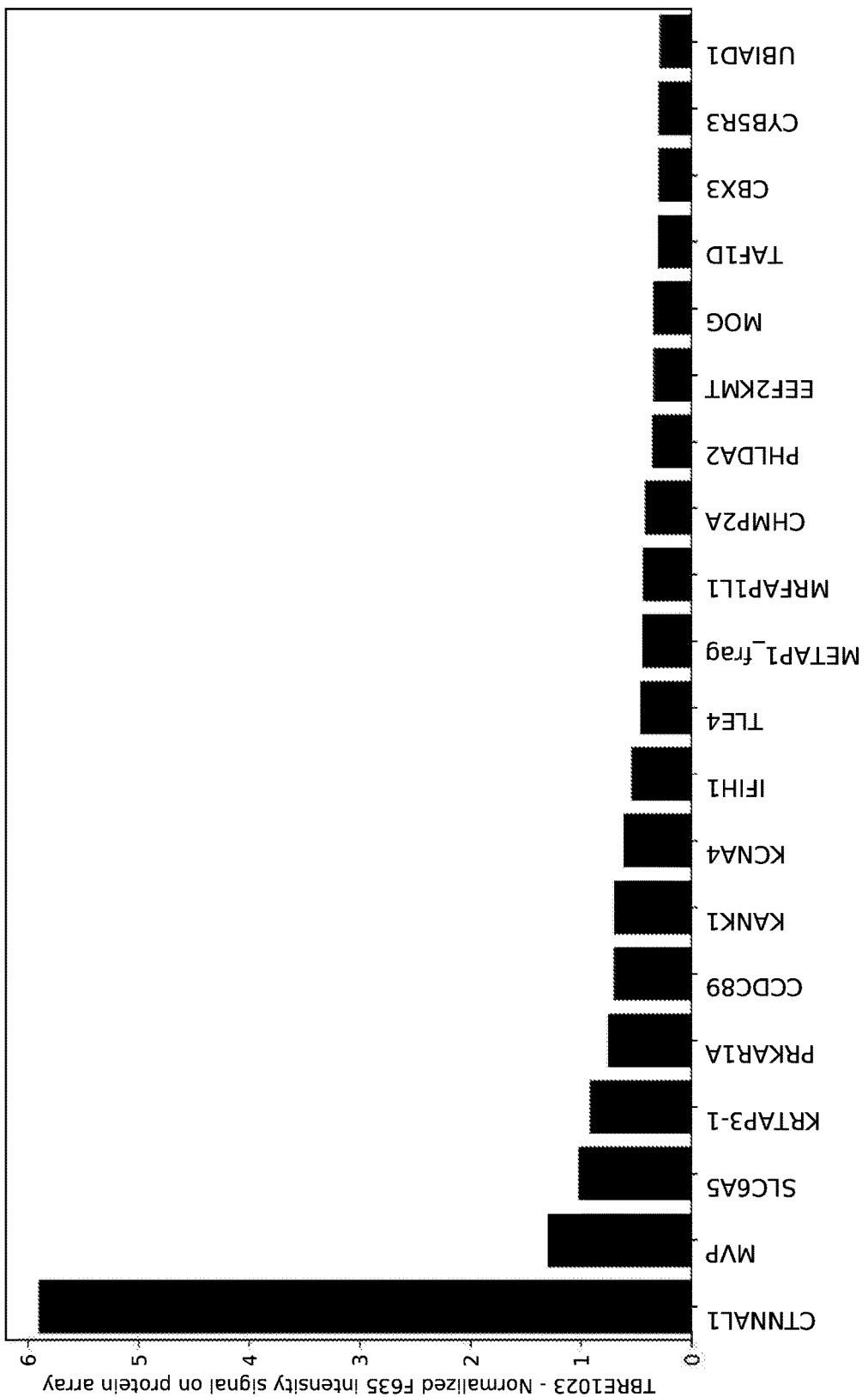

FIG. 36 is protein array data showing specific binding of catenin alpha like 1, transcript variant 1 by TBRE1023 antibody.

Figure 37:
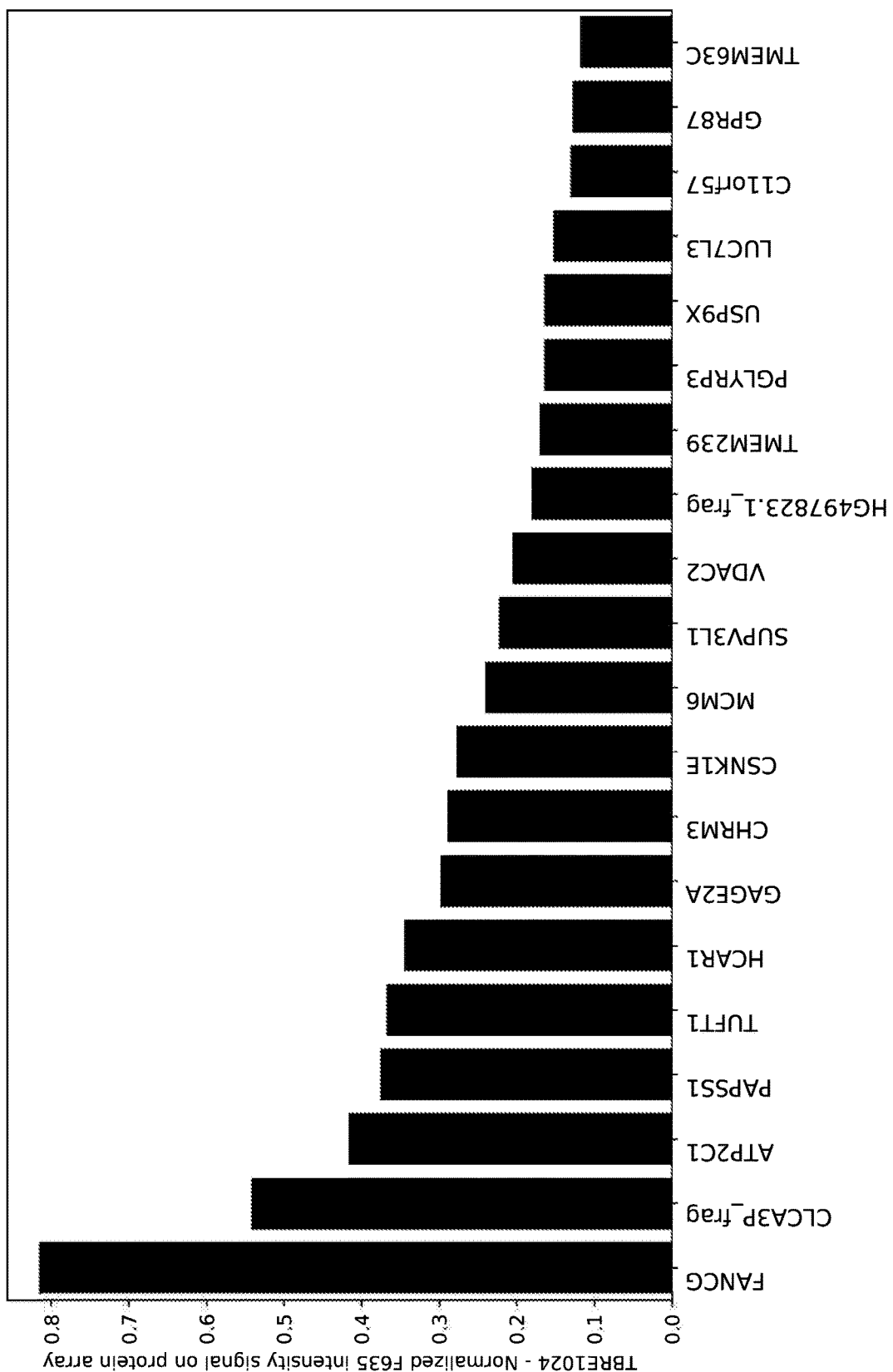

FIG. 37 is protein array data showing specific binding of FA complementation group G by TBRE1024 antibody.

Figure 38:
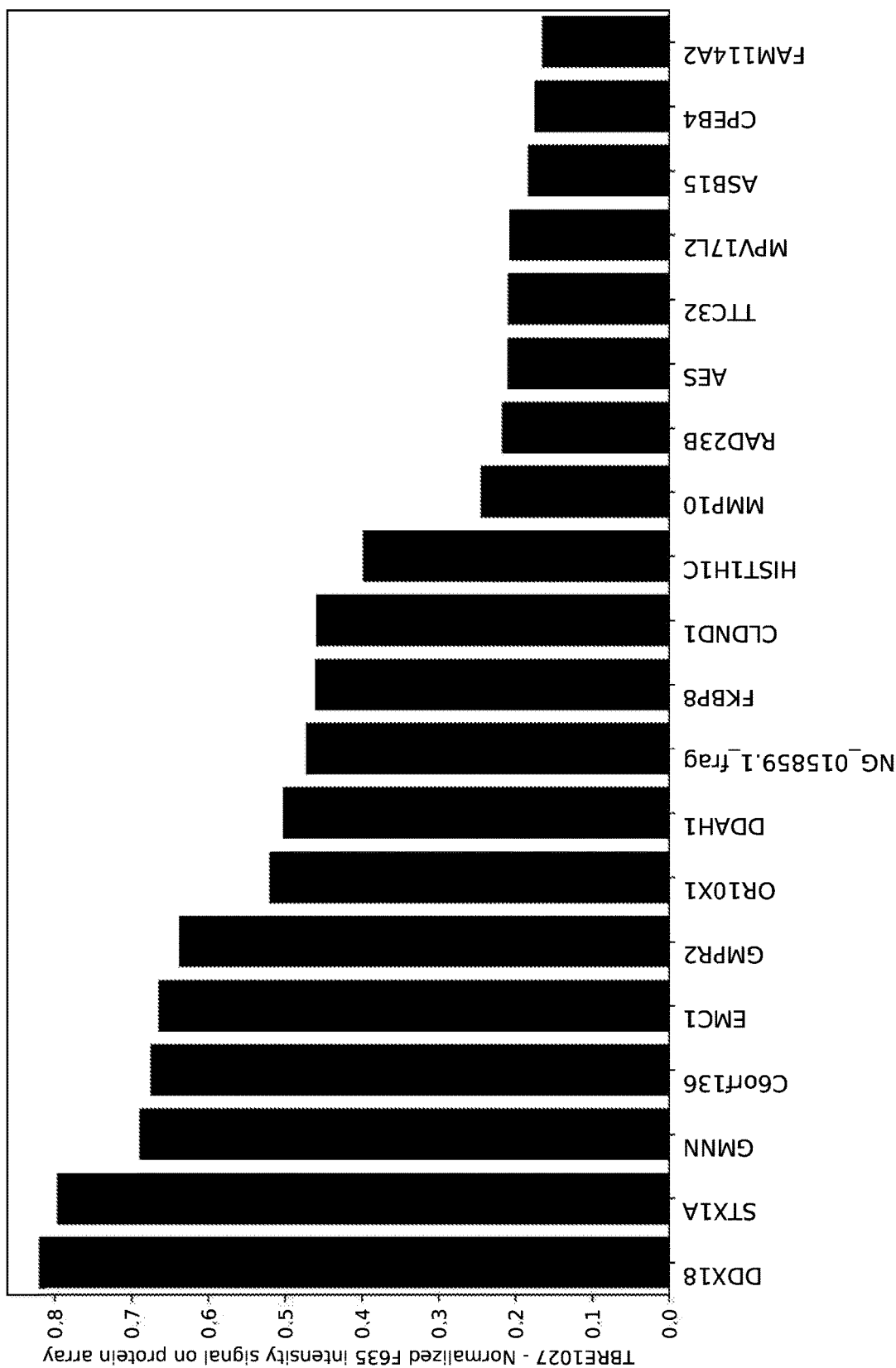

FIG. 38 is protein array data showing specific binding of DEAD-box helicase 18, syntaxin 1A, transcript variant 1, and geminin DNA replication inhibitor, transcript variant 1, by TBRE1027 antibody.

Figure 39:
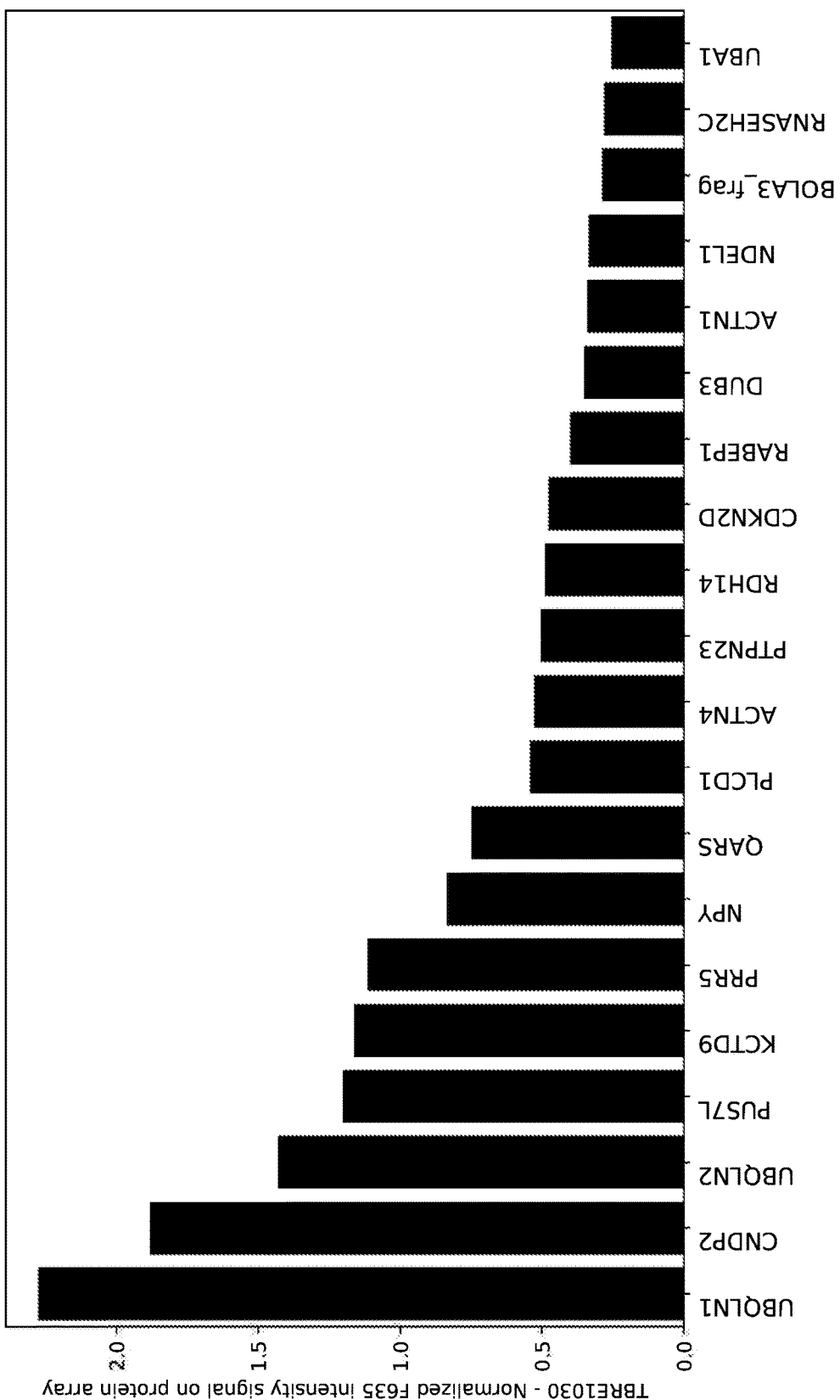

FIG. 39 is protein array data showing specific binding of ubiquilin 1, transcript variant 2 and carnosine dipeptidase 2, transcript variant 1 by TBRE1030 antibody.

Figure 40:
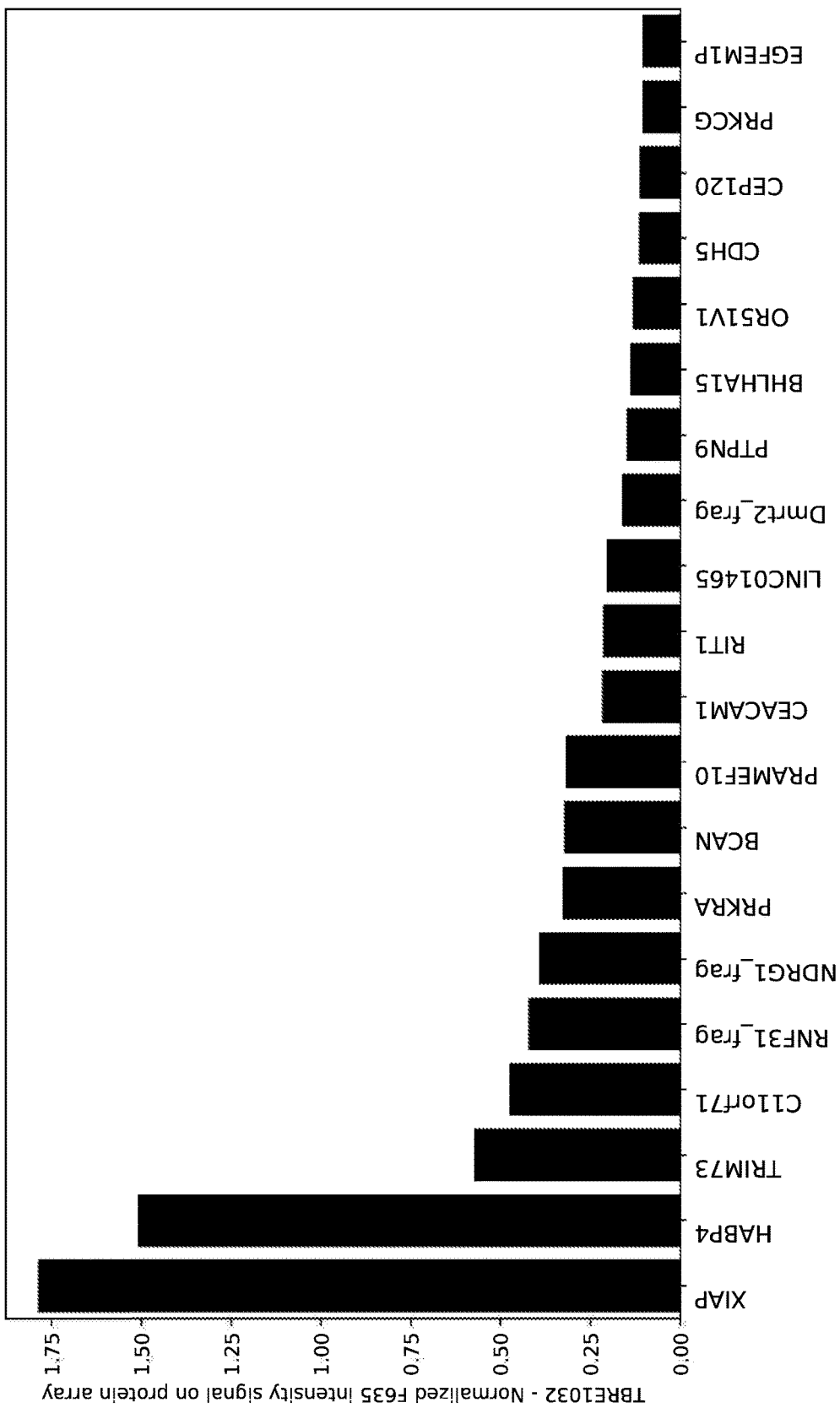

FIG. 40 is protein array data showing specific binding of X-linked inhibitor of apoptosis, transcript variant 2, and hyaluronan binding protein 4 by TBRE1032 antibody.

Figure 41:
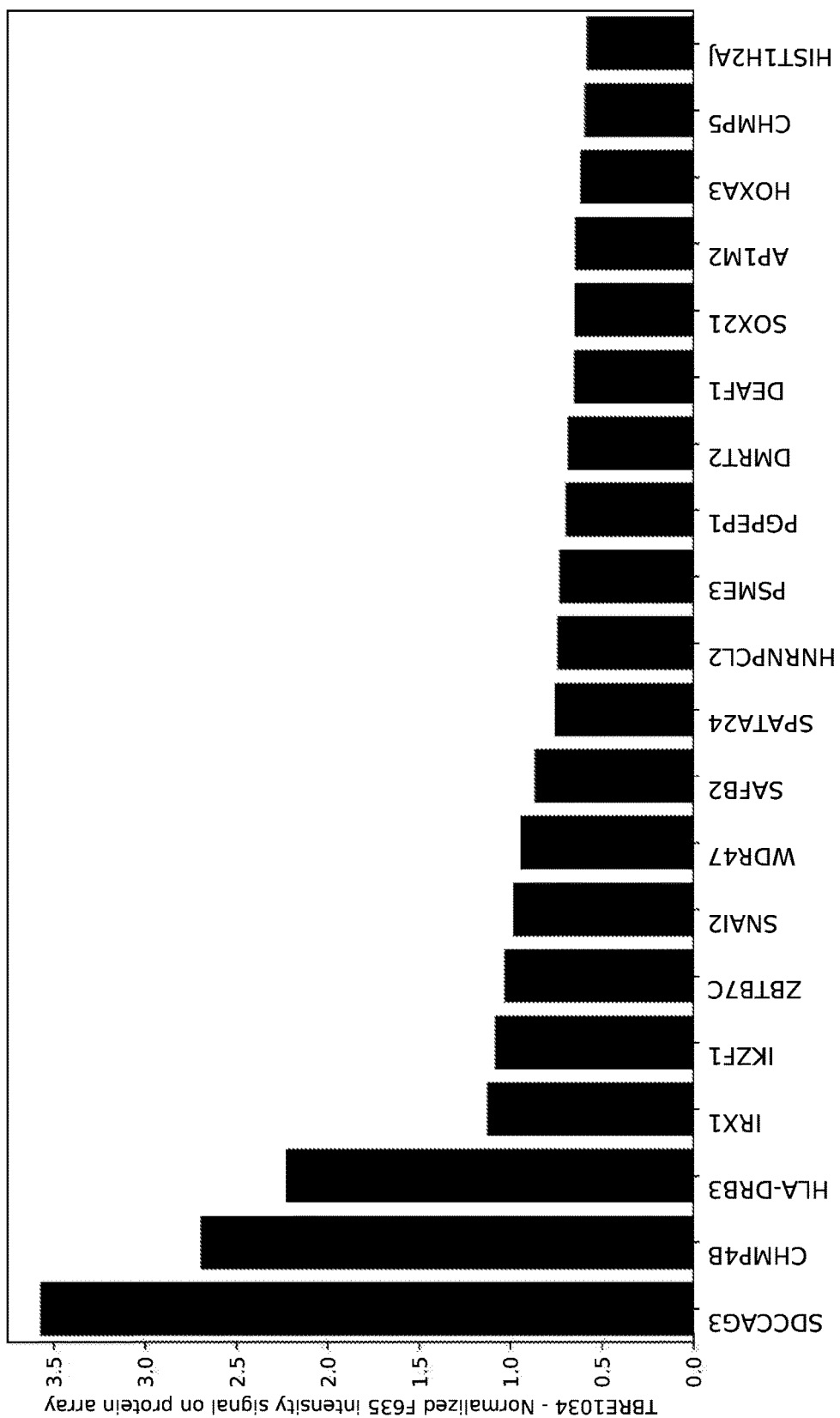

FIG. 41 is protein array data showing specific binding of endosome associated trafficking regulator 1, transcript variant 2 charged multivesicular body protein 4B by TBRE1034 antibody.

Figure 42:
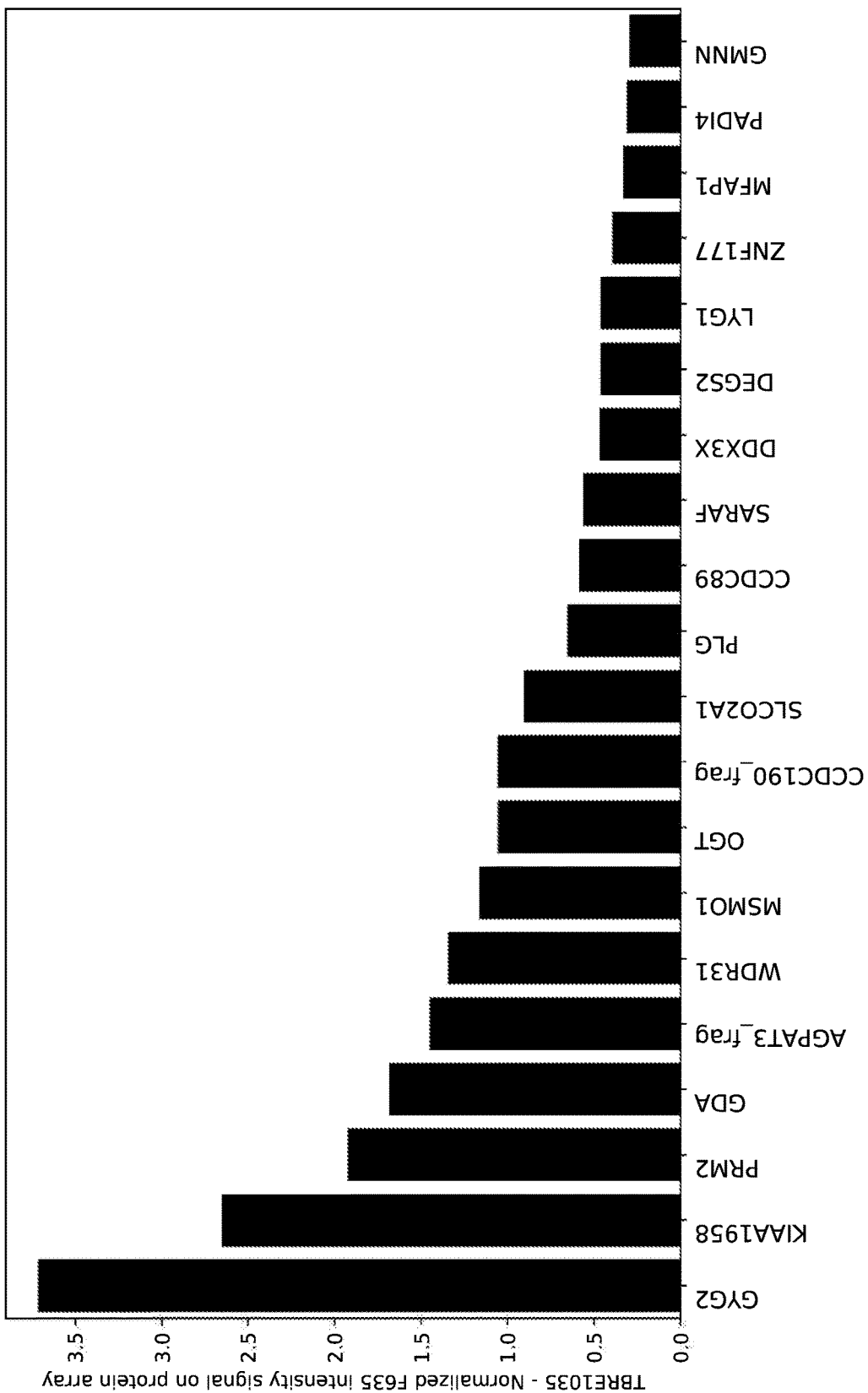

FIG. 42 is protein array data showing specific binding of glycogenin 2, transcript variant 2 by TBRE1035 antibody.

Figure 43:
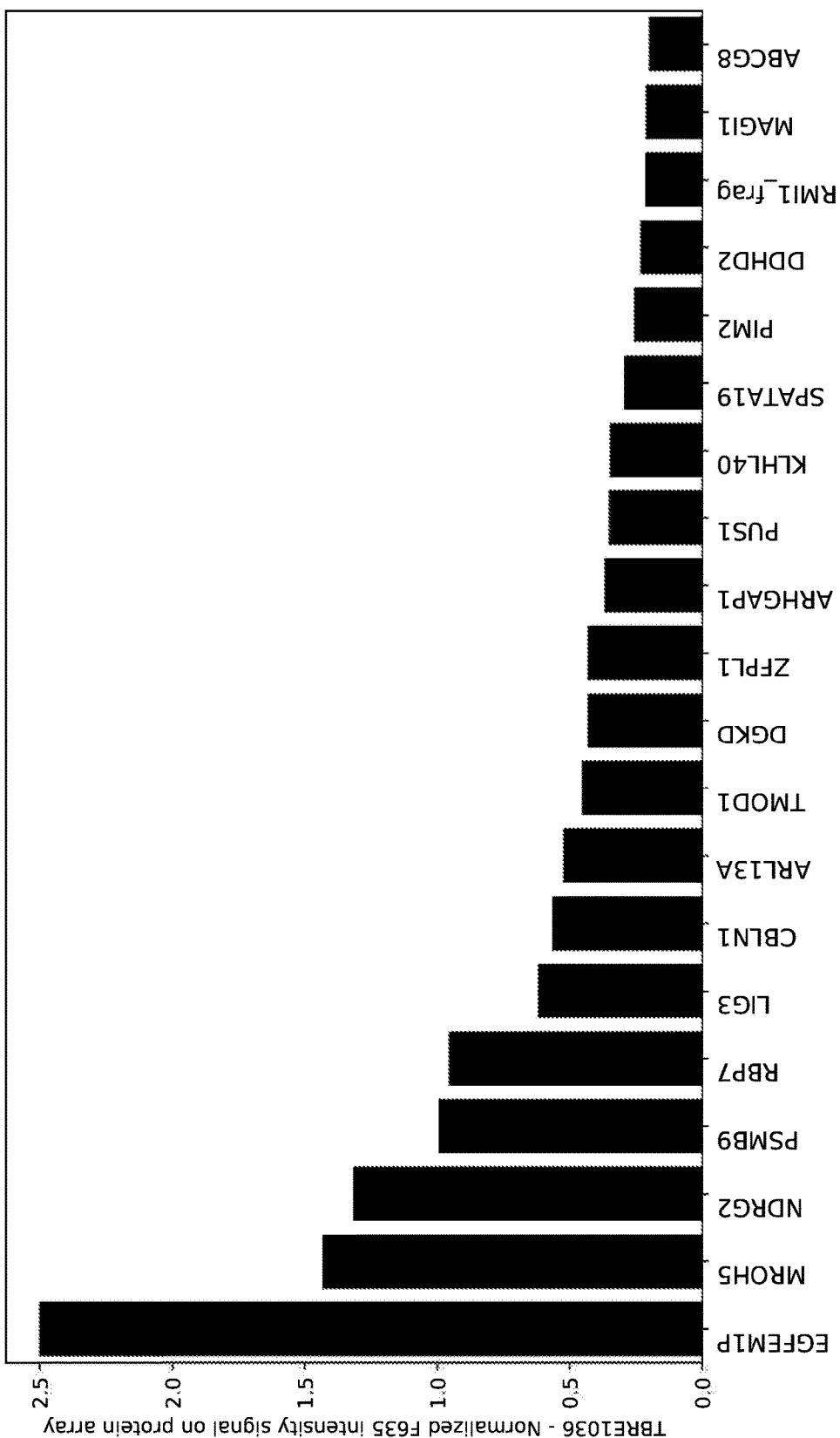

FIG. 43 is protein array data showing specific binding of Egf like and emi domain containing 1, pseudogene by TBRE1036 antibody.

Figure 44:
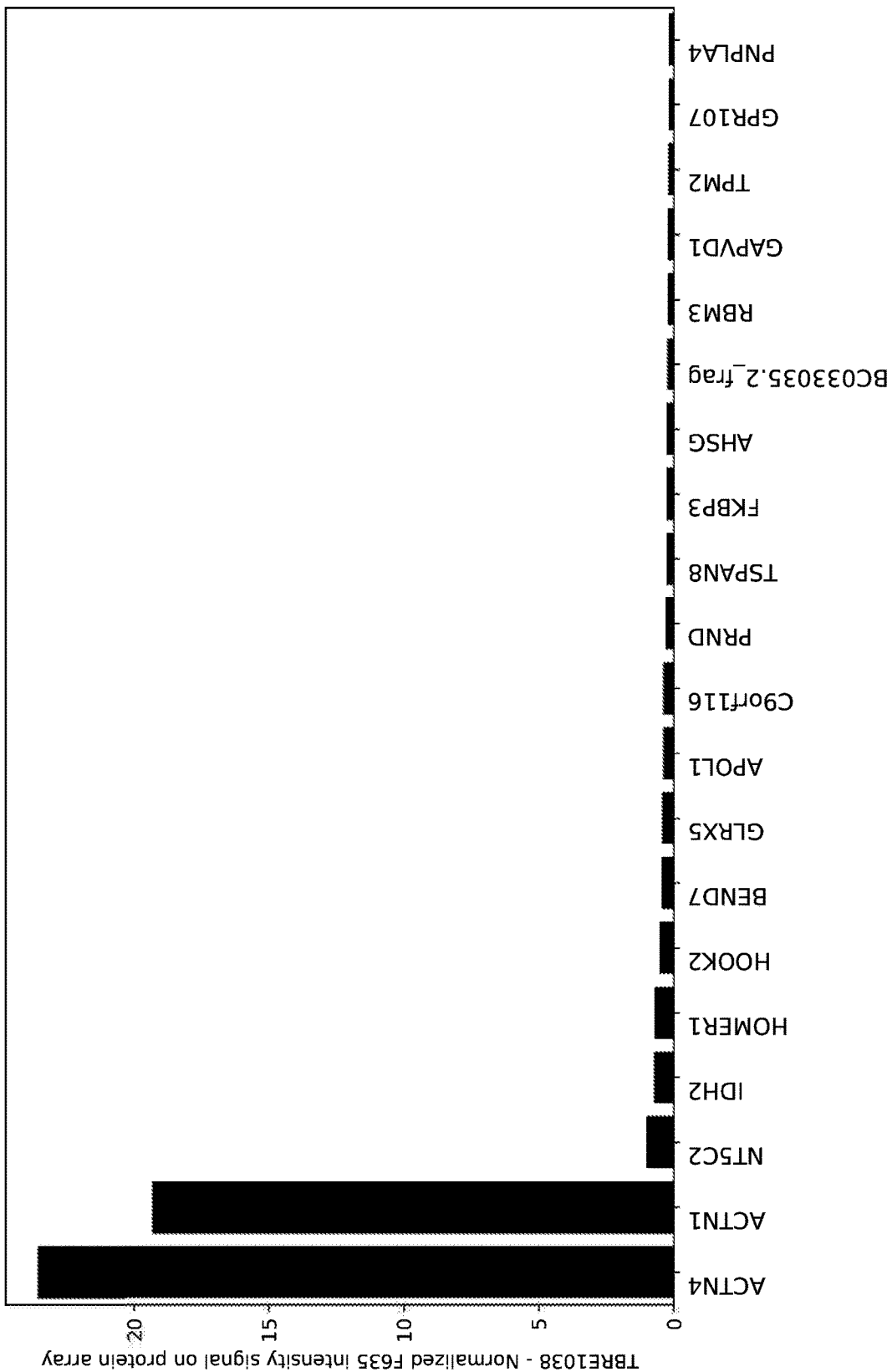

FIG. 44 is protein array data showing specific binding of actinin alpha 4, transcript variant 1 by TBRE1038 antibody.

Figure 45:
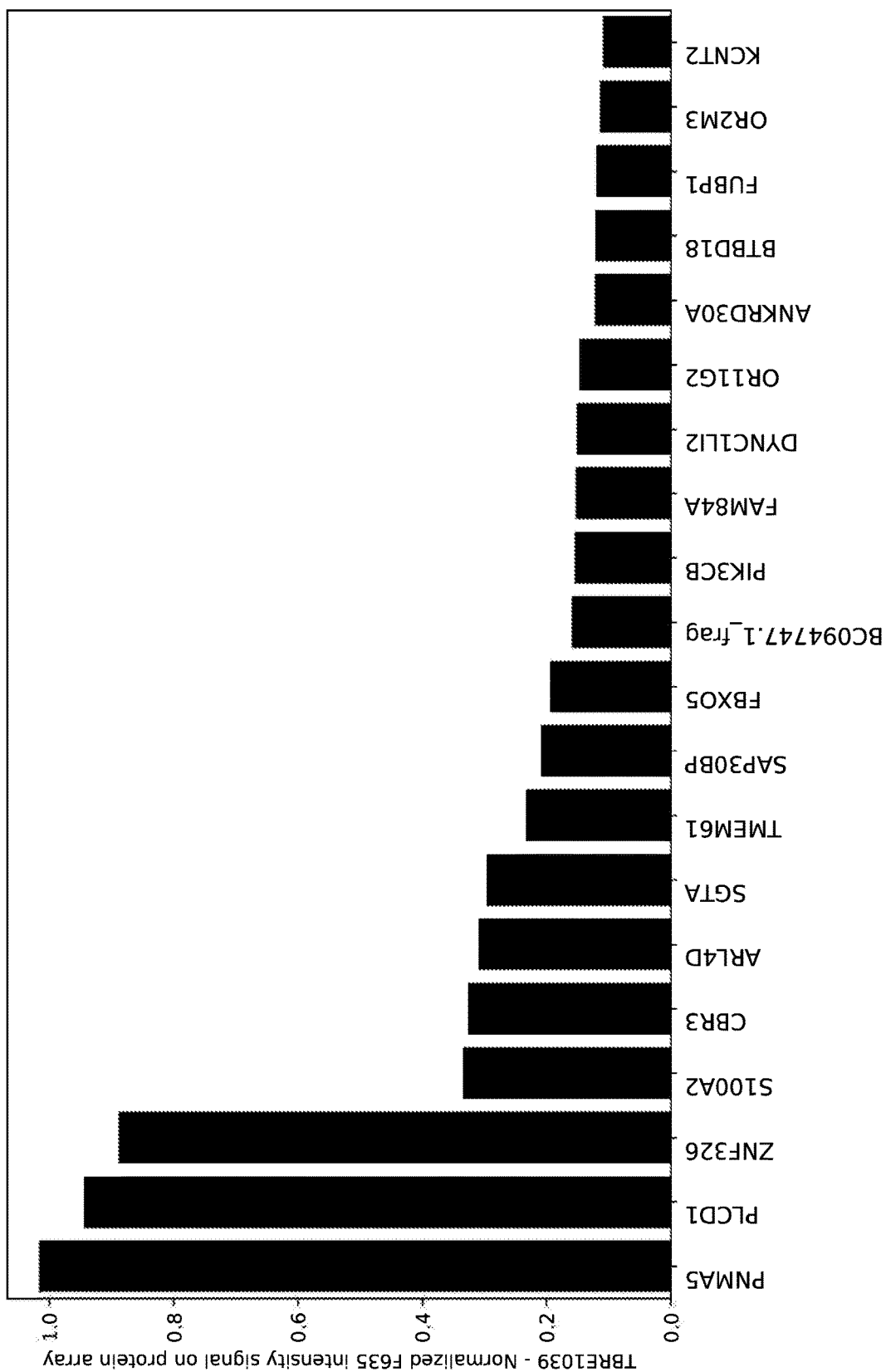

FIG. 45 is protein array data showing specific binding of PNMA family member 5, transcript variant 2 phospholipase C delta 1, transcript variant 2, and zinc finger protein 326, transcript variant 1 by TBRE1039 antibody.

Figure 46:
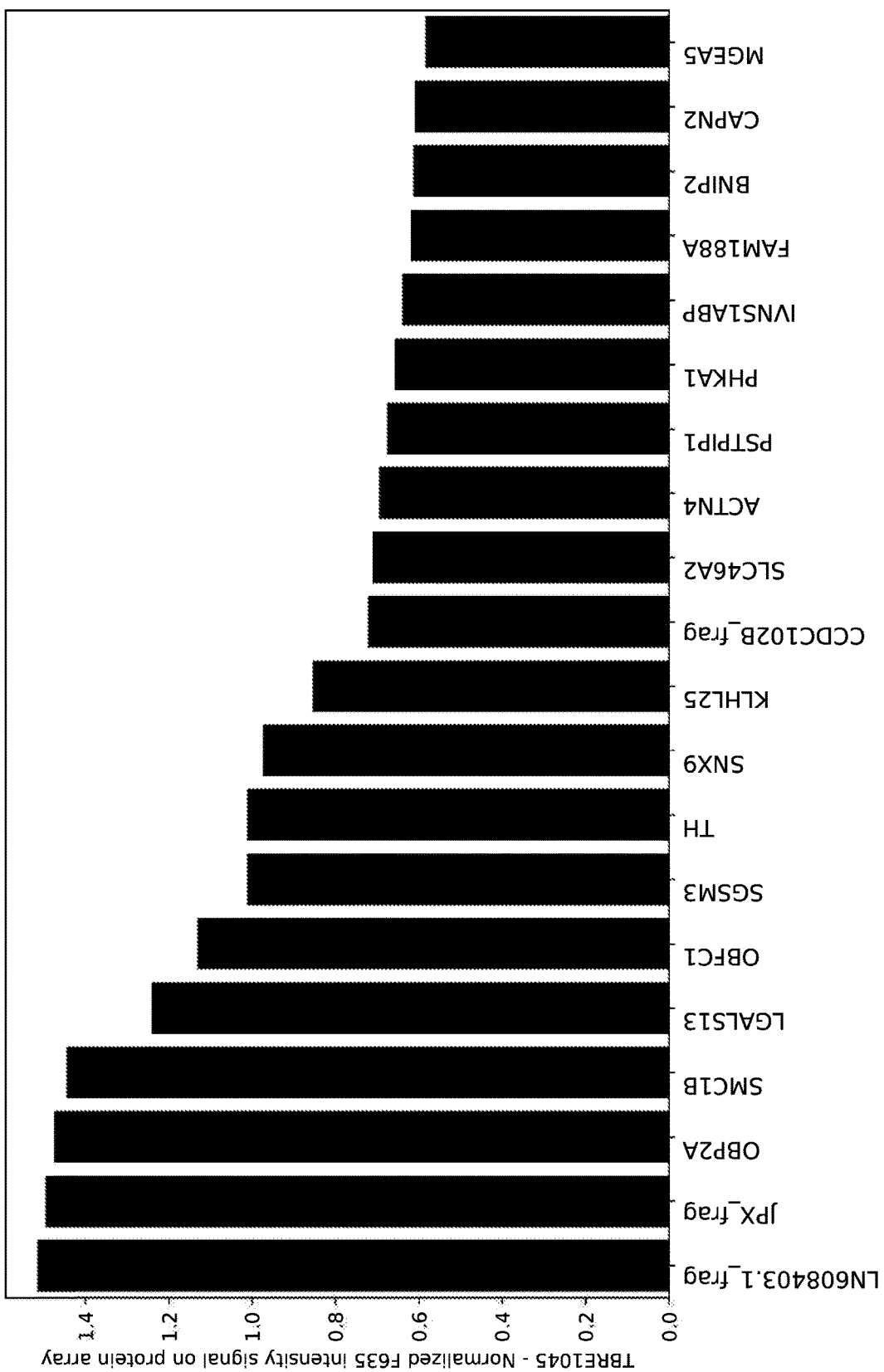

FIG. 46 is protein array data showing specific binding of LN608403.1_frag, JPX transcript XIST activator, and odorant binding protein 2A, transcript variant alpha by TBRE1045 antibody.

Figure 47:
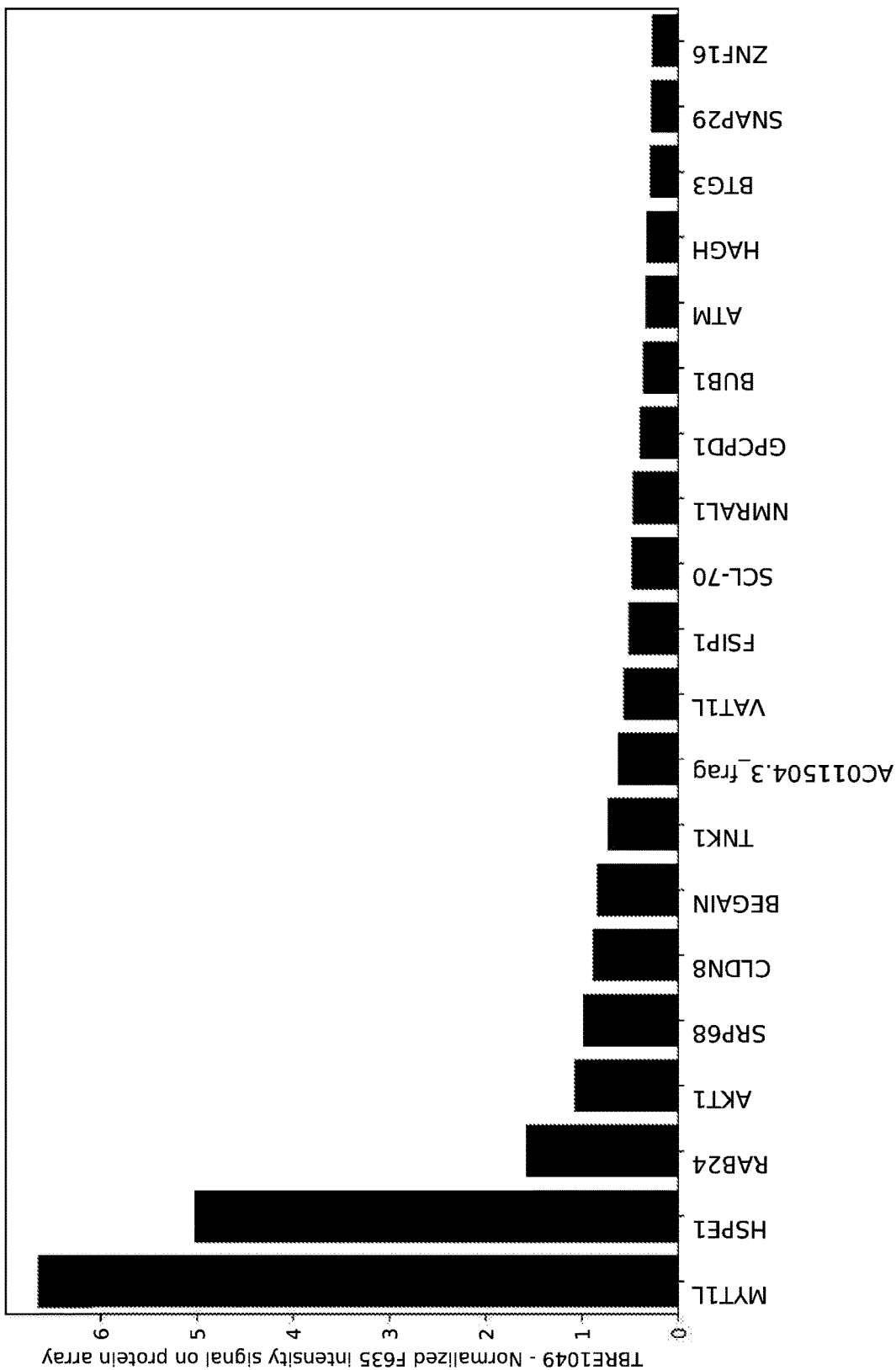

FIG. 47 is protein array data showing specific binding of myelin transcription factor 1 like, transcript variant 2 heat shock protein family E (Hsp10) member 1 by TBRE1049 antibody.

Figure 48:
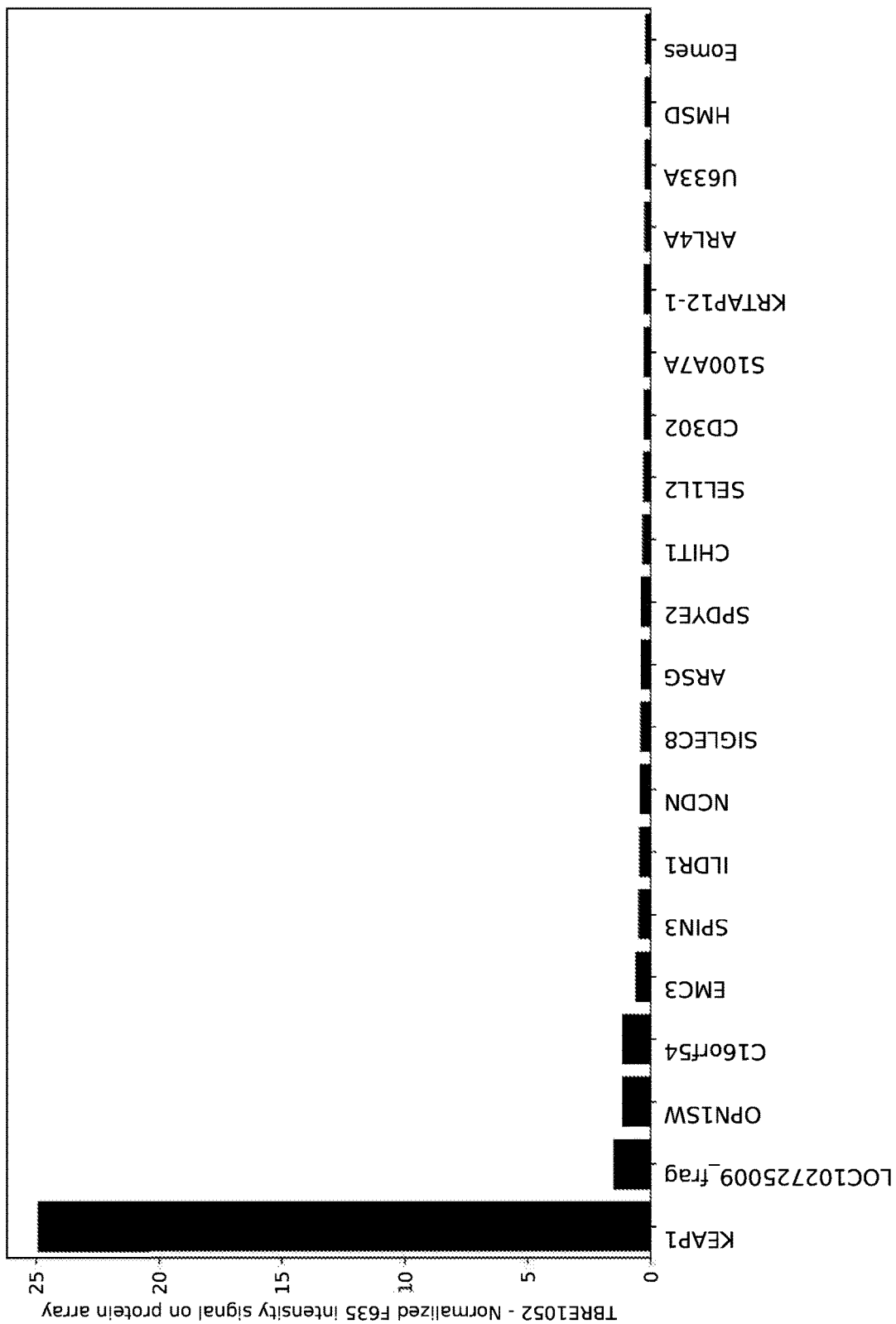

FIG. 48 is protein array data showing specific binding of kelch like ECH associated protein 1, transcript variant 1 by TBRE1052 antibody.

Figure 49:
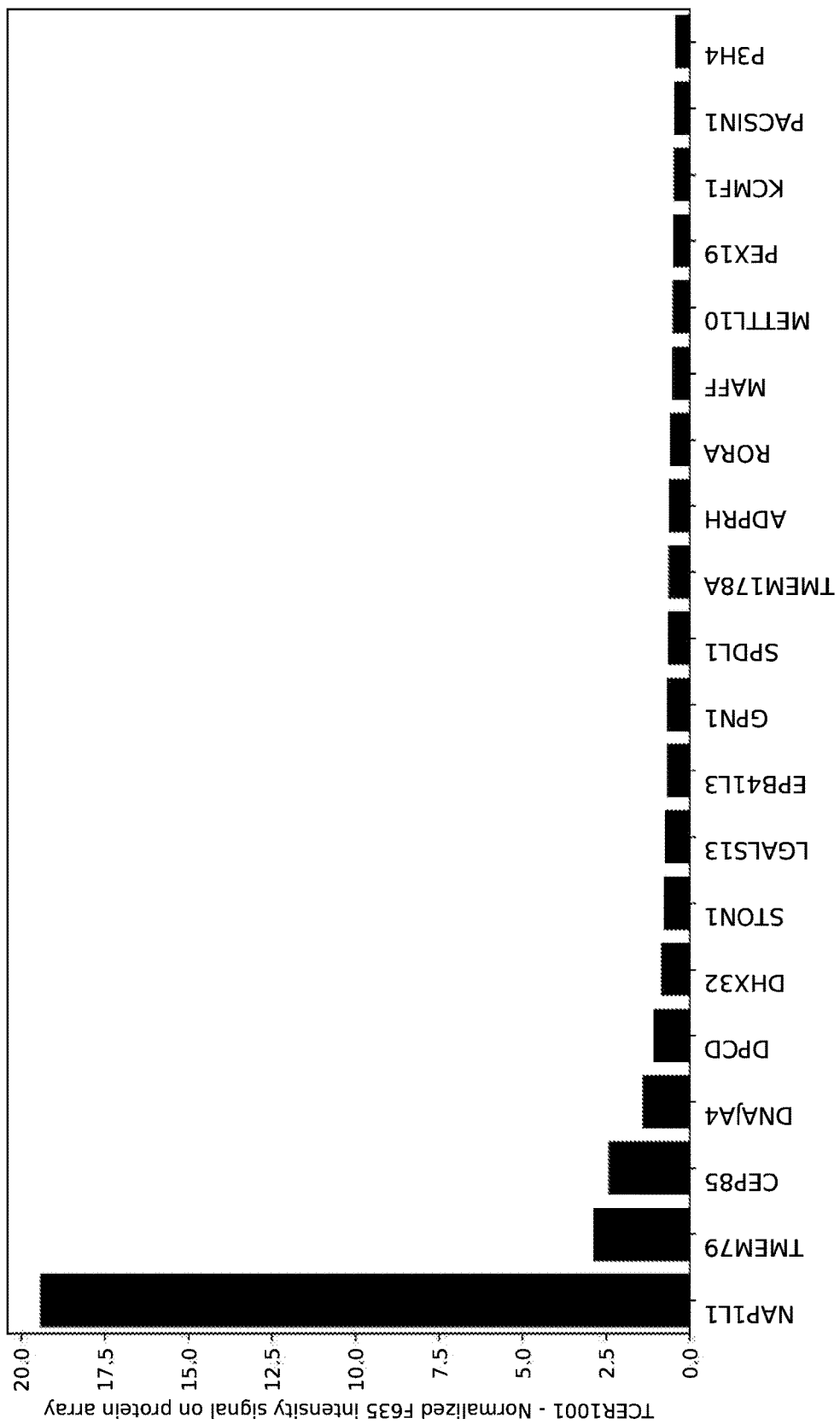

FIG. 49 is protein array data showing specific binding of nucleosome assembly protein 1 like 1, transcript variant 1 by TCER1001 antibody.

Figure 50:
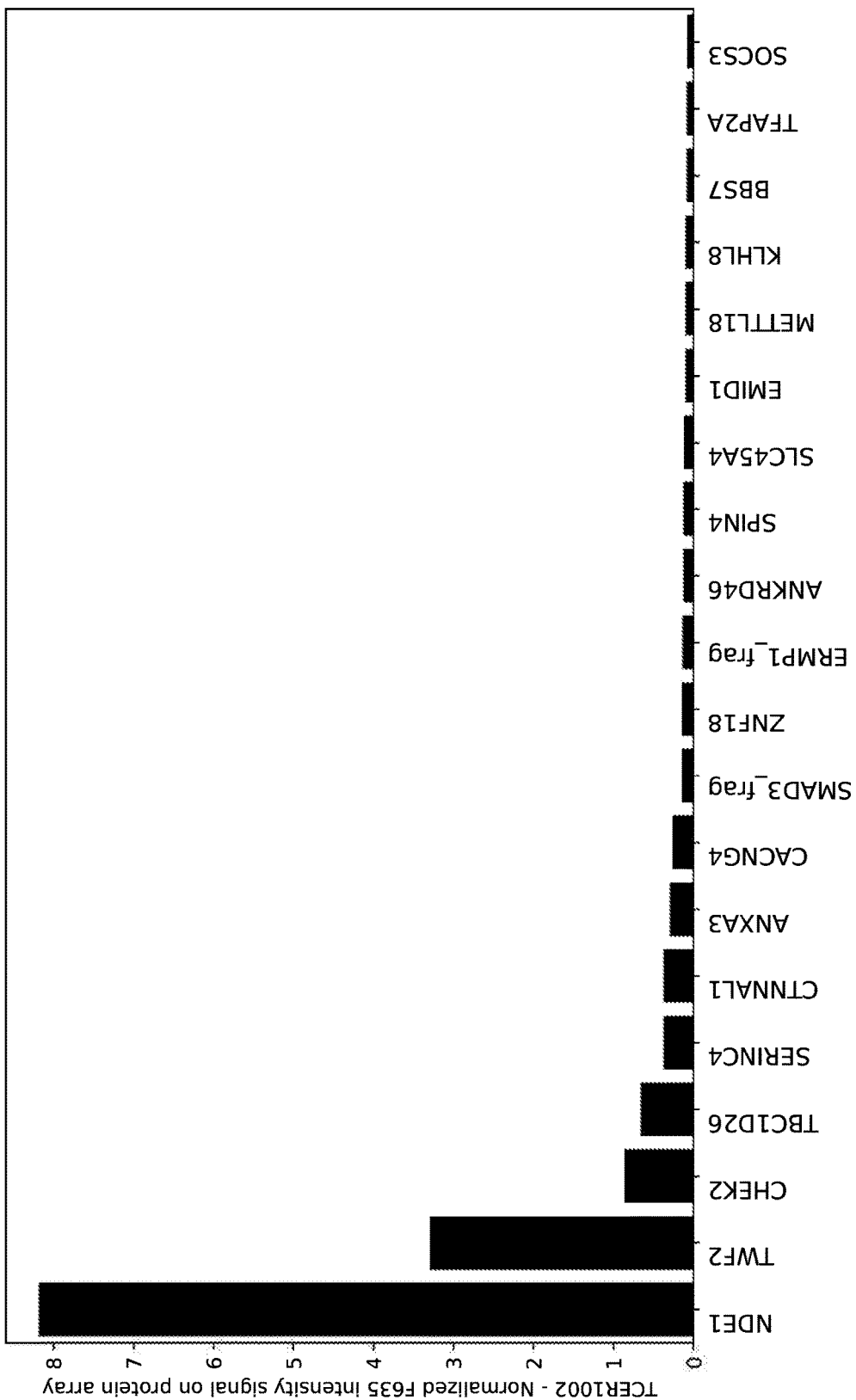

FIG. 50 is protein array data showing specific binding of nudE neurodevelopment protein 1, transcript variant 1 by TCER1002 antibody.

Figure 51:
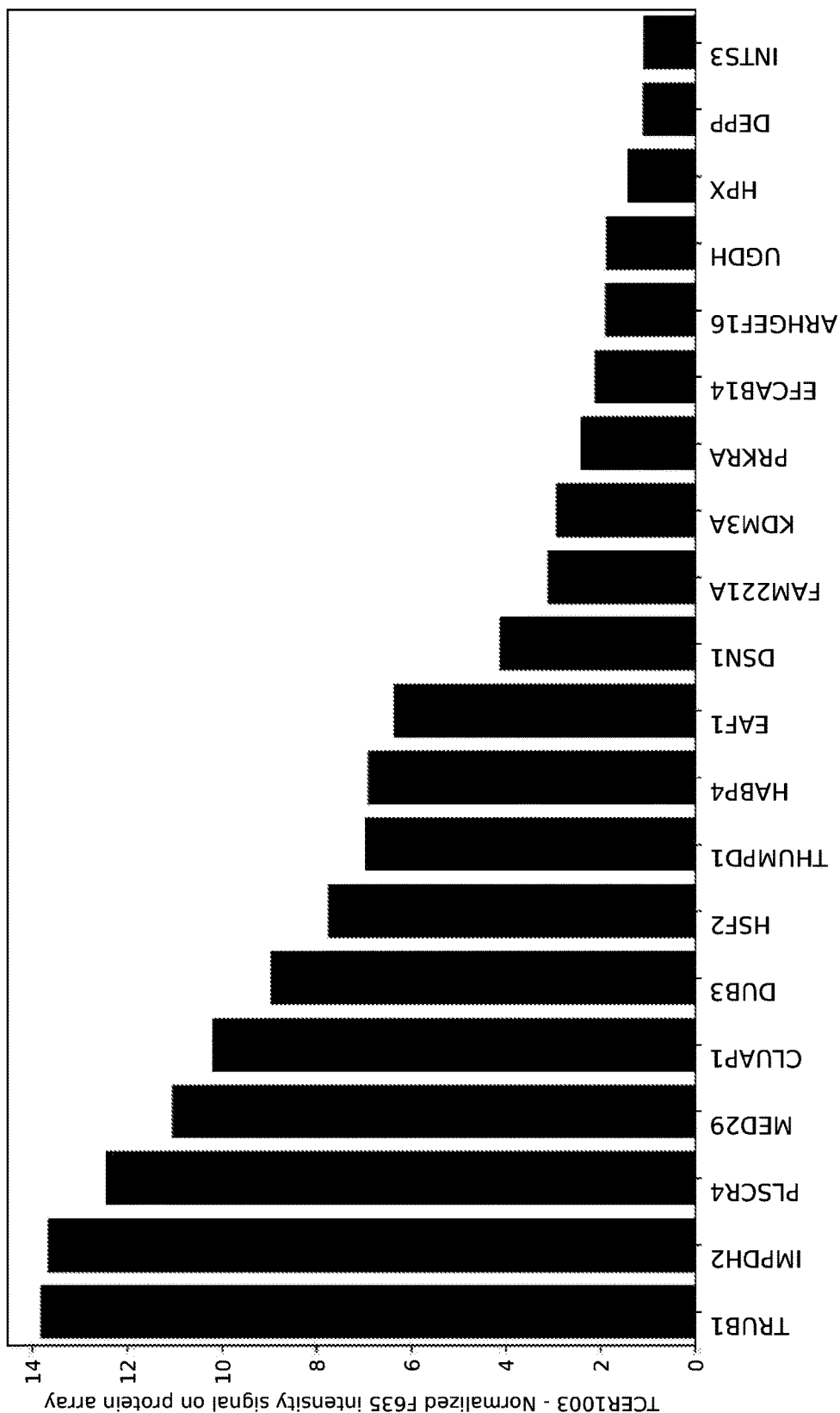

FIG. 51 is protein array data showing specific binding of TruB pseudouridine synthase family member 1 inosine monophosphate dehydrogenase 2, and phospholipid scramblase 4, transcript variant X4 by TCER1003 antibody.

Figure 52:
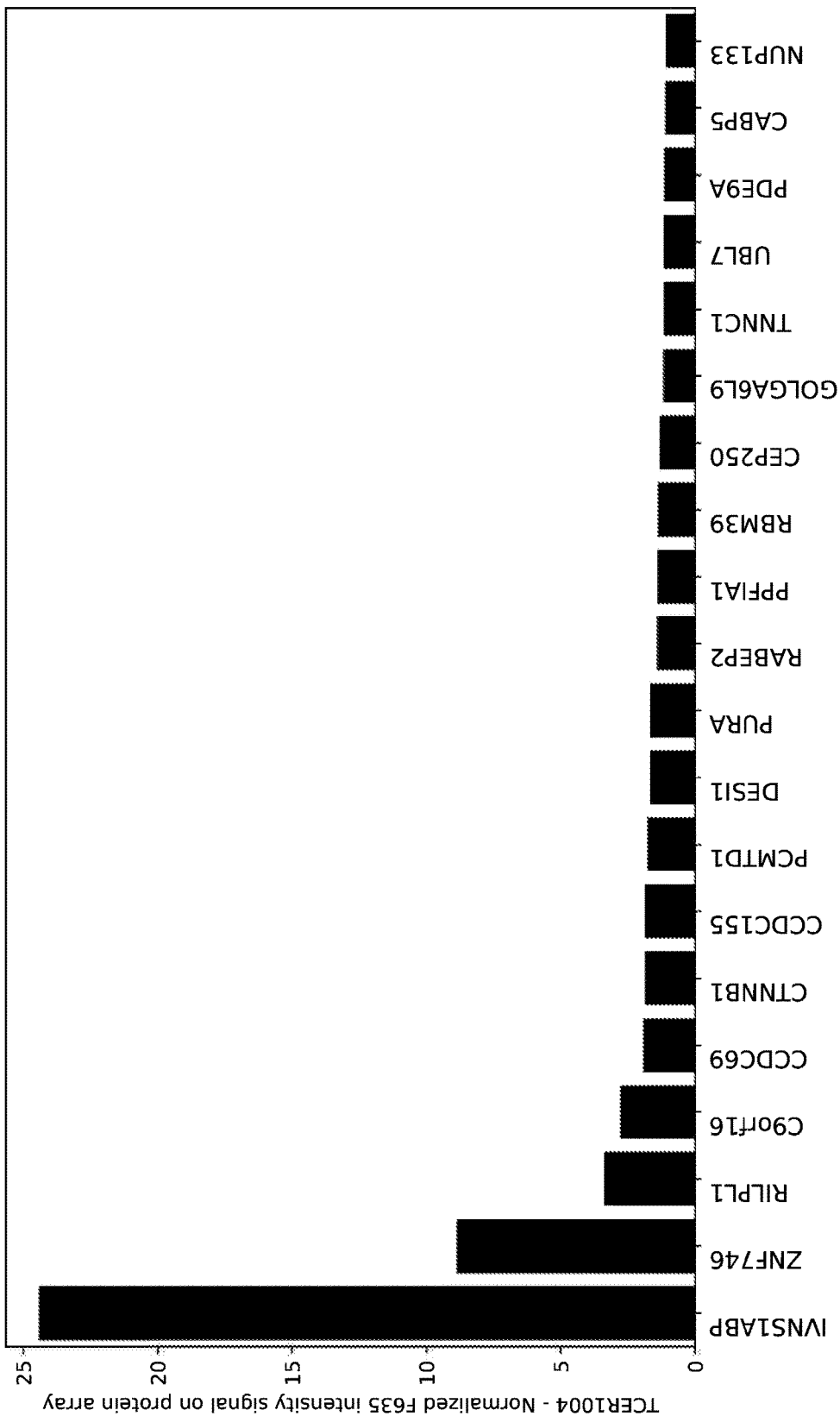

FIG. 52 is protein array data showing specific binding of influenza virus NS1A binding protein by TCER1004 antibody.

Figure 53:
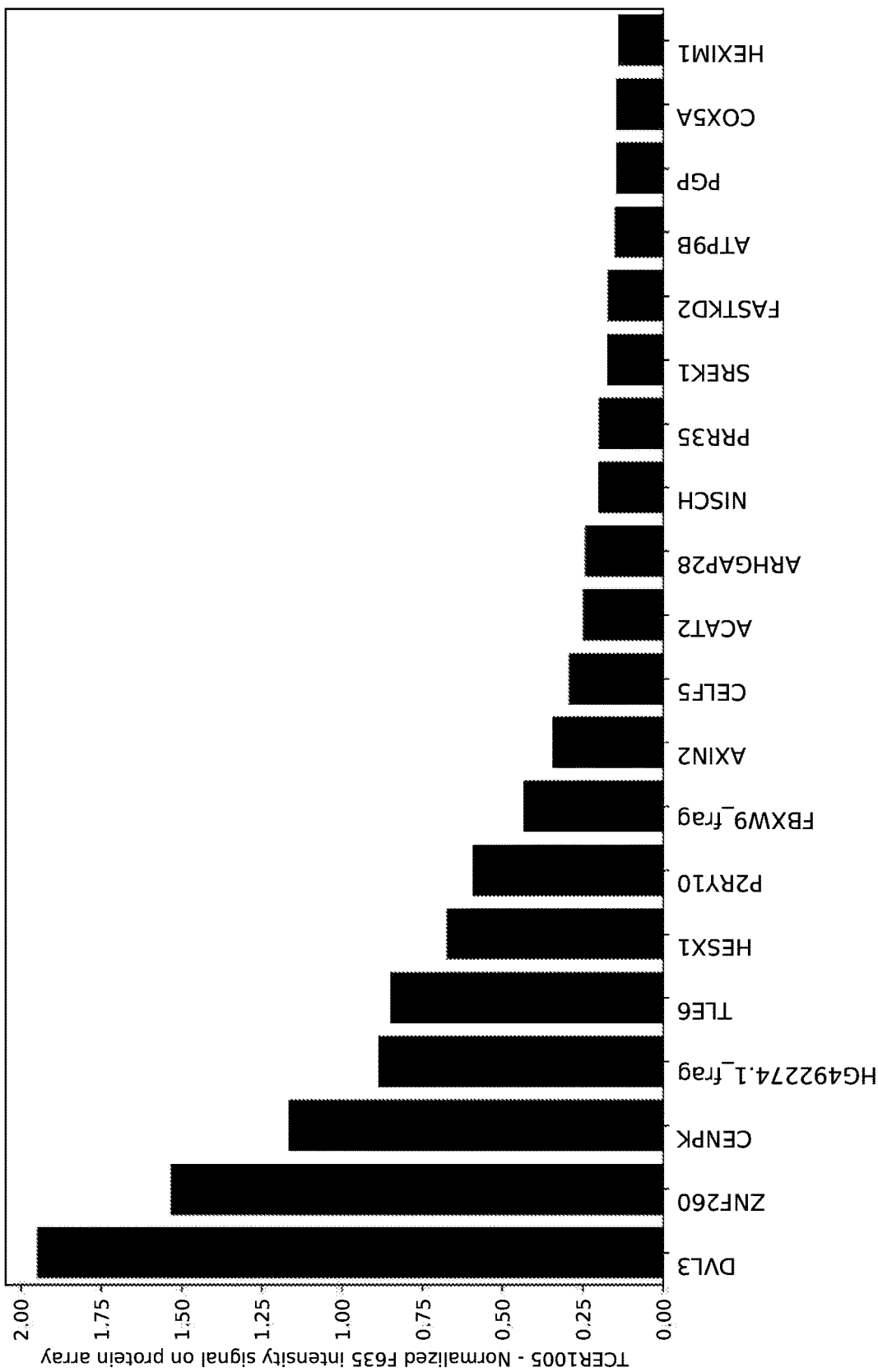

FIG. 53 is protein array data showing specific binding of disheveled segment polarity protein 3, and Zinc finger protein 260 by TCER1005 antibody.

Figure 54:
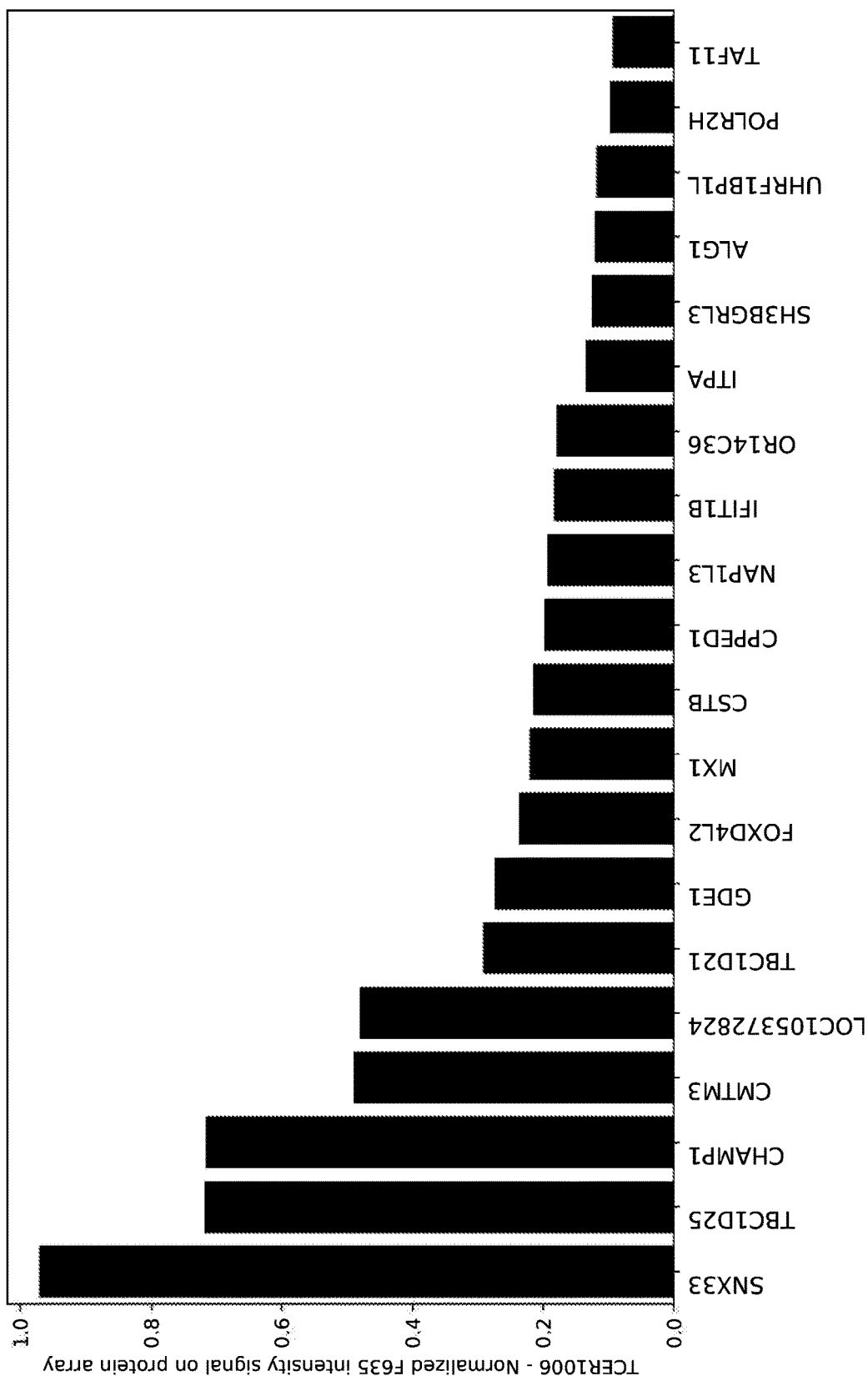

FIG. 54 is protein array data showing specific binding of sorting nexin 33, transcript variant 1 by TCER1006 antibody.

Figure 55:
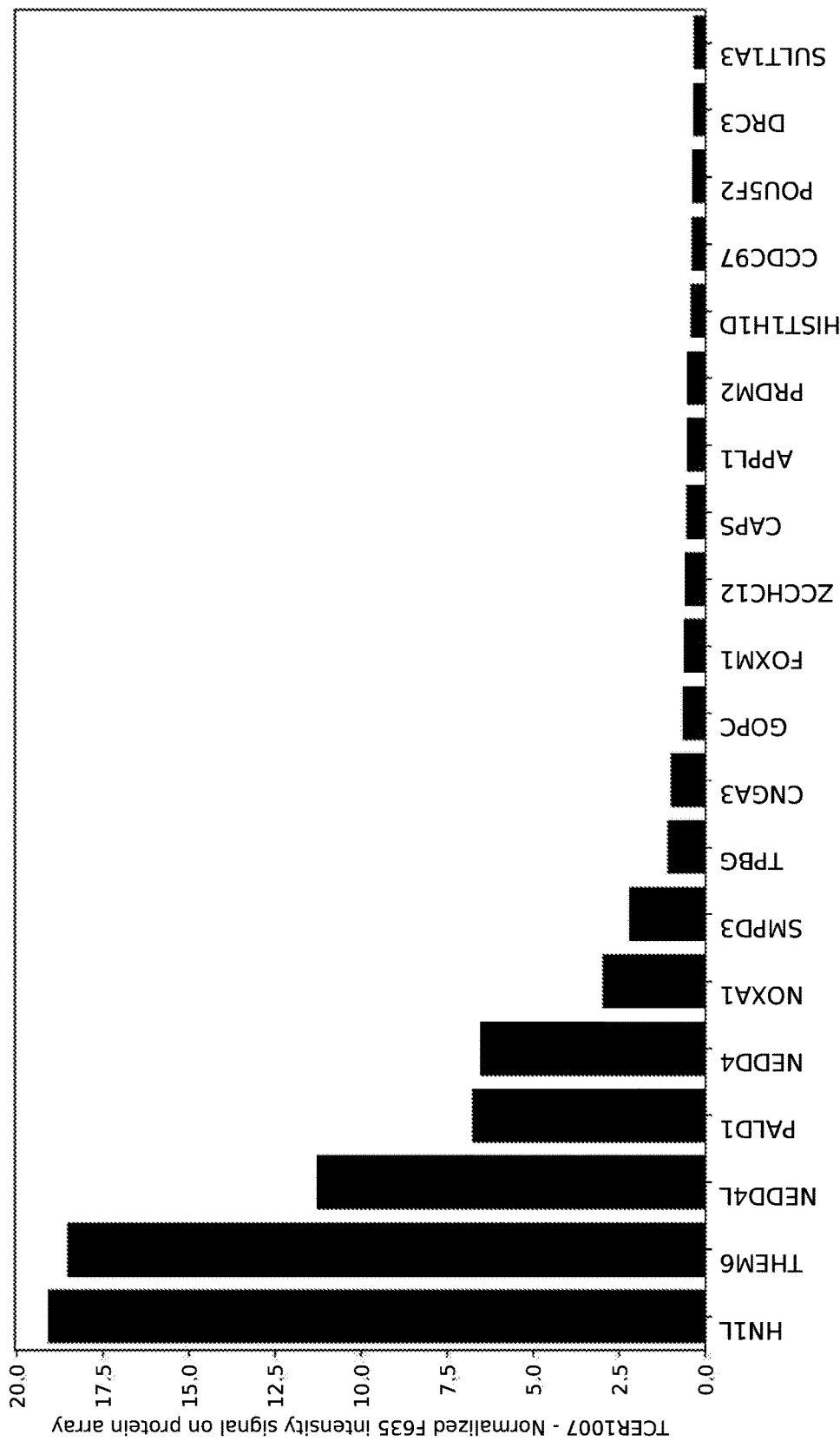

FIG. 55 is protein array data showing specific binding of Jupiter microtubule associated homolog 2, and thioesterase superfamily member 6, transcript variant 1 by TCER1007 antibody.

Figure 56:
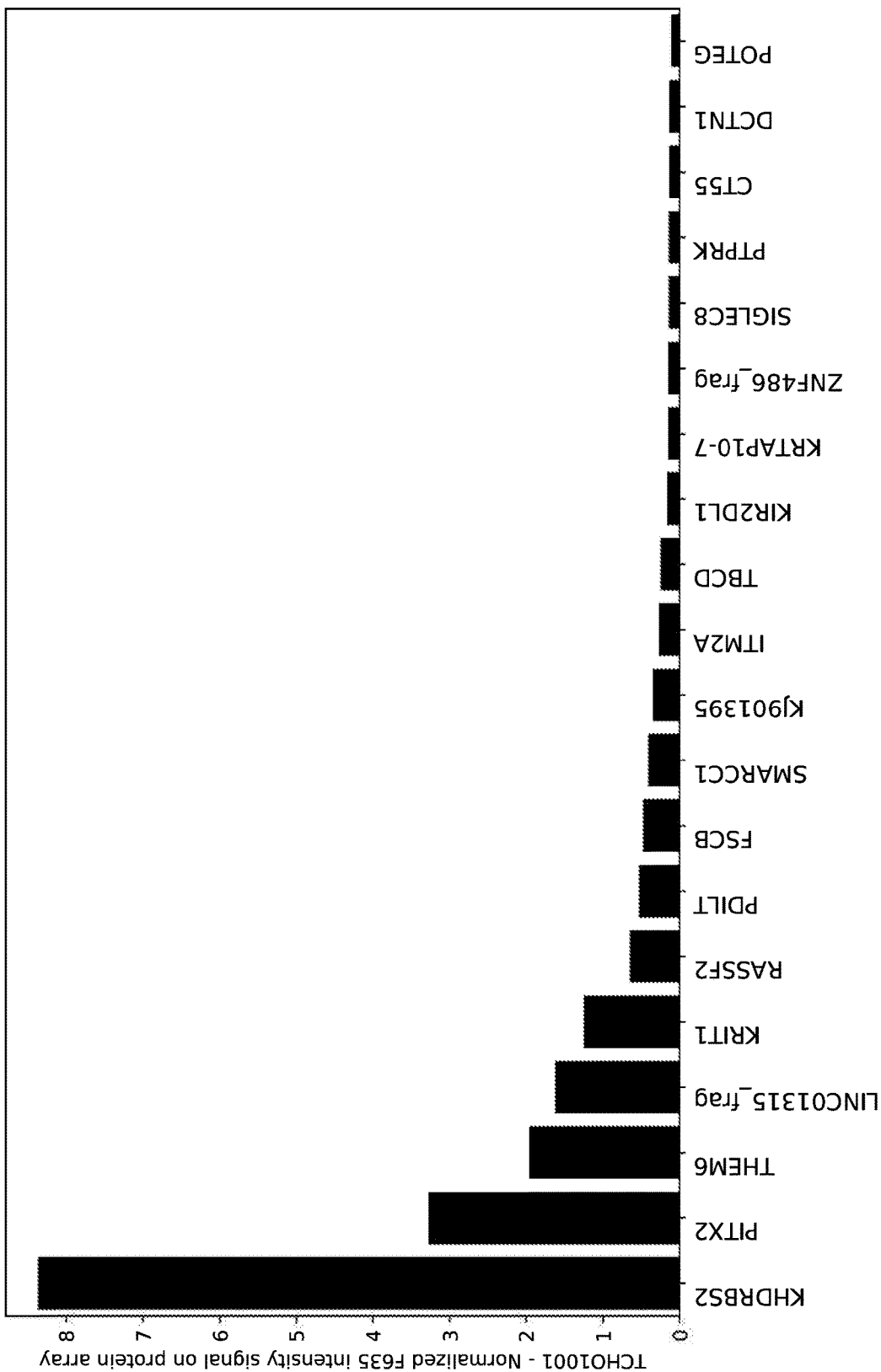

FIG. 56 is protein array data showing specific binding of KH RNA binding domain containing, signal transduction associated 2, transcript variant 2 by TCHO1001 antibody.

Figure 57:
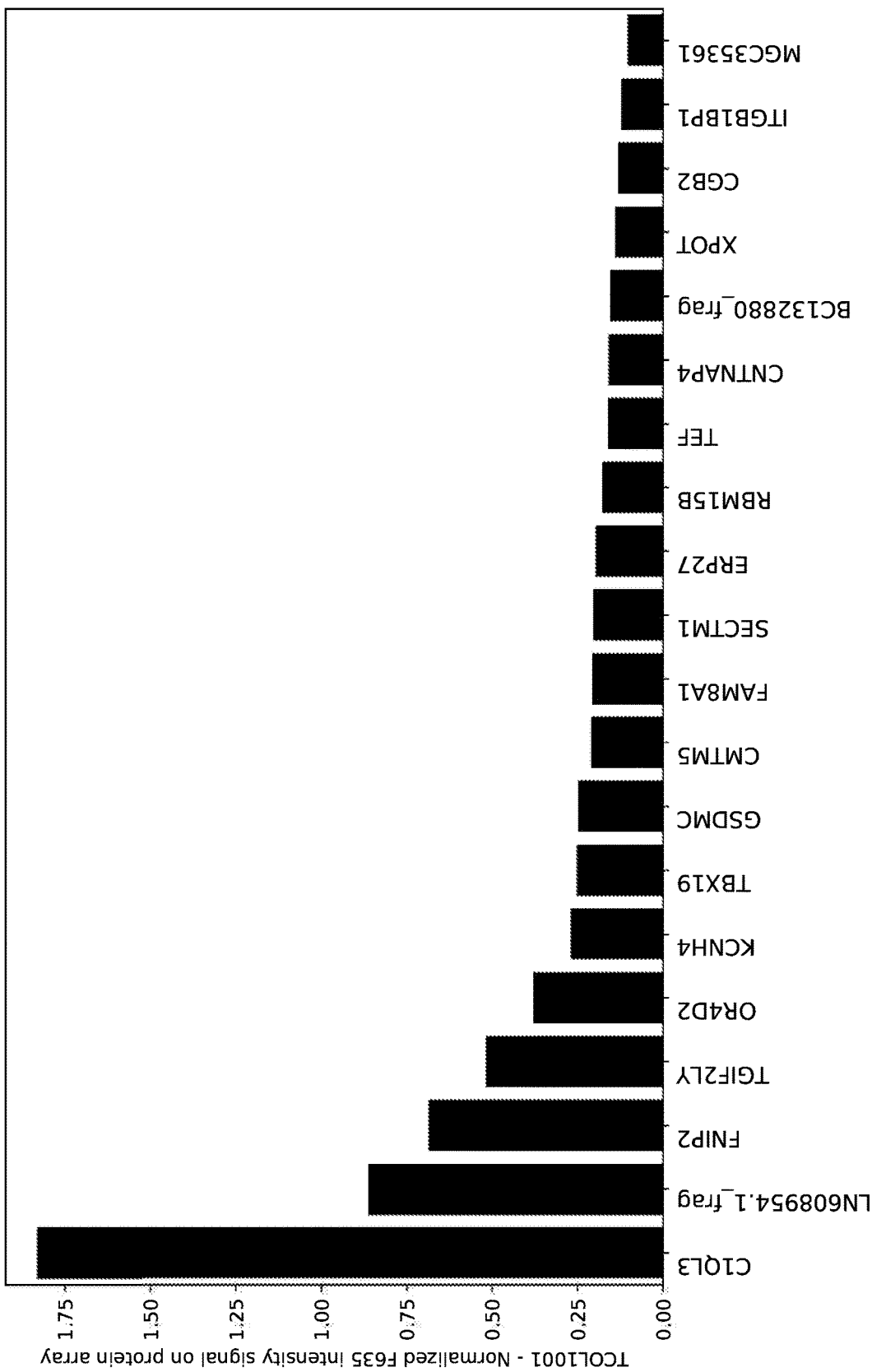

FIG. 57 is protein array data showing specific binding of complement C1q like 3 by TCOL1001 antibody.

Figure 58:
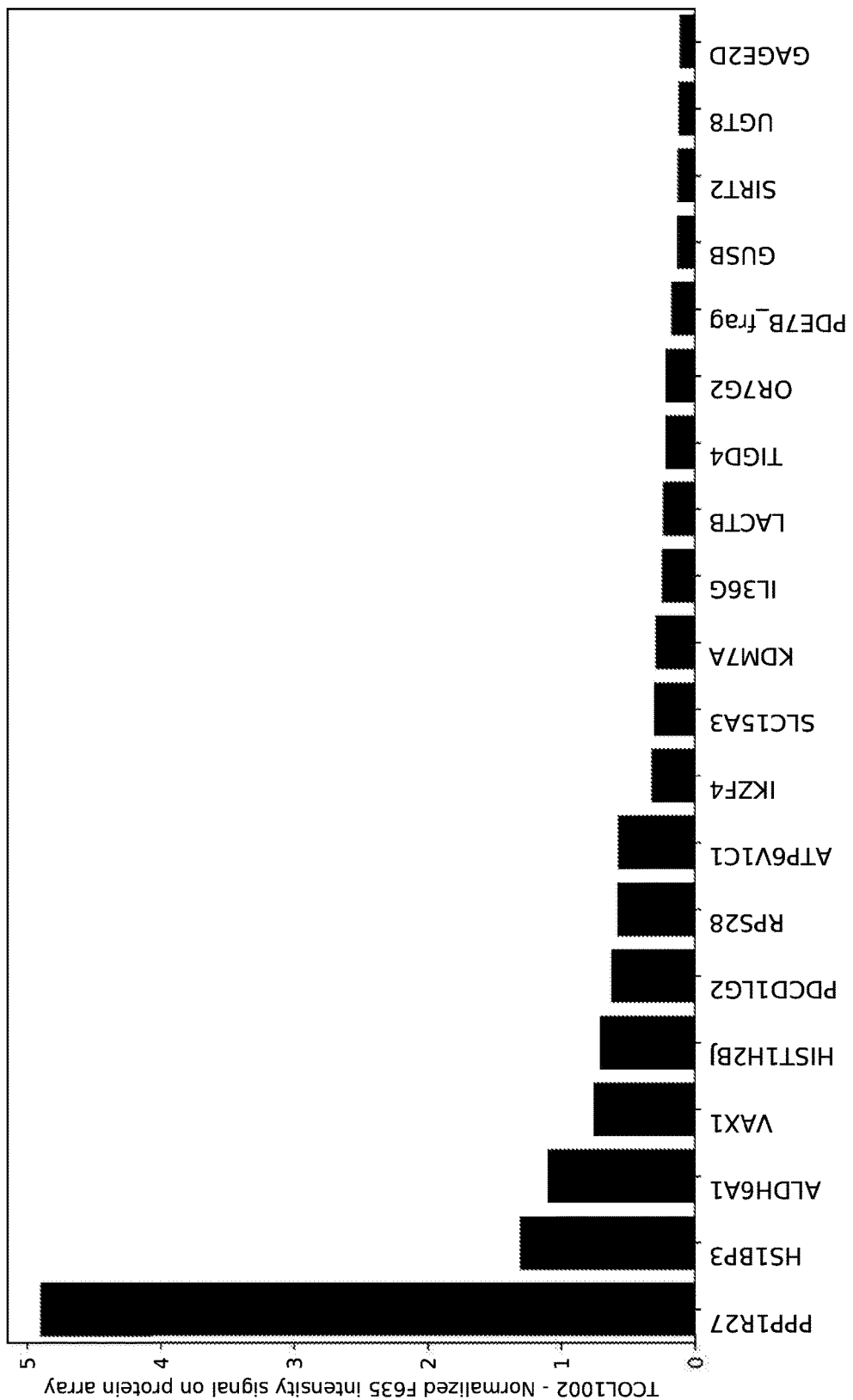

FIG. 58 is protein array data showing specific binding of protein phosphatase 1 regulatory subunit 27 by TCOL1002 antibody.

Figure 59:
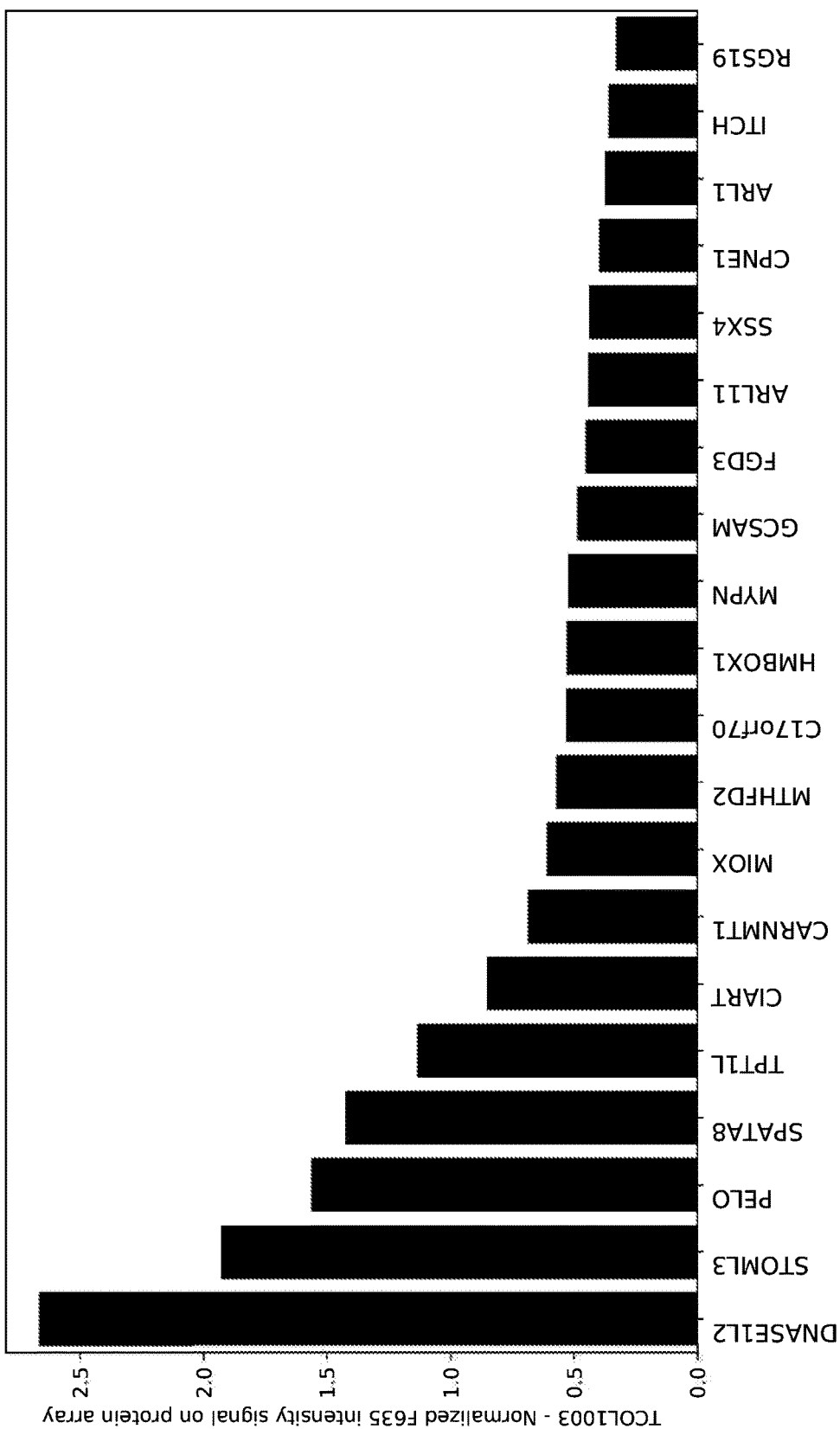

FIG. 59 is protein array data showing specific binding of deoxyribonuclease 1 like 2, transcript variant 1 by TCOL1003 antibody.

Figure 60:
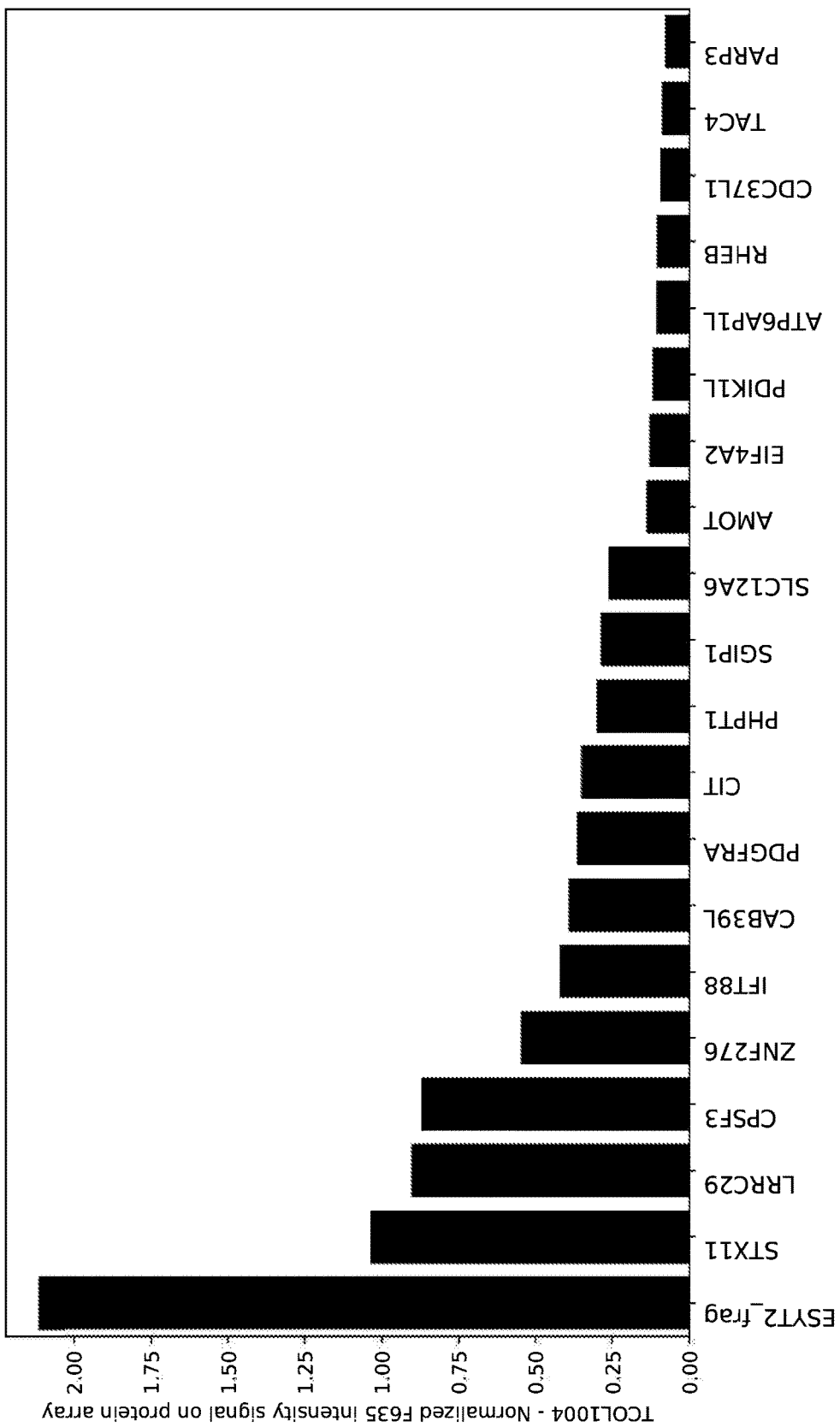

FIG. 60 is protein array data showing specific binding of extended synaptotagmin 2 by TCOL1004 antibody.

Figure 61:
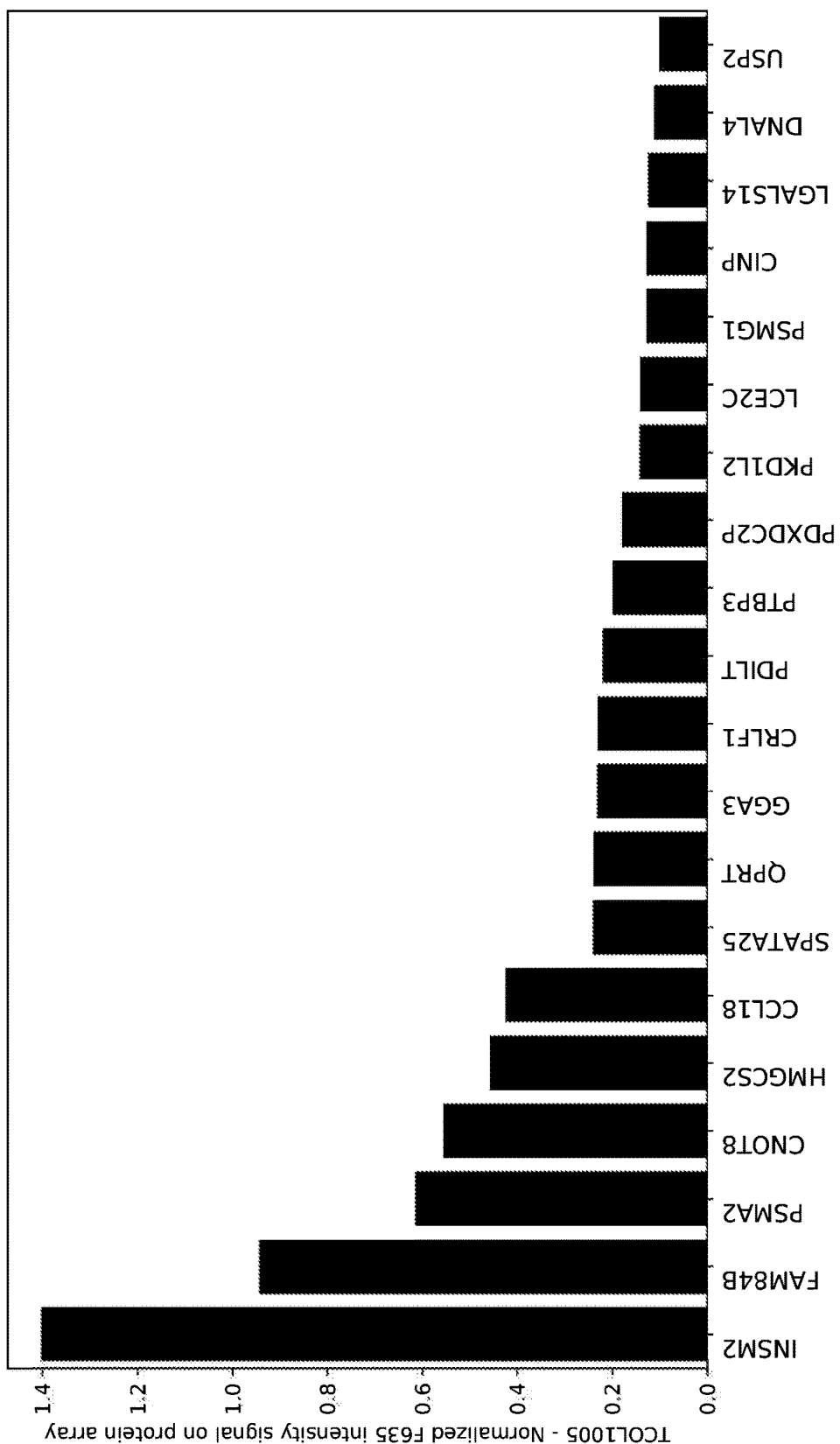

FIG. 61 is protein array data showing specific binding of C-C motif chemokine ligand 18 by TCOL1005 antibody.

Figure 62:
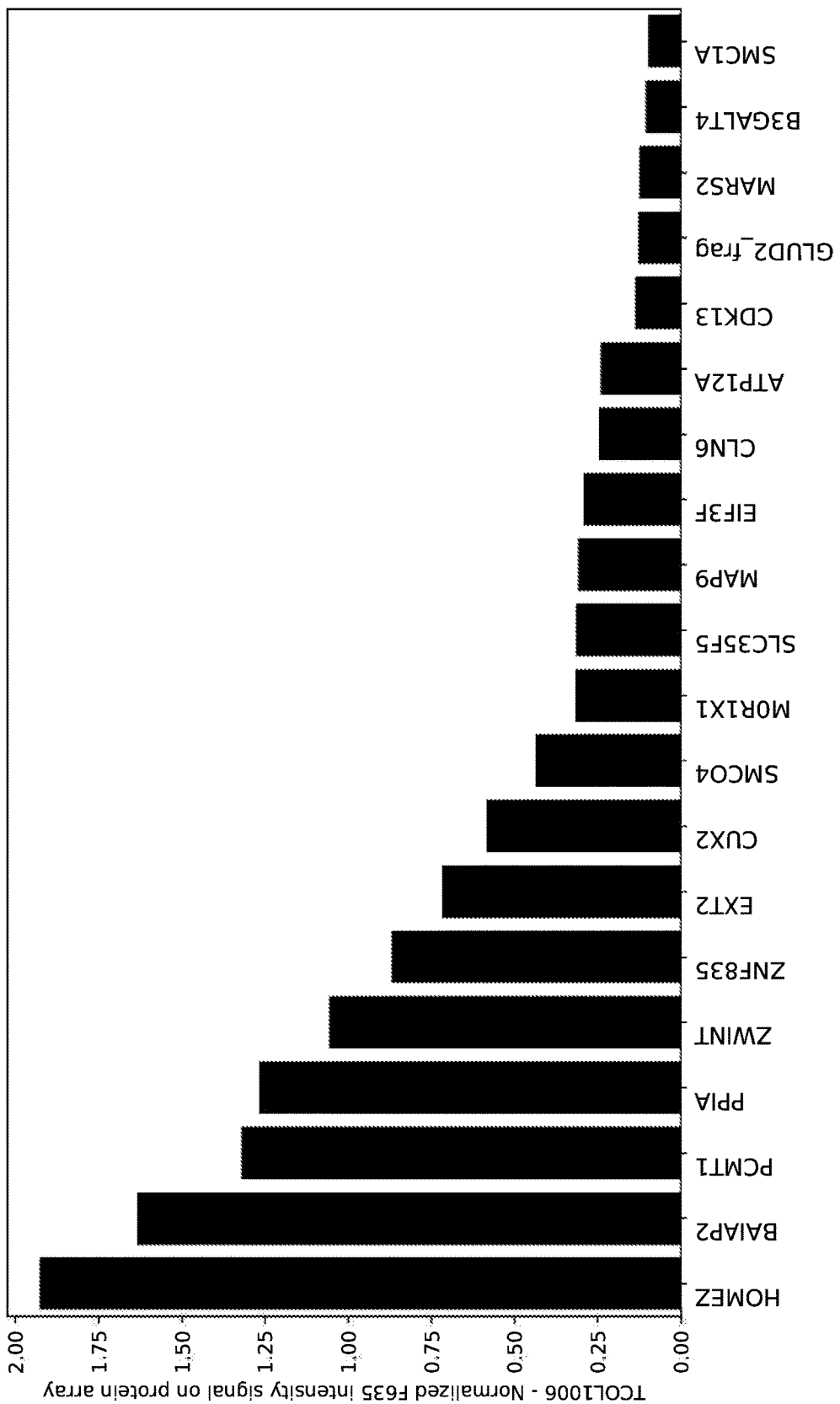

FIG. 62 is protein array data showing specific binding of homeobox and leucine zipper encoding and BAR/IMD domain containing adaptor protein 2, transcript variant 3 by TCOL1006 antibody.

Figure 63:
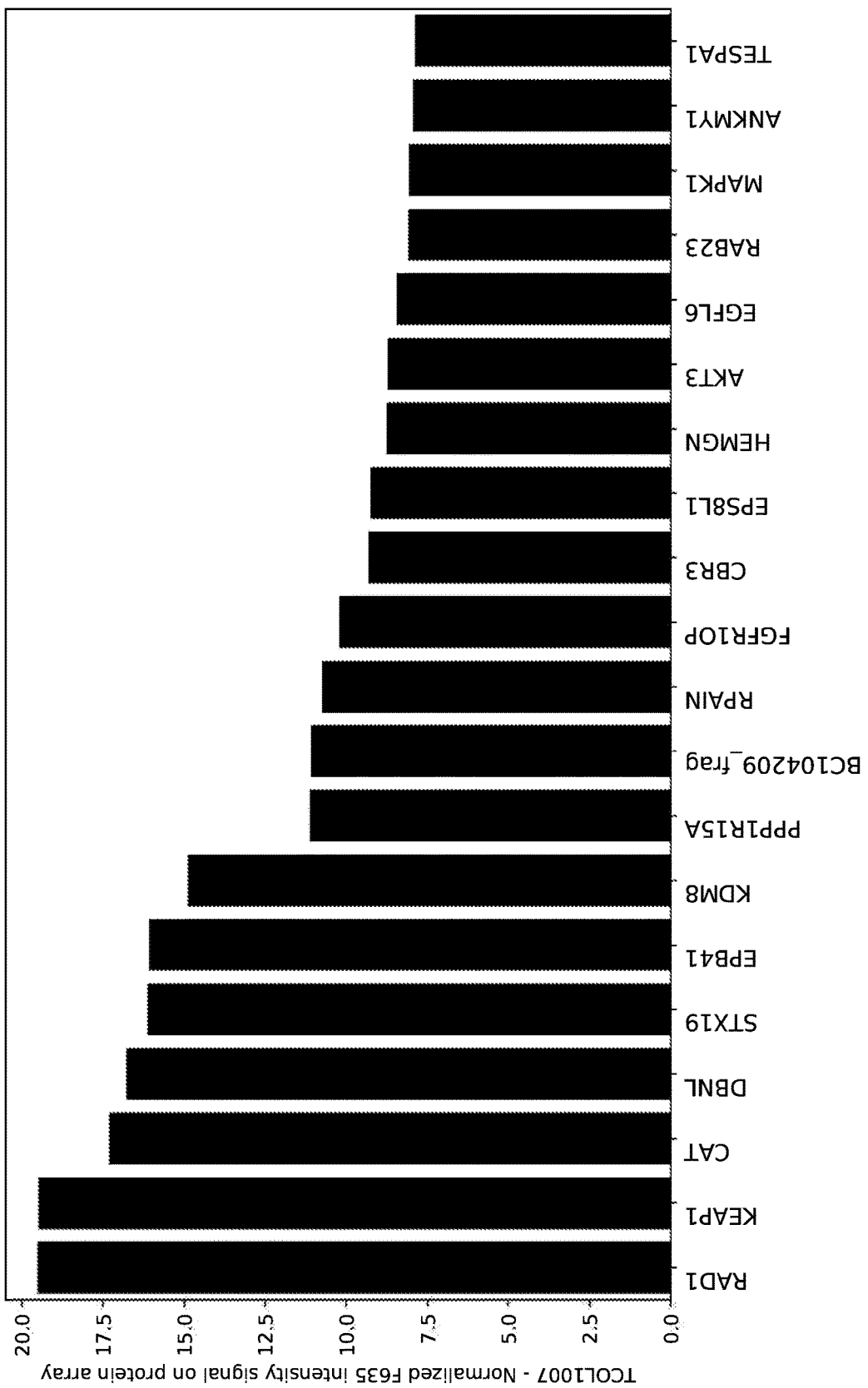

FIG. 63 is protein array data showing specific binding of kelch like ECH associated protein 1, transcript variant 1 by TCOL1007 antibody.

Figure 64:
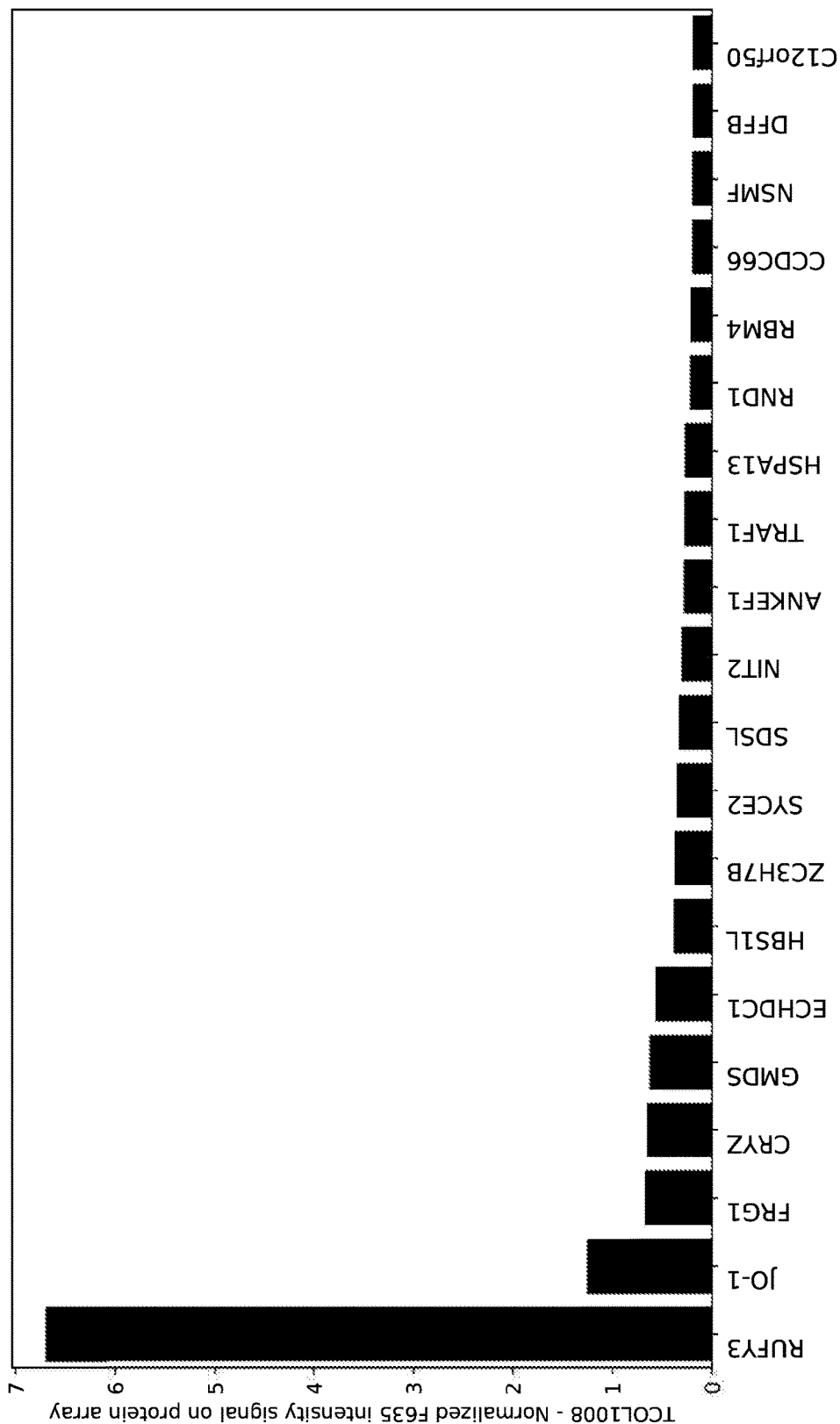

FIG. 64 is protein array data showing specific binding of RUN and FYVE domain containing 3, transcript variant 2 by TCOL1008 antibody.

Figure 65A:
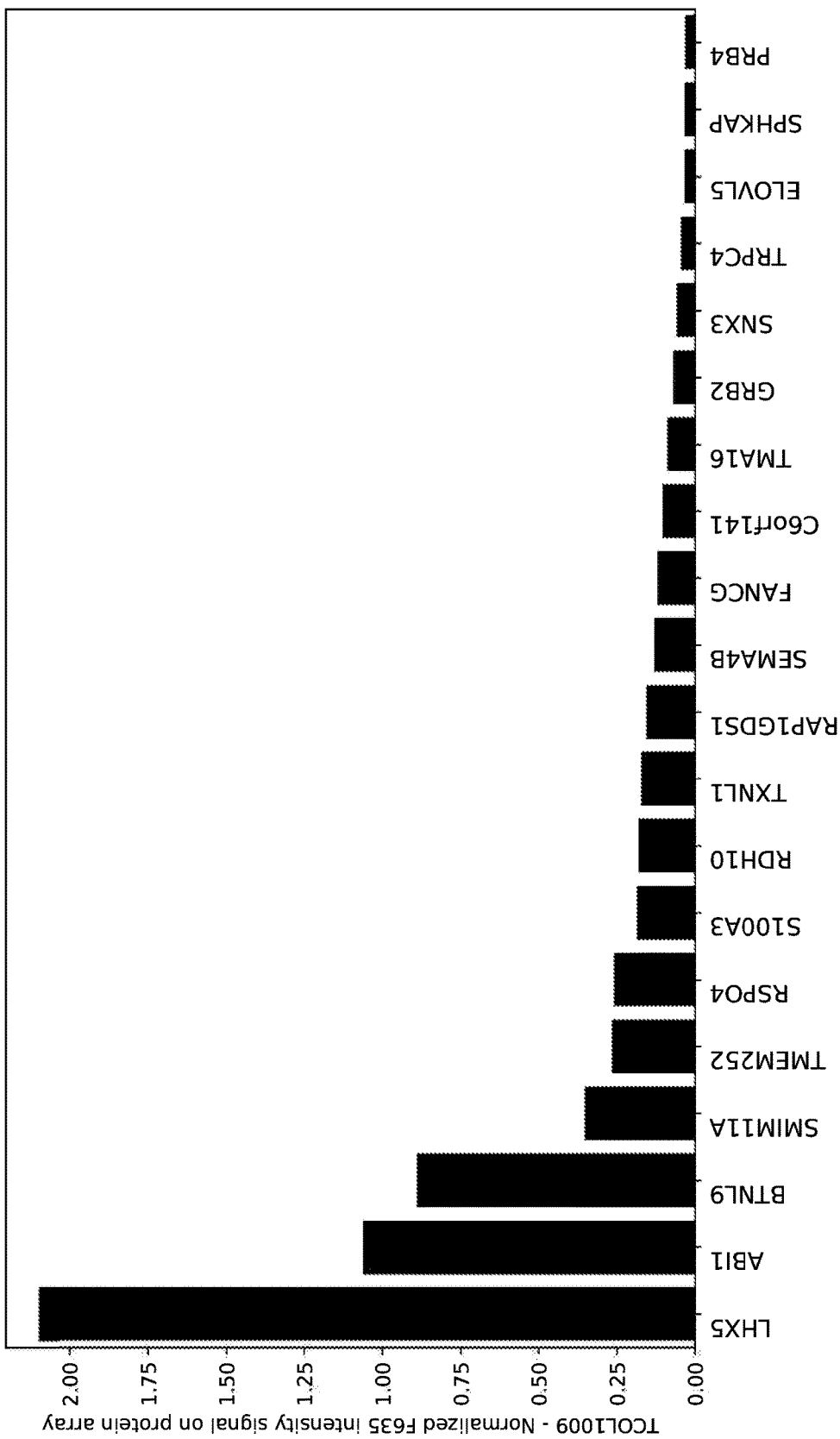
Figure 65B:
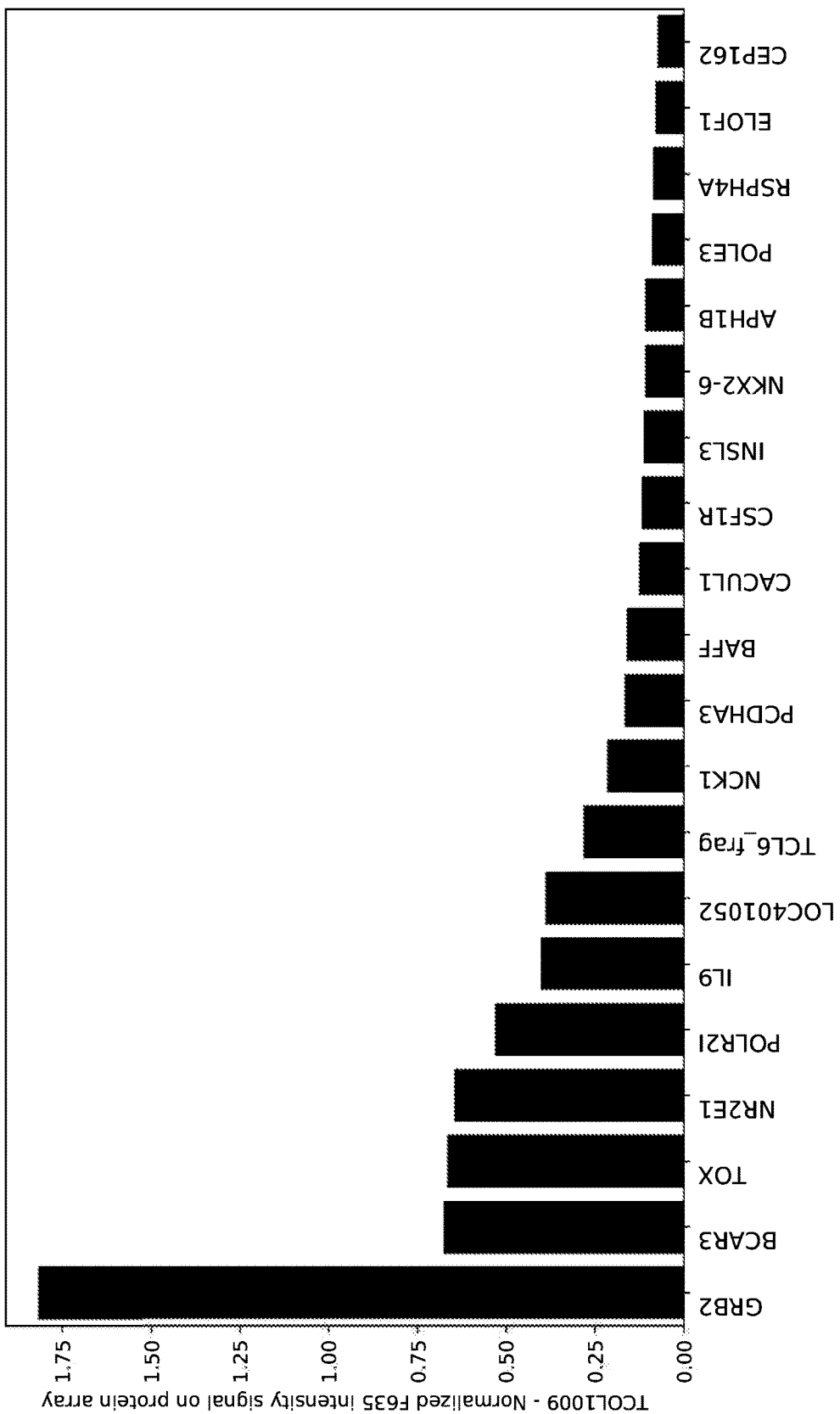

FIG. 65A is protein array data showing specific binding of LIM homeobox 5, transcript variant 2 by TCOL1009 antibody. FIG. 65B is protein array data showing specific binding of growth factor receptor bound protein 2, transcript variant 1 by TCOL1009 antibody.

Figure 66:
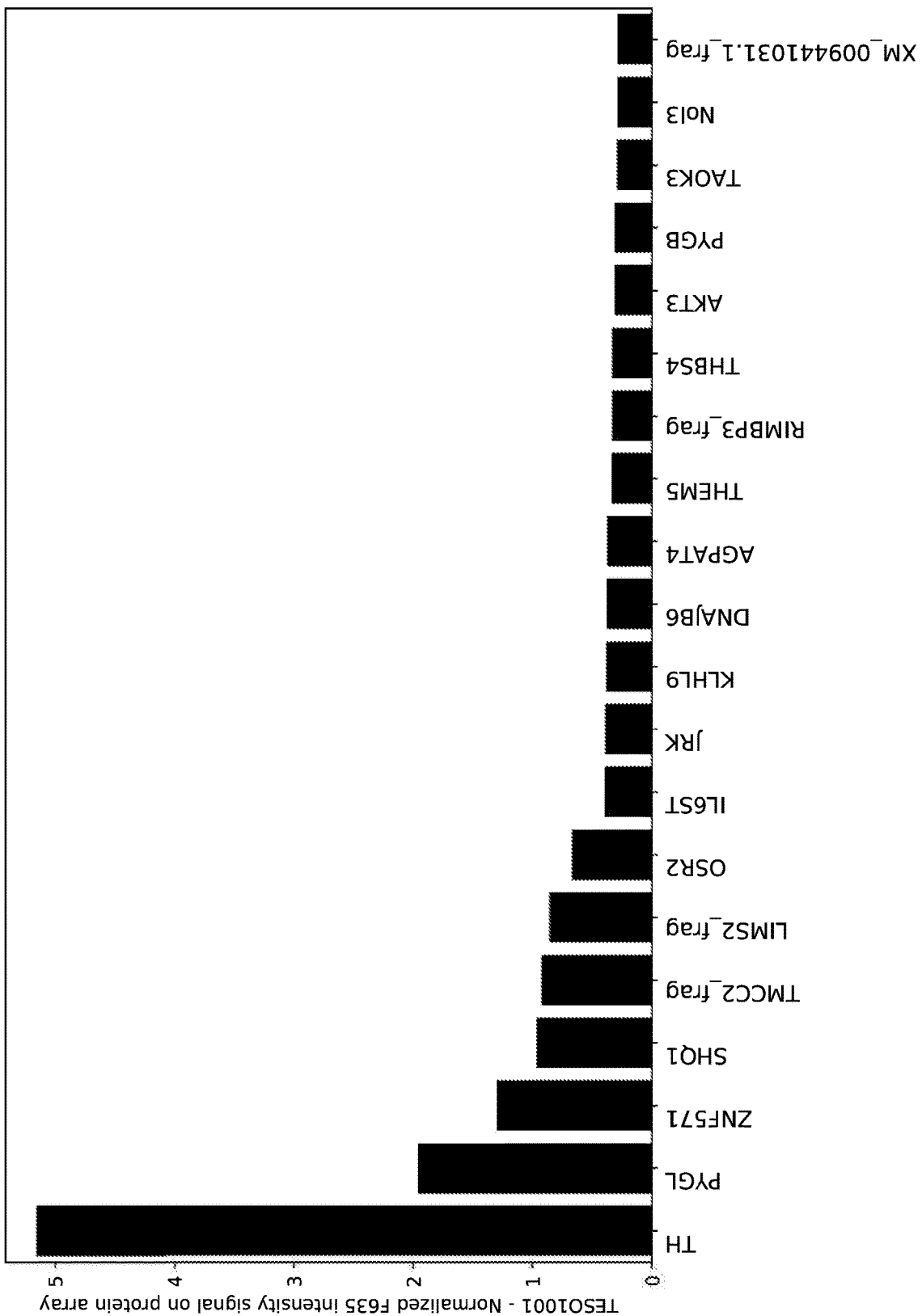

FIG. 66 is protein array data showing specific binding of Tyrosine hydroxylase by TESO1001 antibody.

Figure 67:
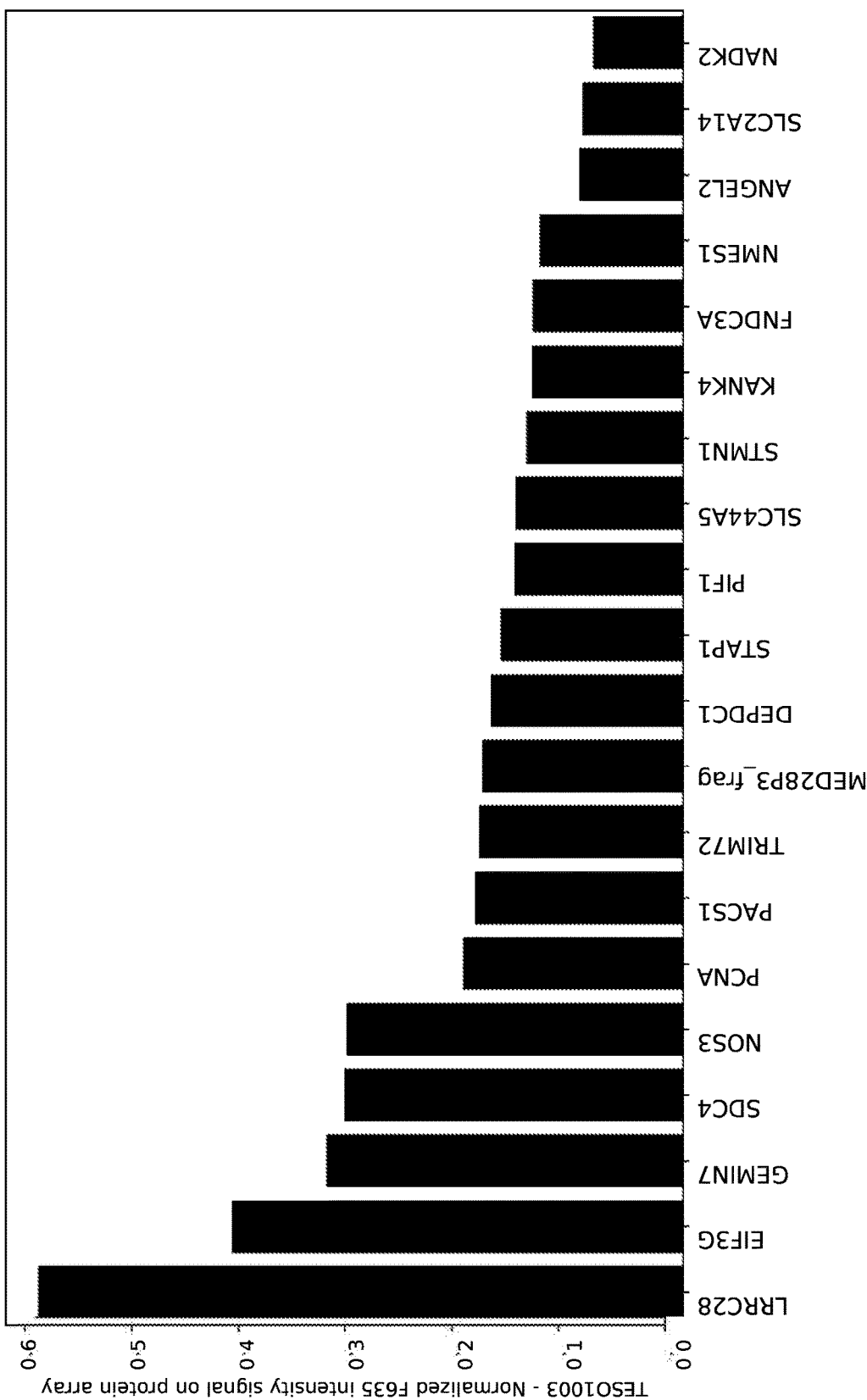

FIG. 67 is protein array data showing specific binding of leucine rich repeat containing 28, transcript variant 1 by TESO1003 antibody.

Figure 68A:
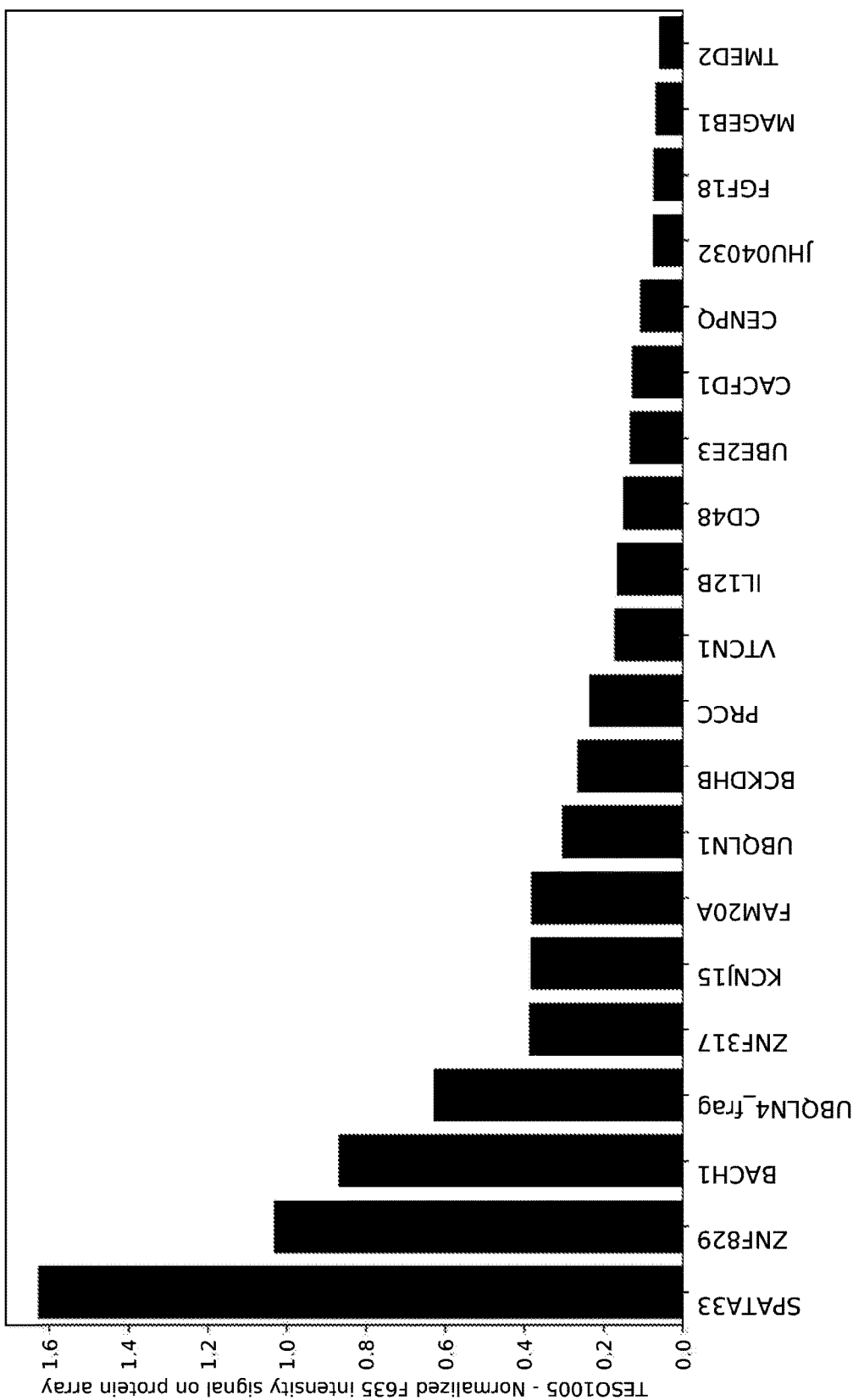
Figure 68B:
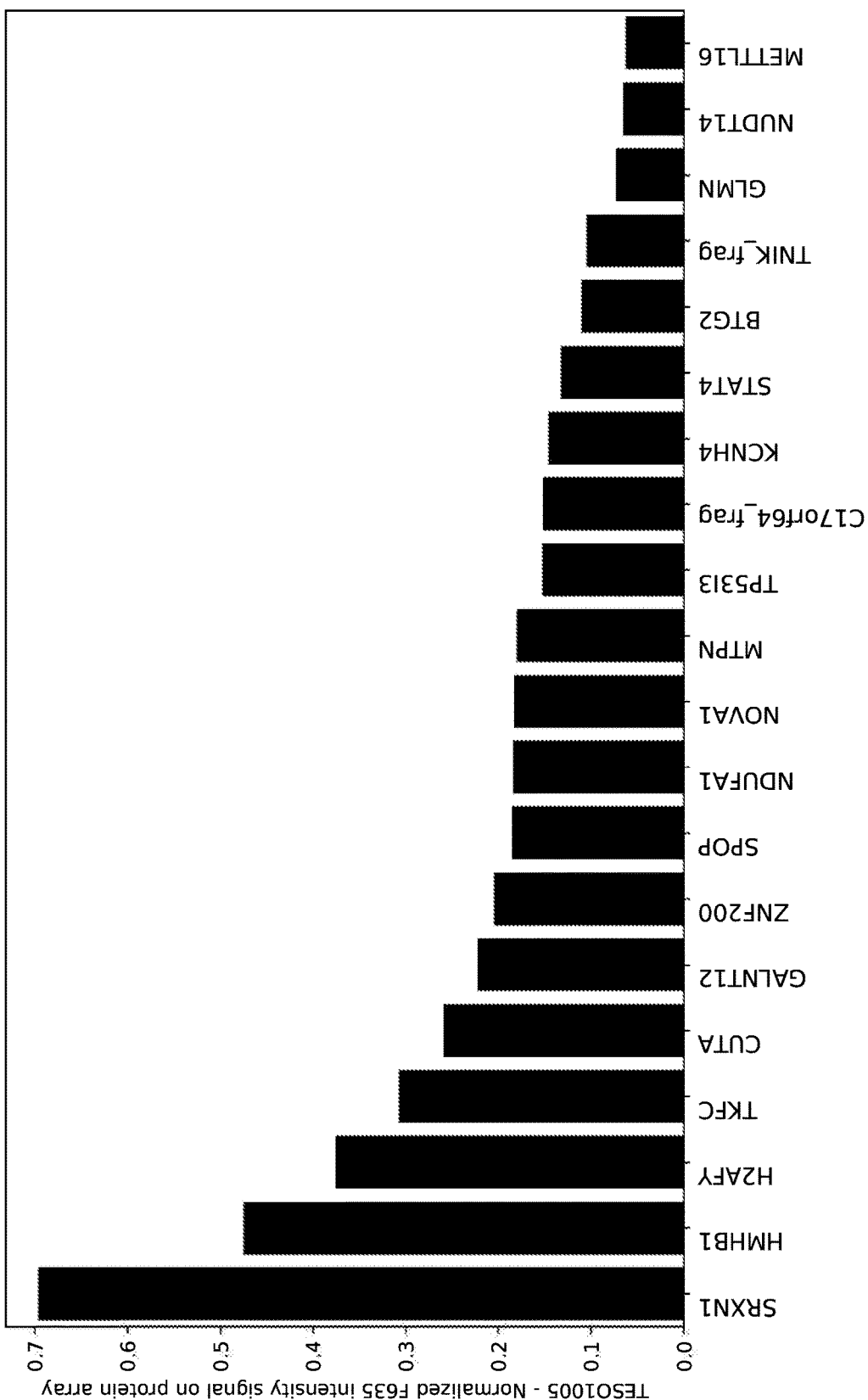

FIG. 68A is protein array data showing specific binding of spermatogenesis associated 33, transcript variant 2 by TESO1005 antibody. FIG. 68B is an experimental replicate.

Figure 69:
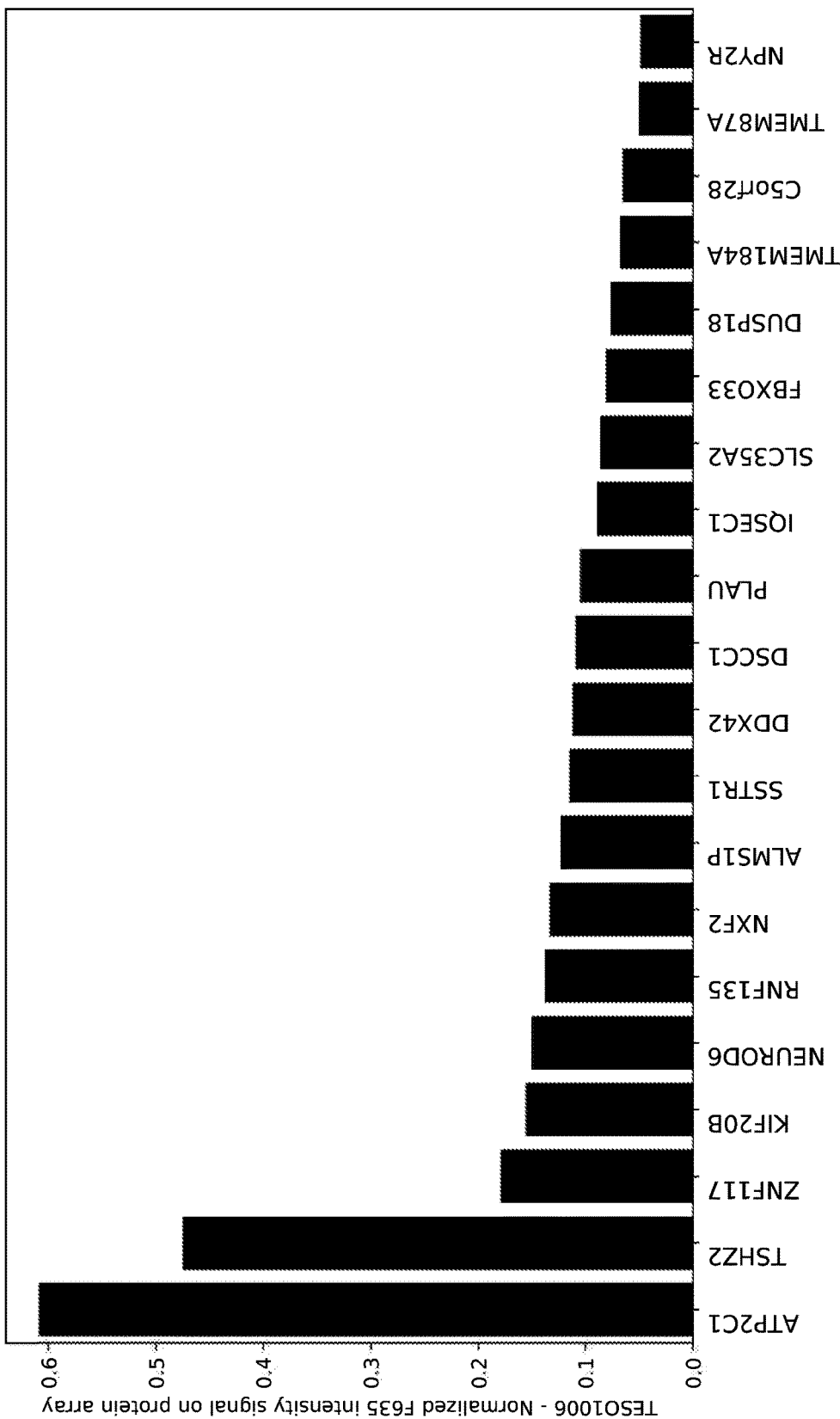

FIG. 69 is protein array data showing specific binding of Atpase secretory pathway ca2+ transporting 1, and teashirt zinc finger homeobox 2, transcript variant 1 by TESO1006 antibody.

Figure 70:
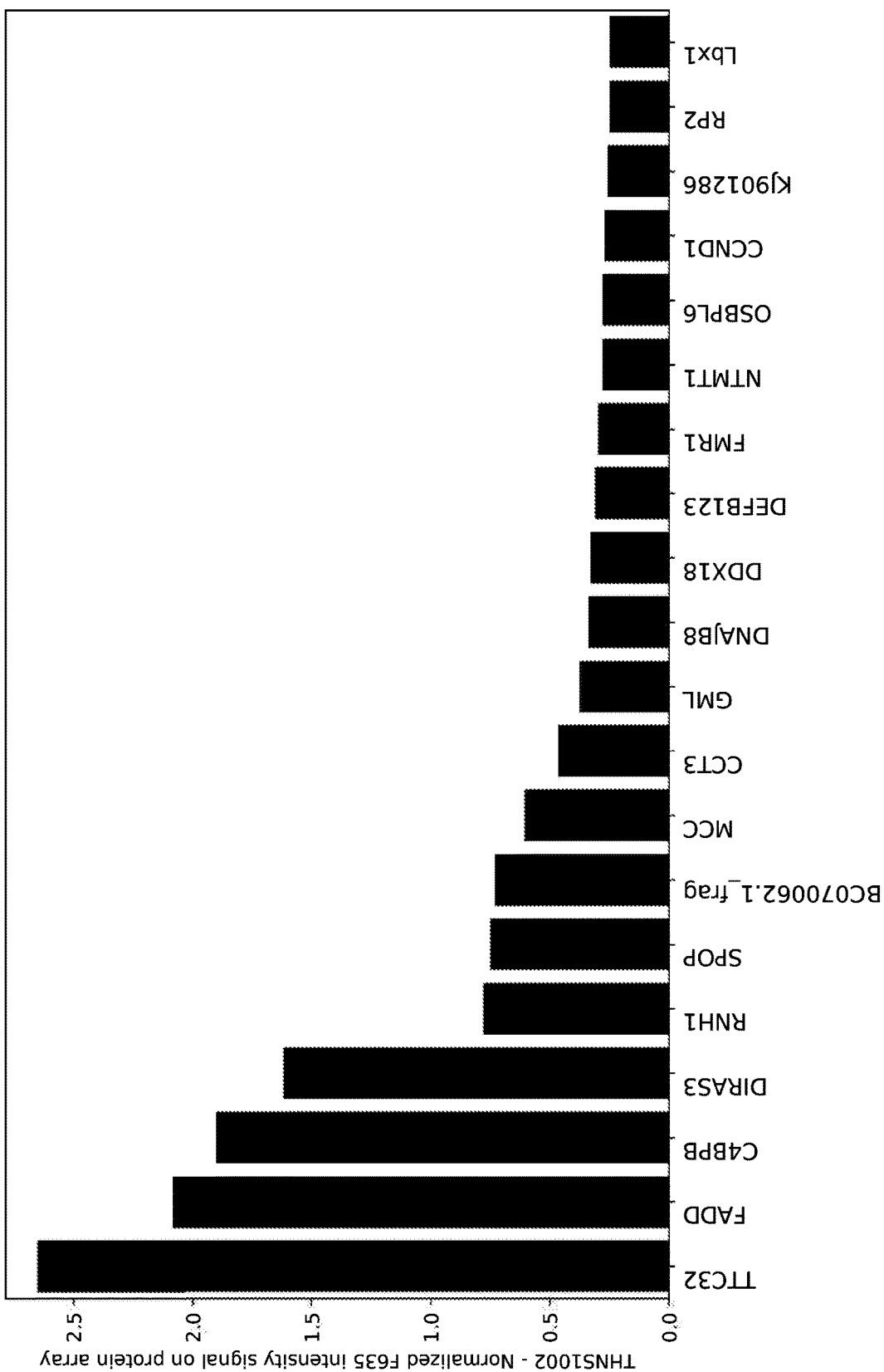

FIG. 70 is protein array data showing specific binding of Complement component 4 binding protein beta by THNS1002 antibody.

Figure 71:
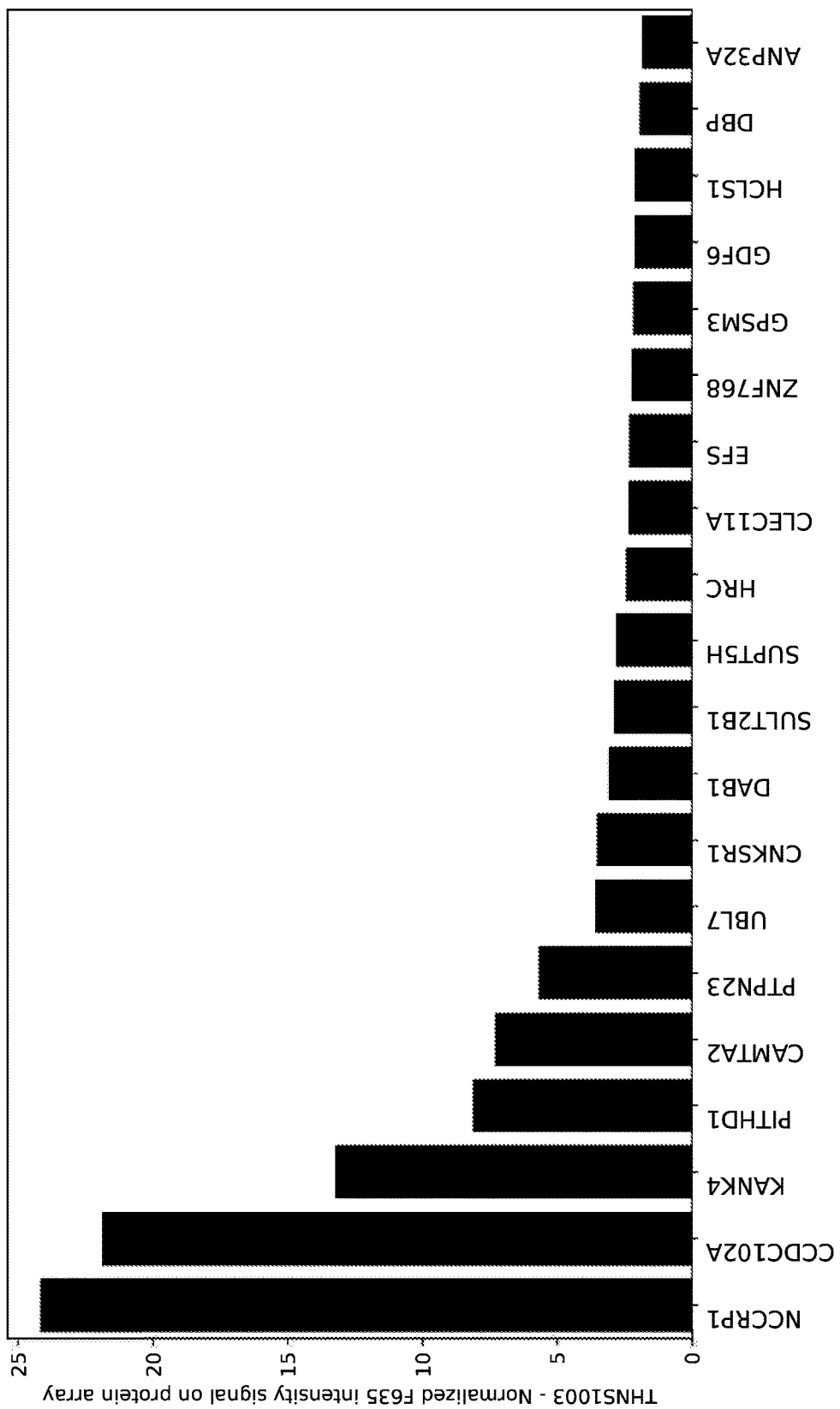

FIG. 71 is protein array data showing specific binding of NCCRP1, F-box associated domain containing, and coiled-coil domain containing 102A, transcript variant X1 by THNS1003 antibody.

Figure 72:
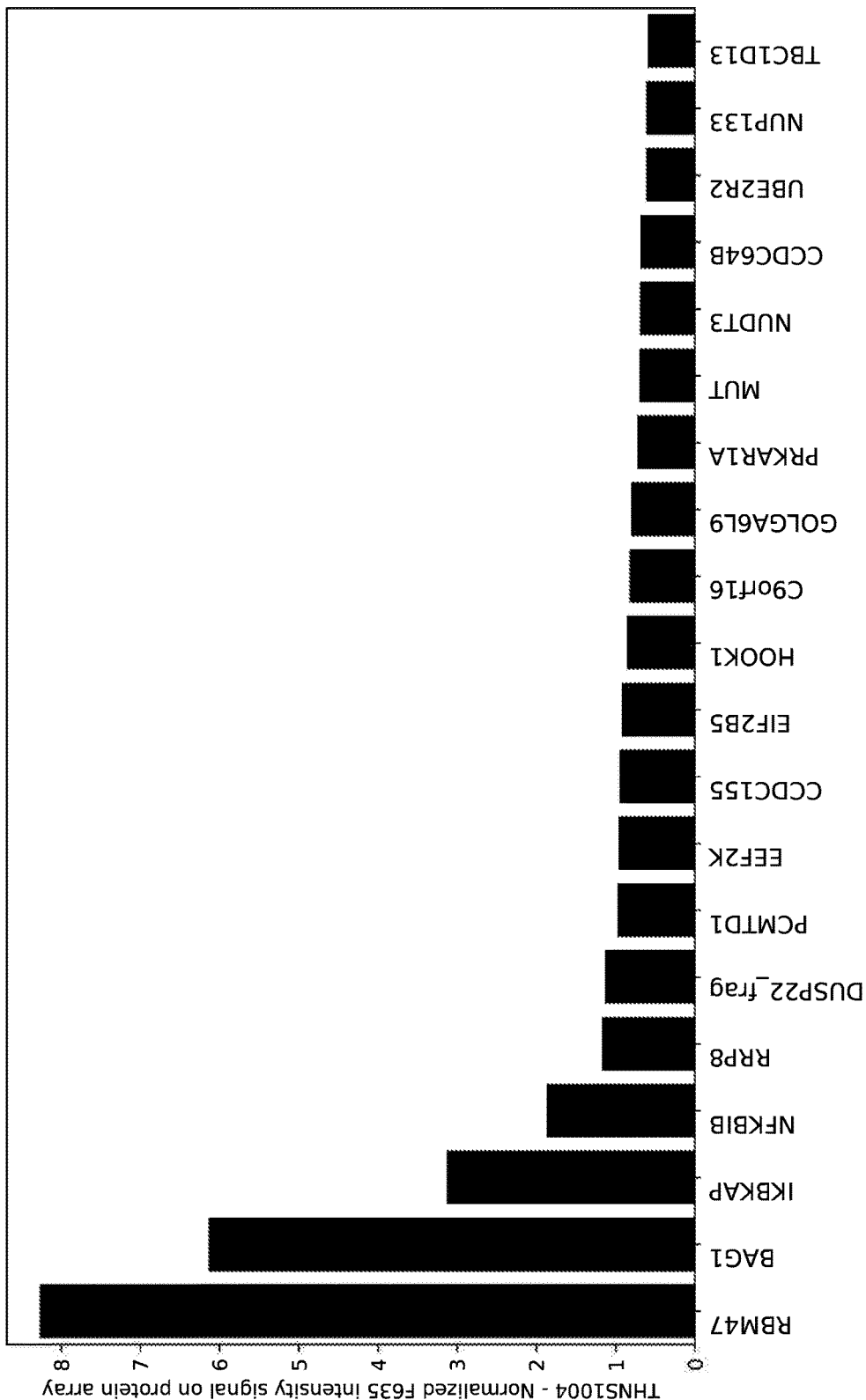

FIG. 72 is protein array data showing specific binding of RNA binding motif protein 47, transcript variant X10 by THNS1004 antibody.

Figure 73:
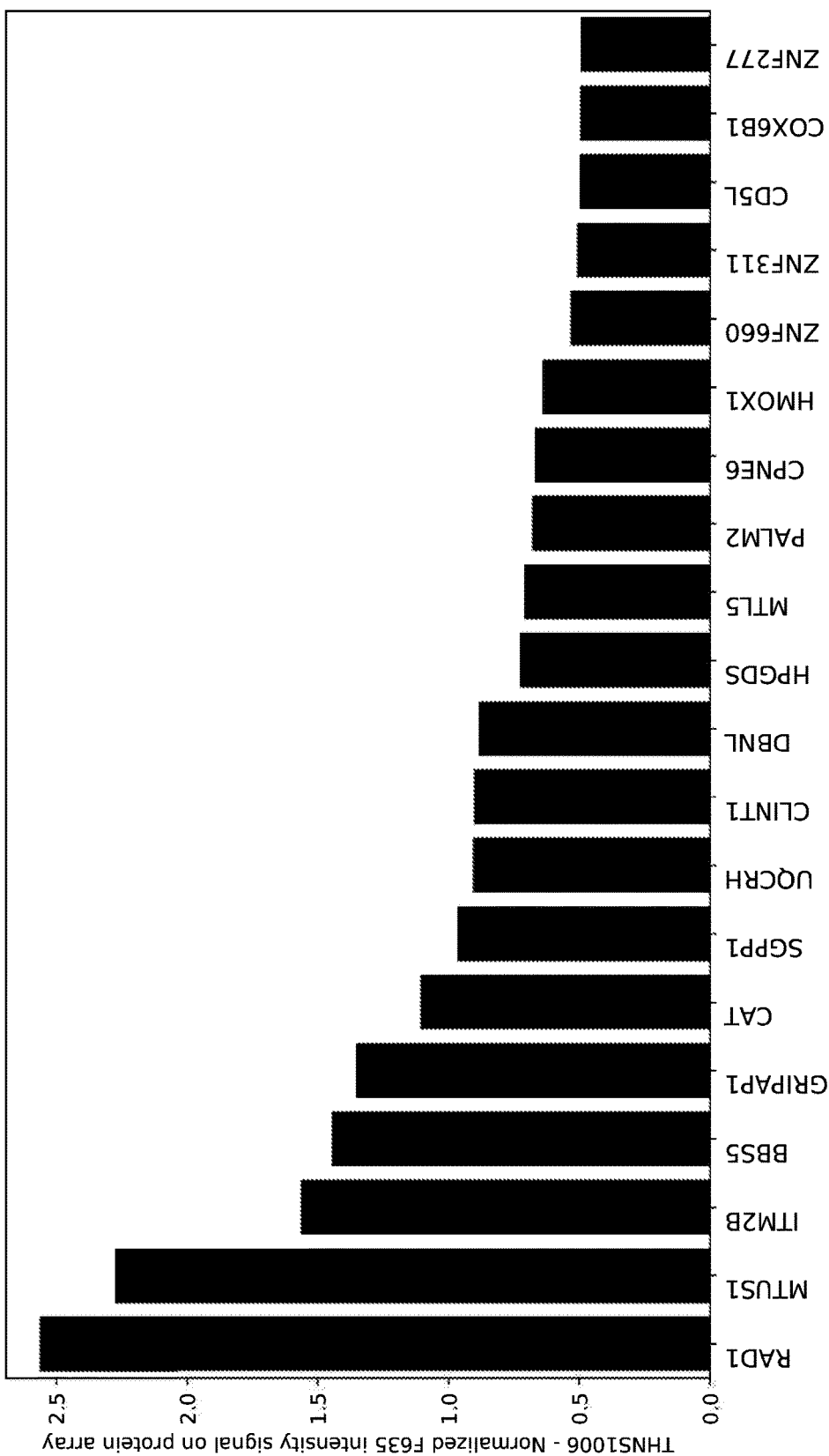

FIG. 73 is protein array data showing specific binding of RAD1 checkpoint DNA exonuclease, transcript variant 1, and Microtubule associated scaffold protein 1 by THNS1006 antibody.

Figure 74:
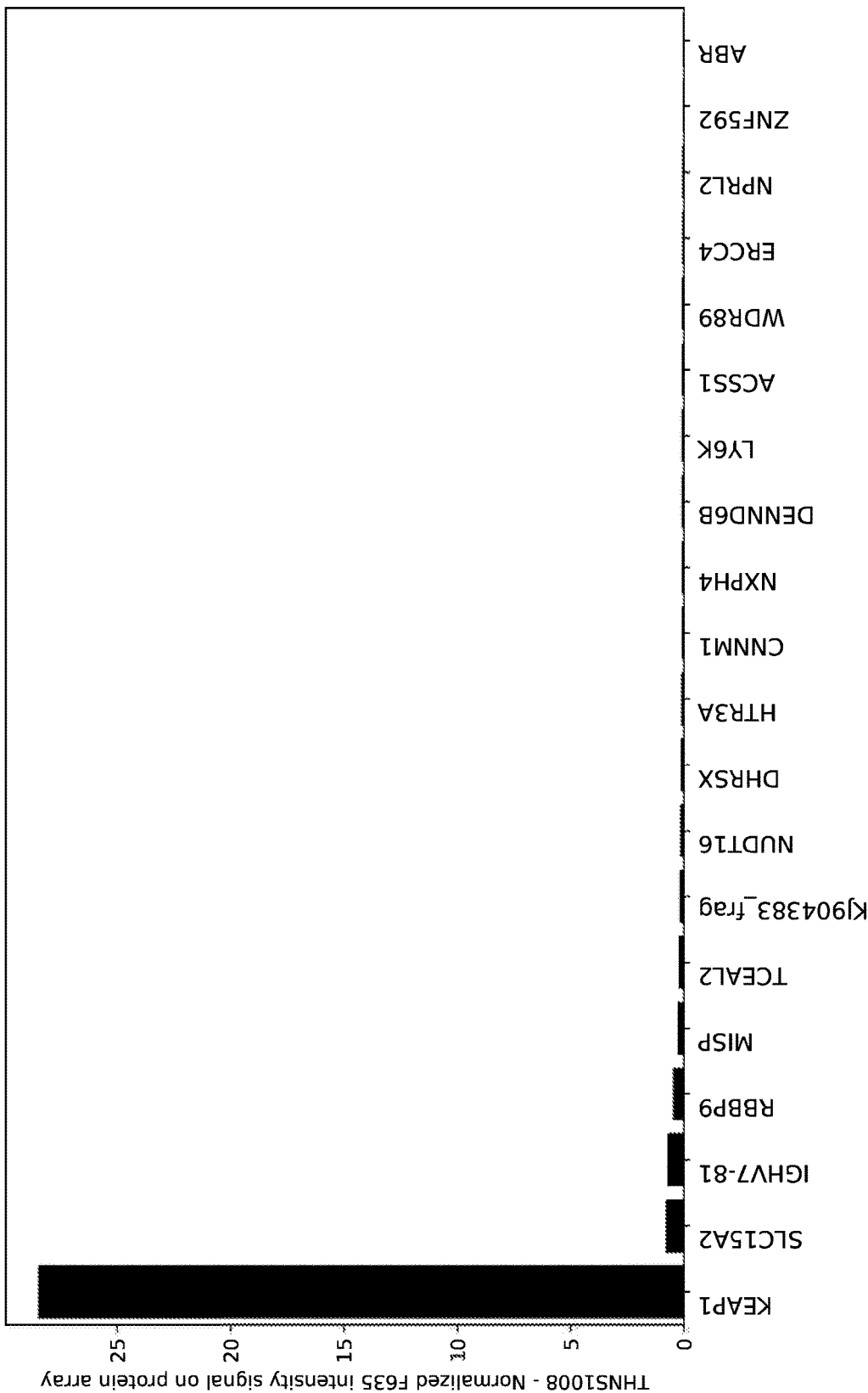

FIG. 74 is protein array data showing specific binding of kelch like ECH associated protein 1, transcript variant 1 by THNS1008 antibody.

Figure 75:
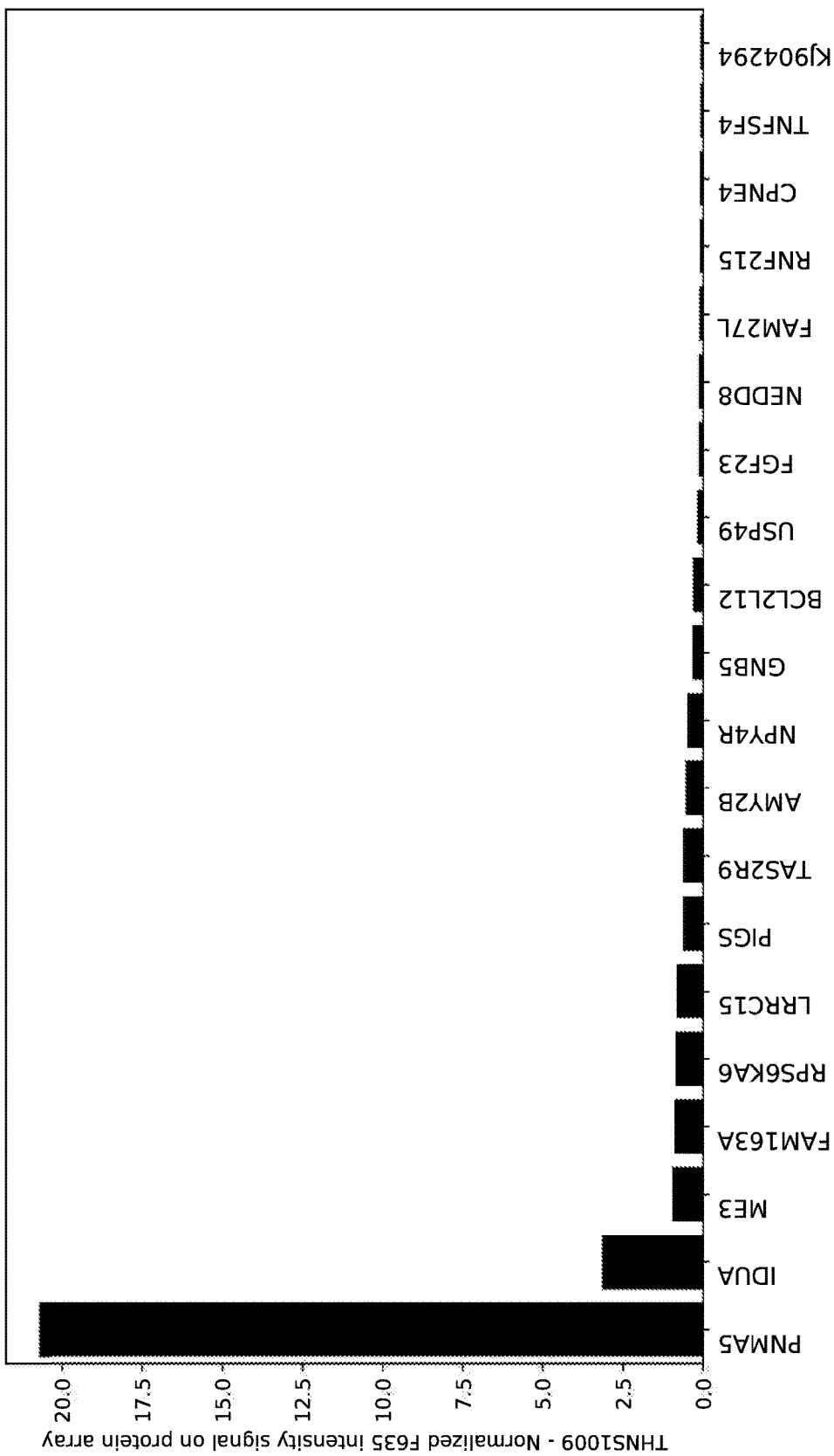

FIG. 75 is protein array data showing specific binding of PNMA family member 5, transcript variant 2 by THNS1009 antibody.

Figure 76:
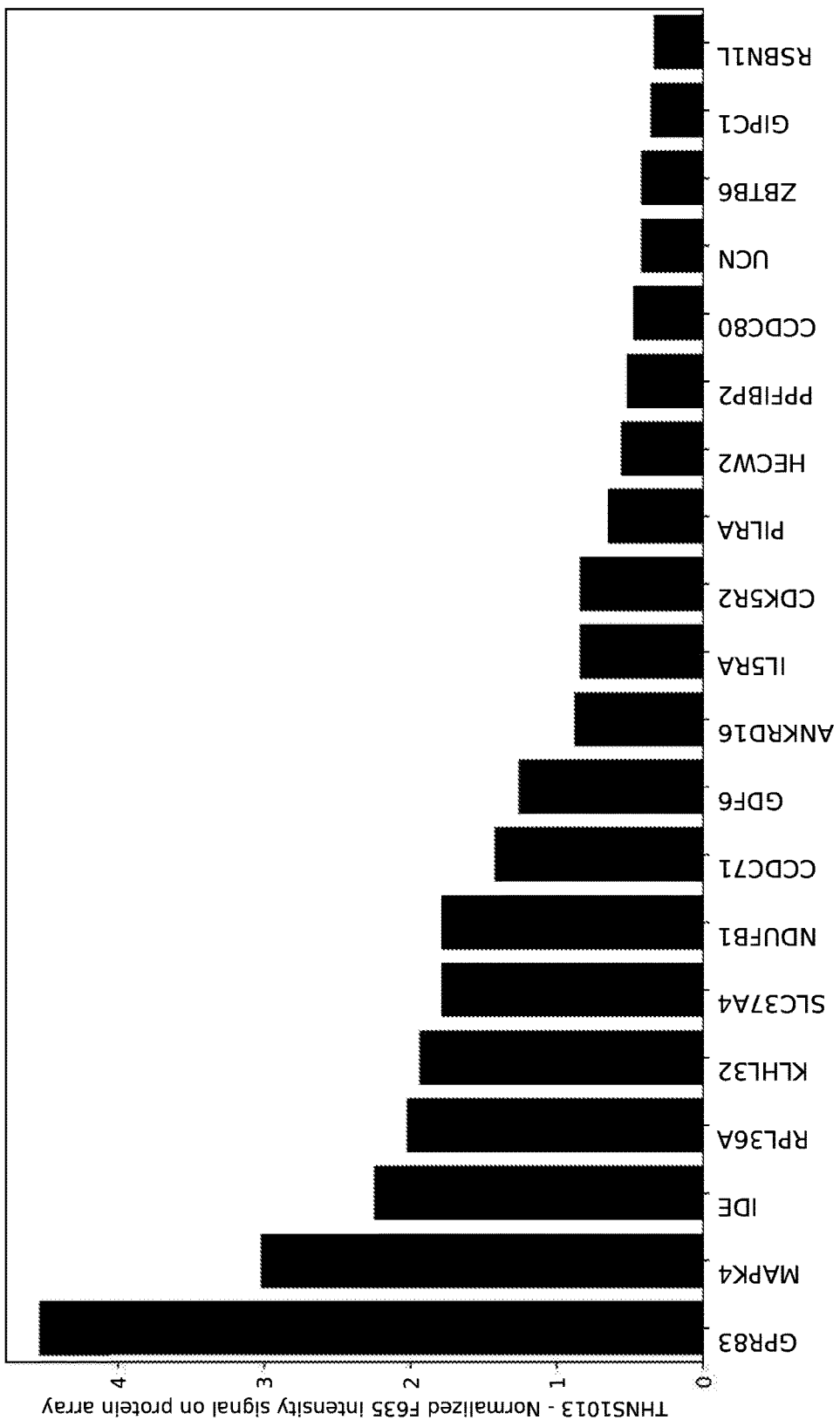

FIG. 76 is protein array data showing specific binding of G protein-coupled receptor 83, transcript variant 1 by THNS1013 antibody.

Figure 77:
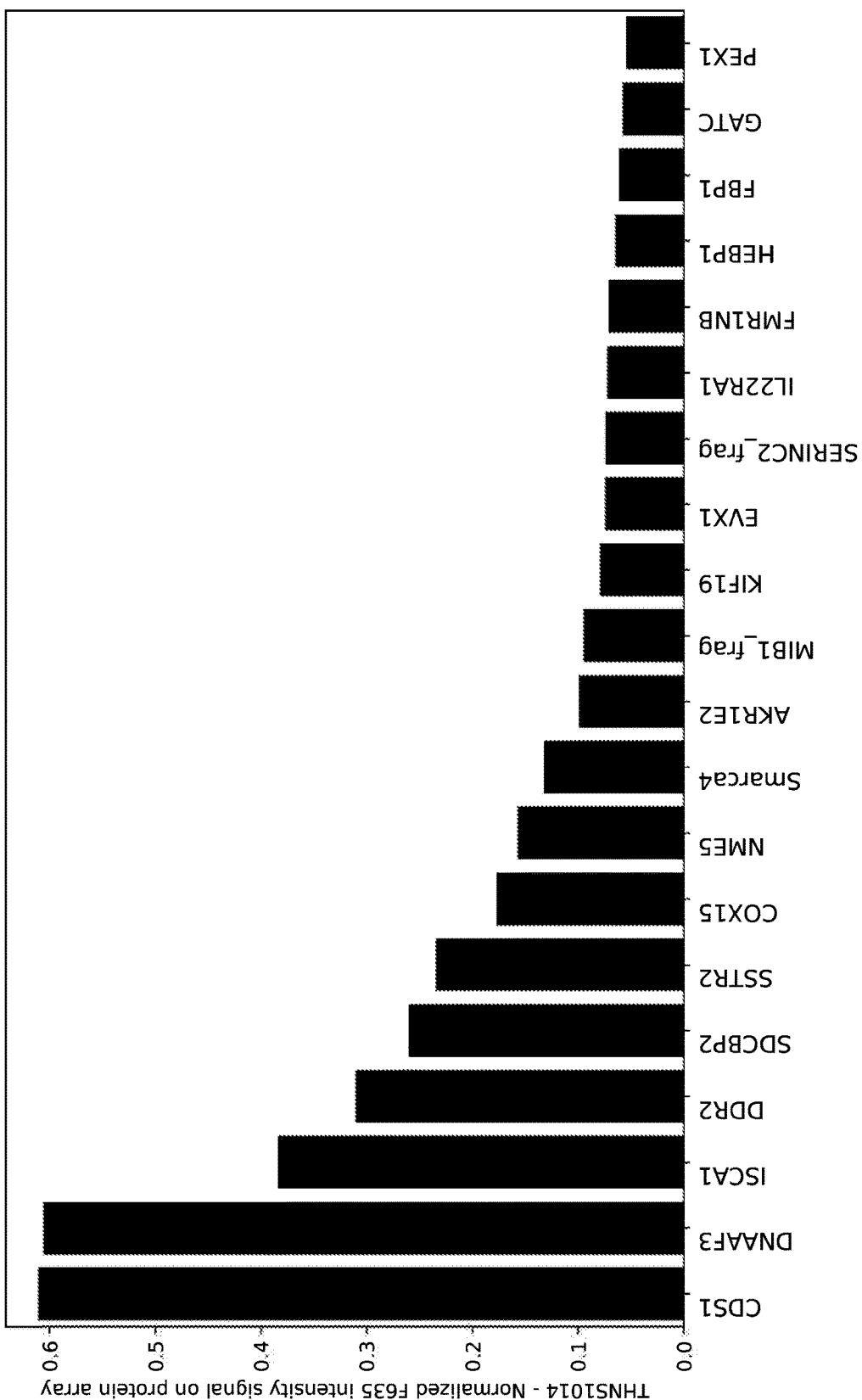

FIG. 77 is protein array data showing specific binding of CDP-diacylglycerol synthase 1, and dynein axonemal assembly factor 3, transcript variant 3 by THNS1014 antibody.

Figure 78:
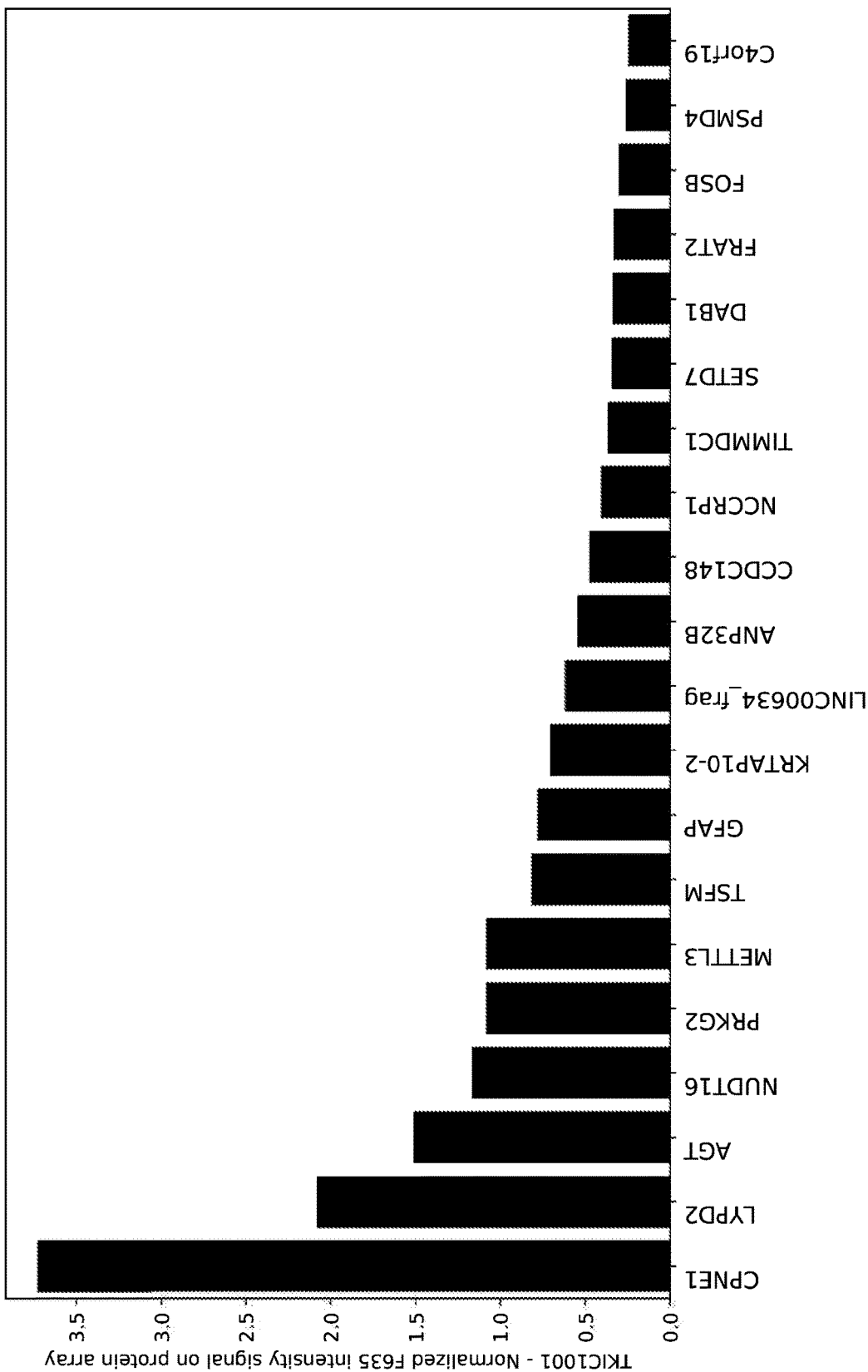

FIG. 78 is protein array data showing specific binding of copine 1, transcript variant 2 by TKIC1001 antibody.

Figure 79:
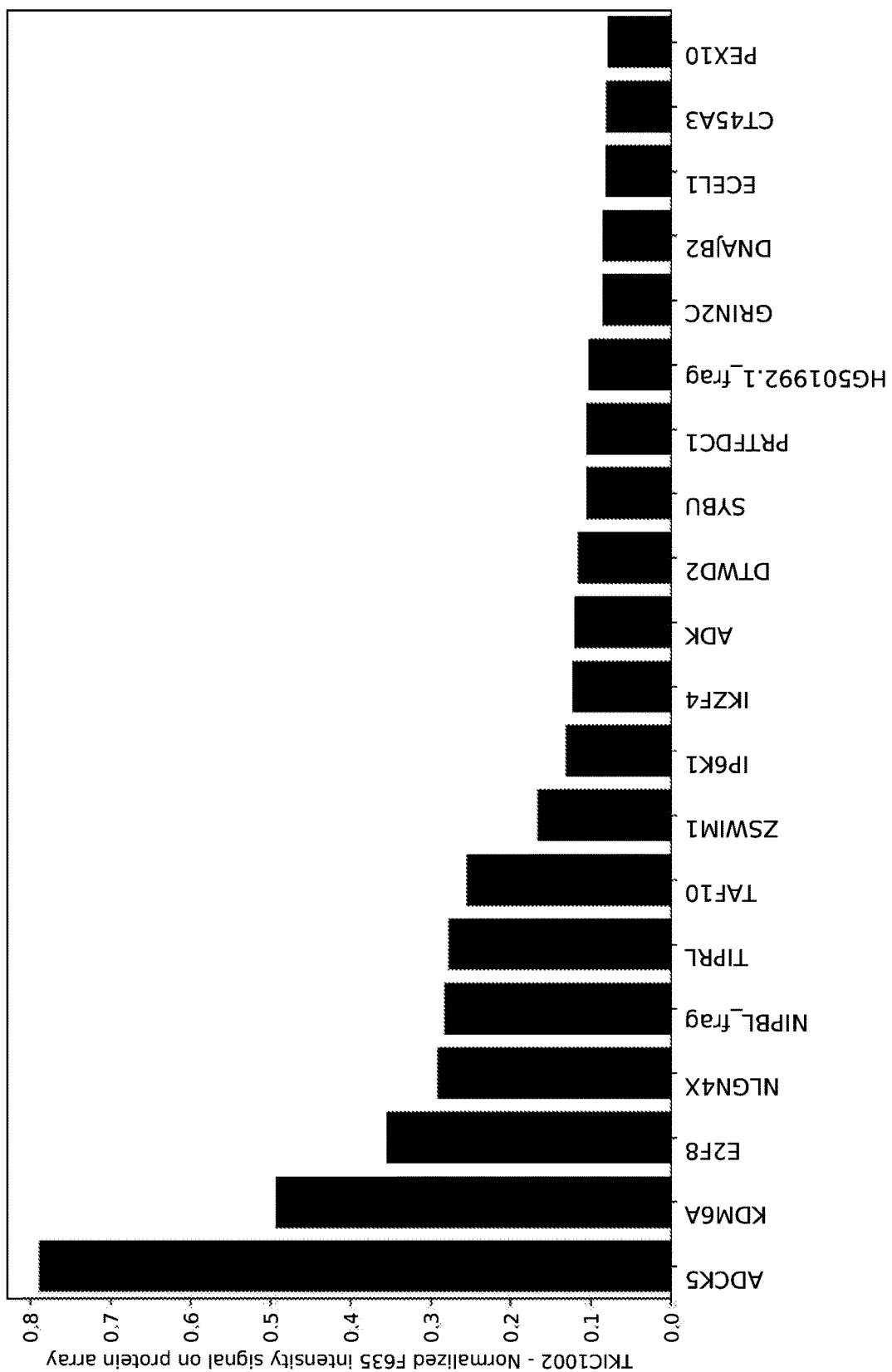

FIG. 79 is protein array data showing specific binding of aarF domain containing kinase 5 by TKIC1002 antibody.

Figure 80:
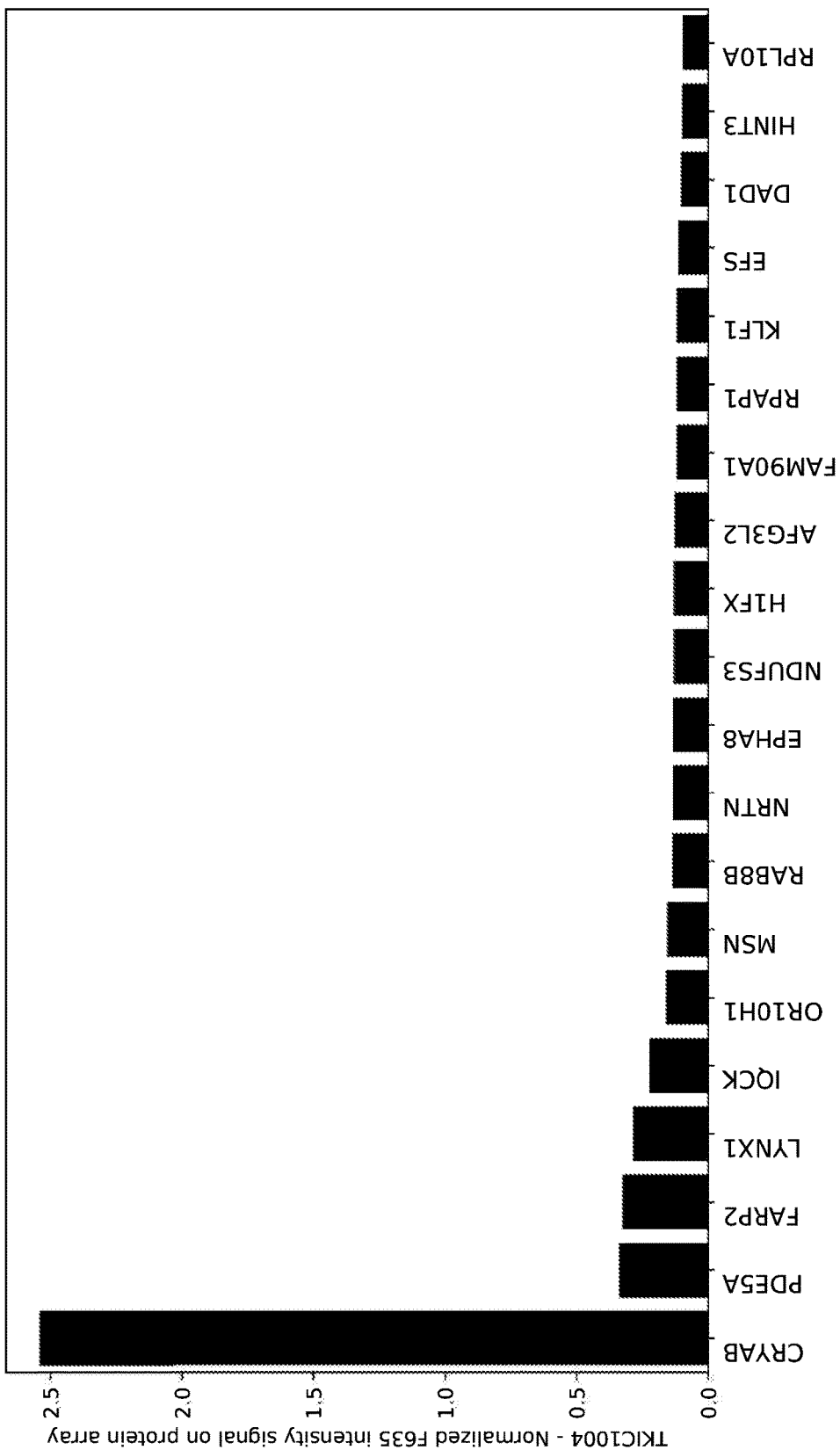

FIG. 80 is protein array data showing specific binding of crystallin alpha B, transcript variant 2 by TKIC1004 antibody.

Figure 81:
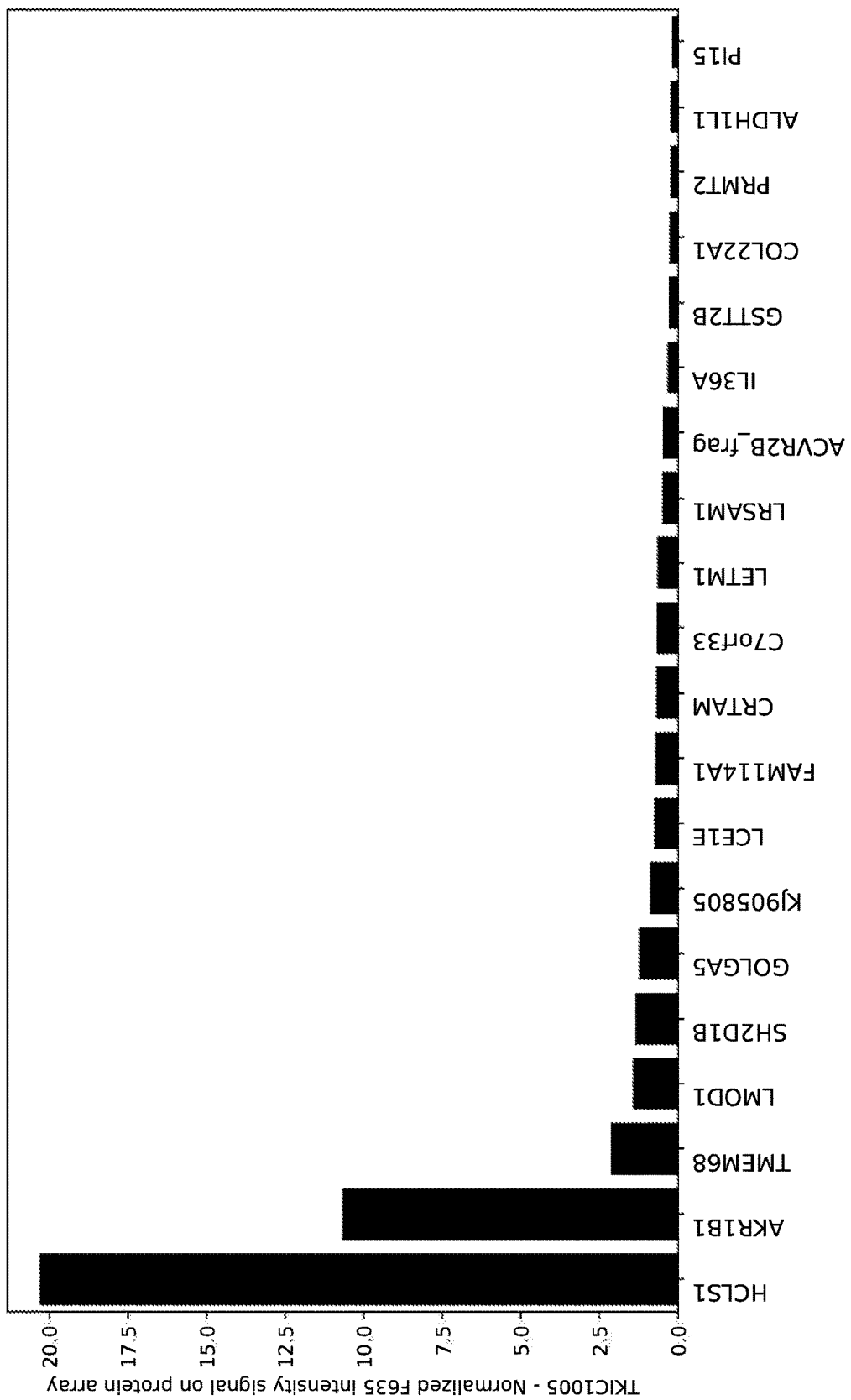

FIG. 81 is protein array data showing specific binding of hematopoietic cell-specific Lyn substrate 1, transcript variant 1 by TKIC1005 antibody.

Figure 82:
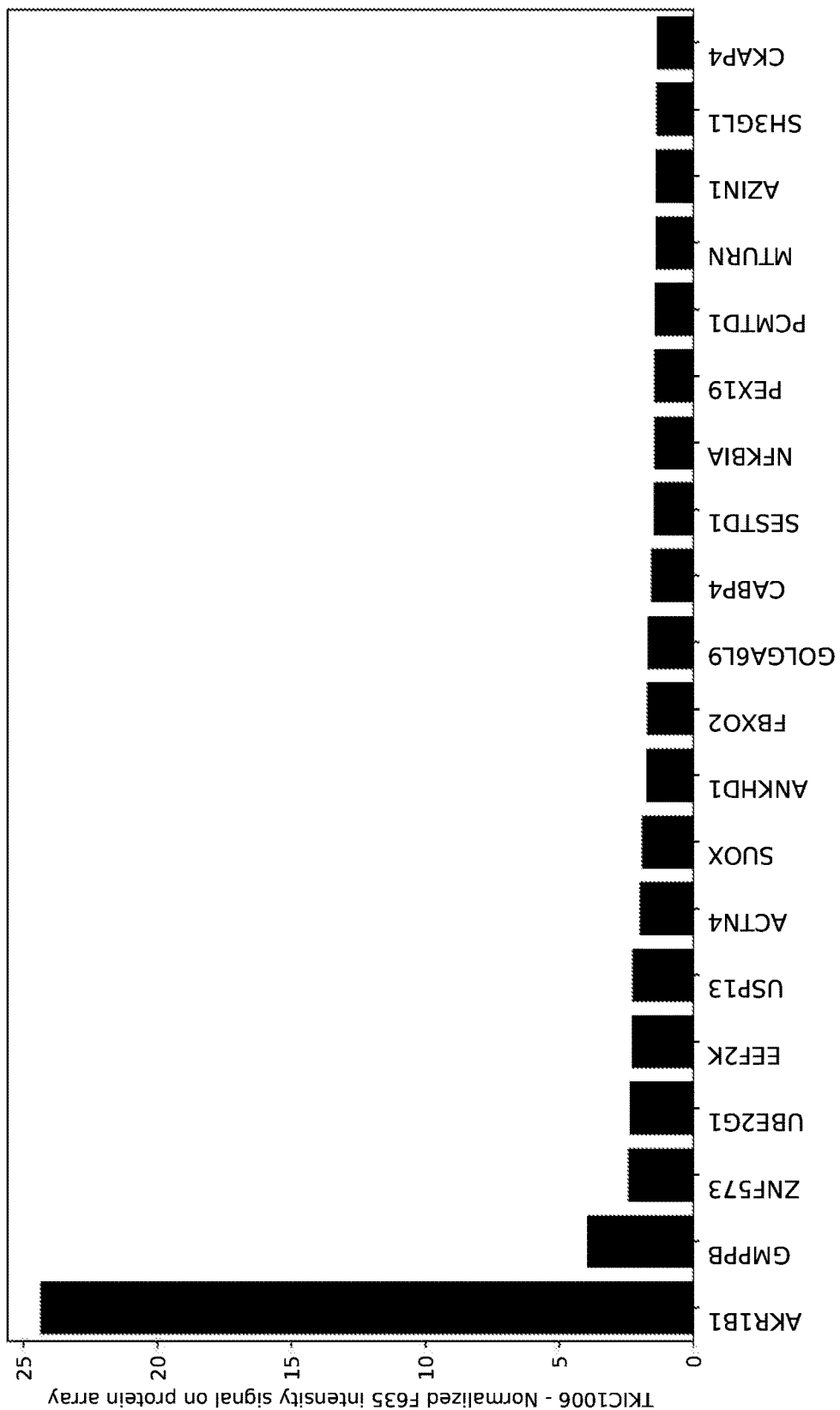

FIG. 82 is protein array data showing specific binding of aldo-keto reductase family 1 member B, transcript variant 1 by TKIC1006 antibody.

Figure 83:
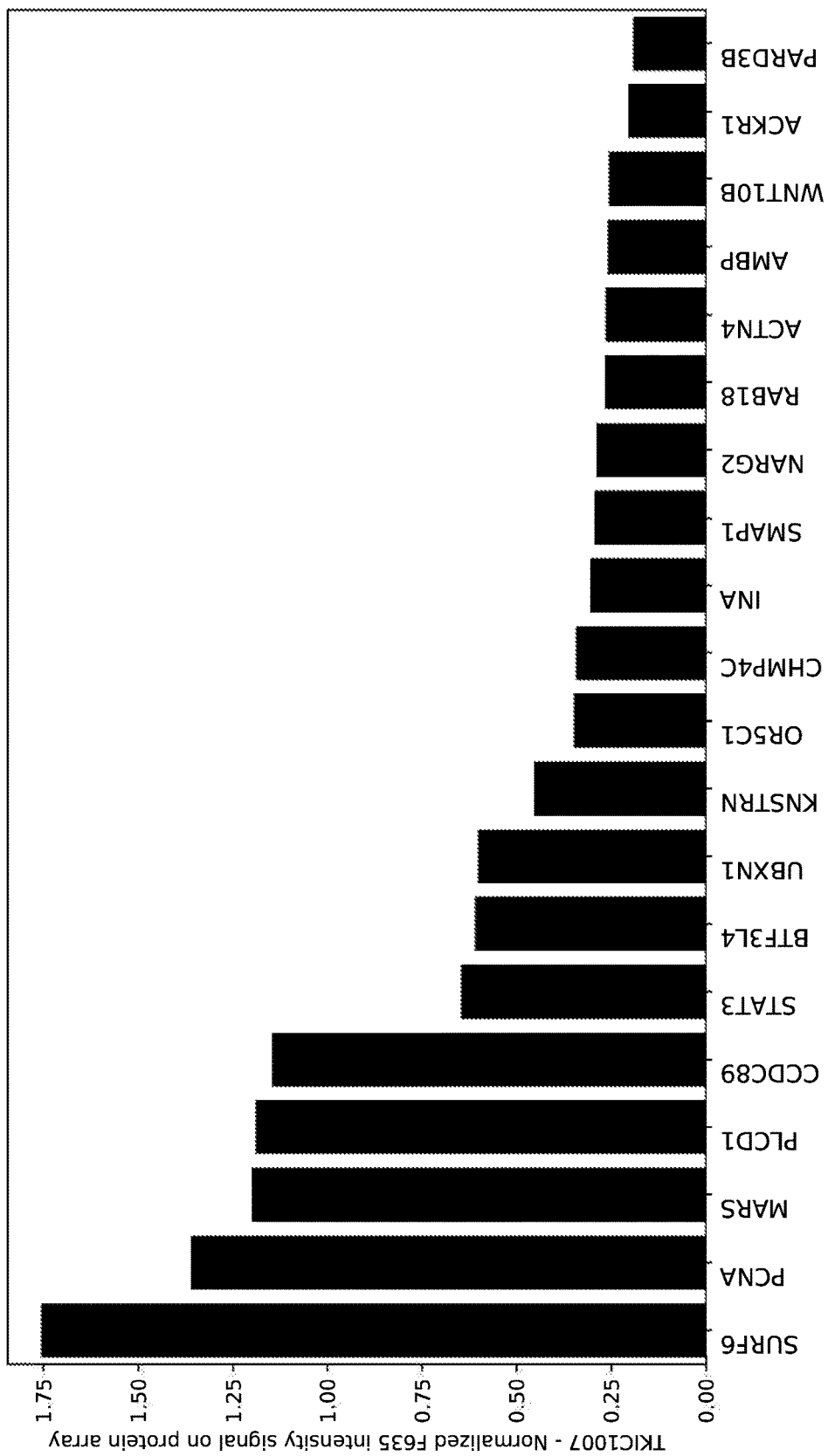

FIG. 83 is protein array data showing specific binding of surfeit 6, transcript variant 1 by TKIC1007 antibody.

Figure 84A:
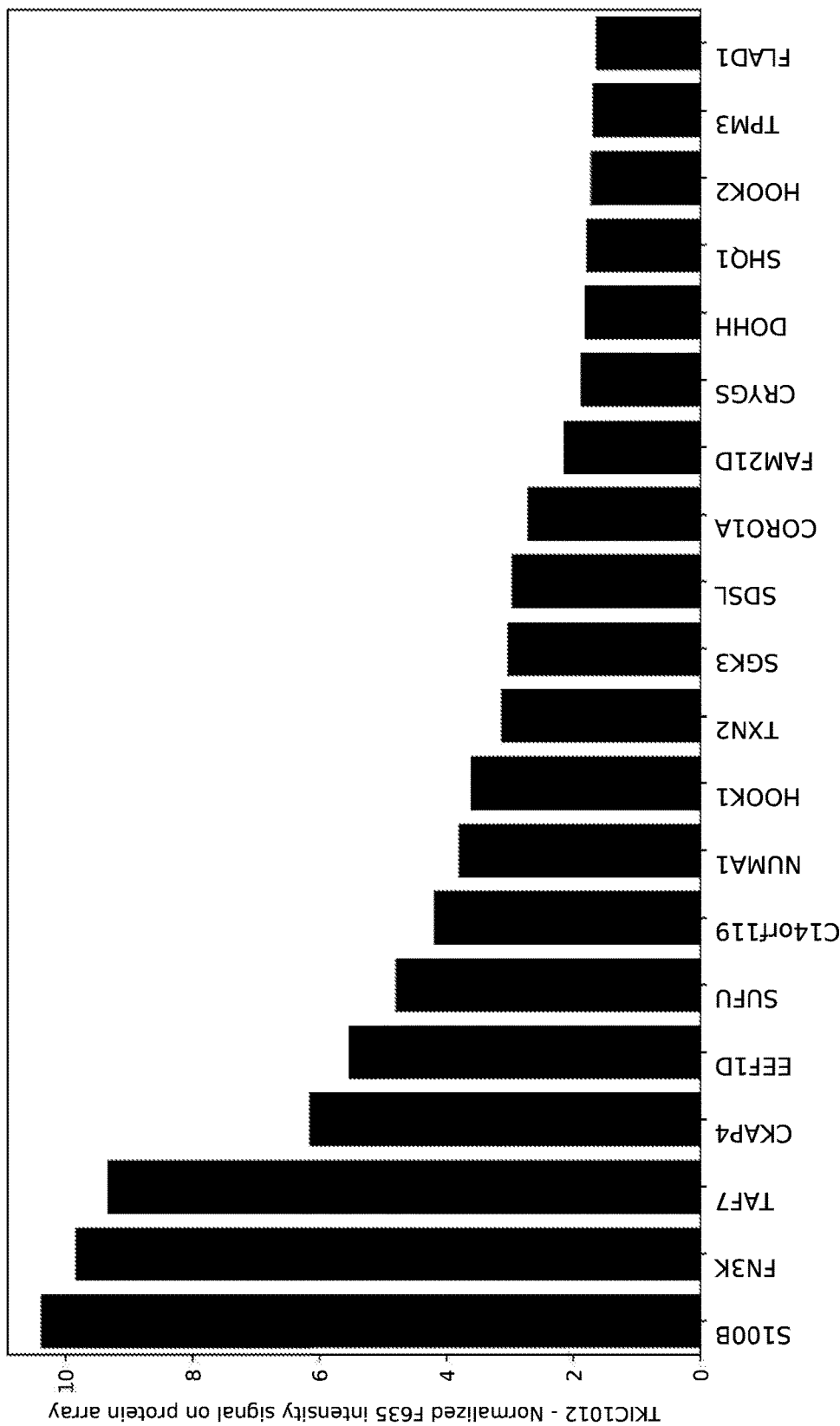
Figure 84B:
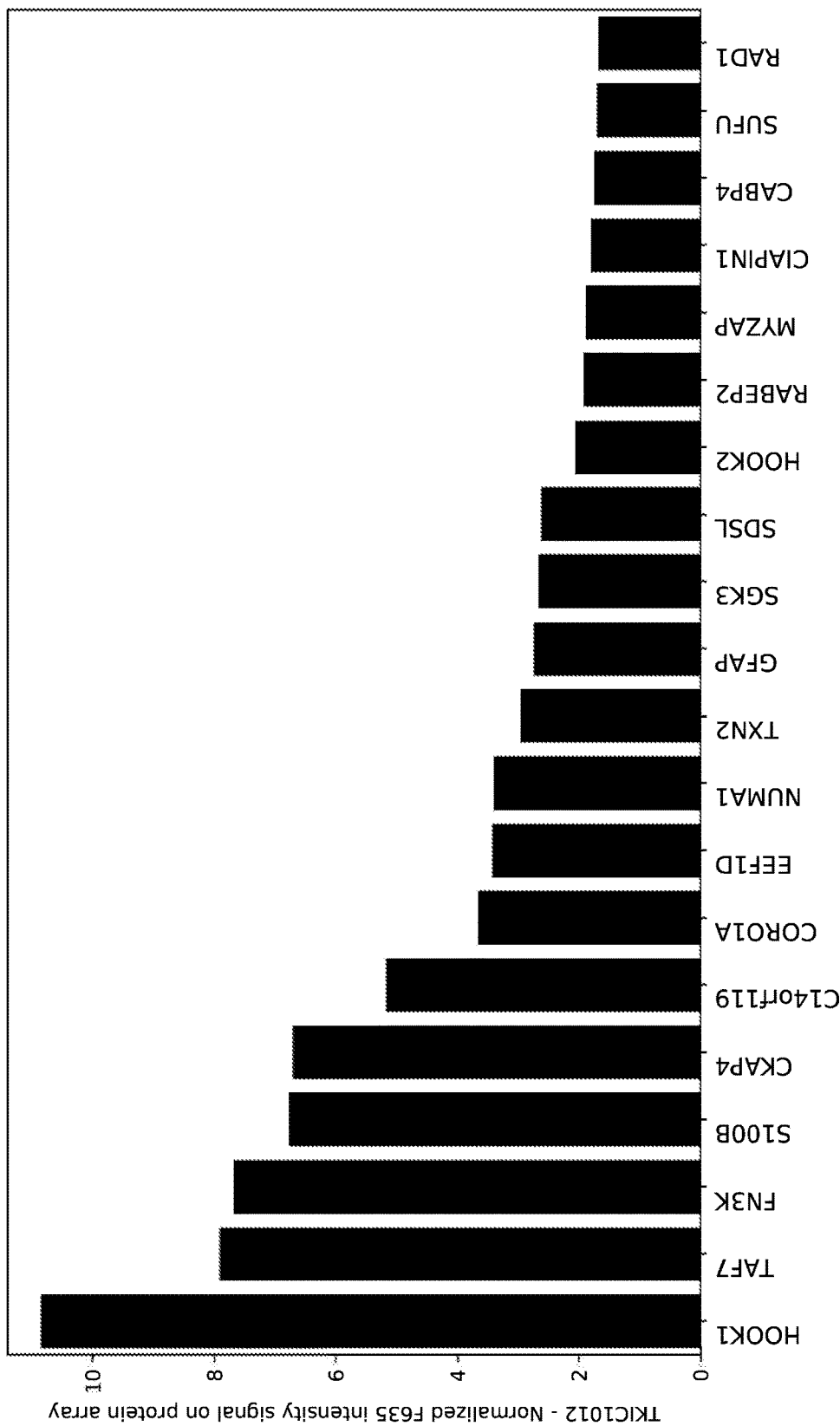

FIG. 84A is protein array data showing specific binding of S100 calcium binding protein B by TKIC10012 antibody. FIG. 84B is an experimental replicate showing specific binding of S100 calcium binding protein B by TKIC10012 antibody.

Figure 85:
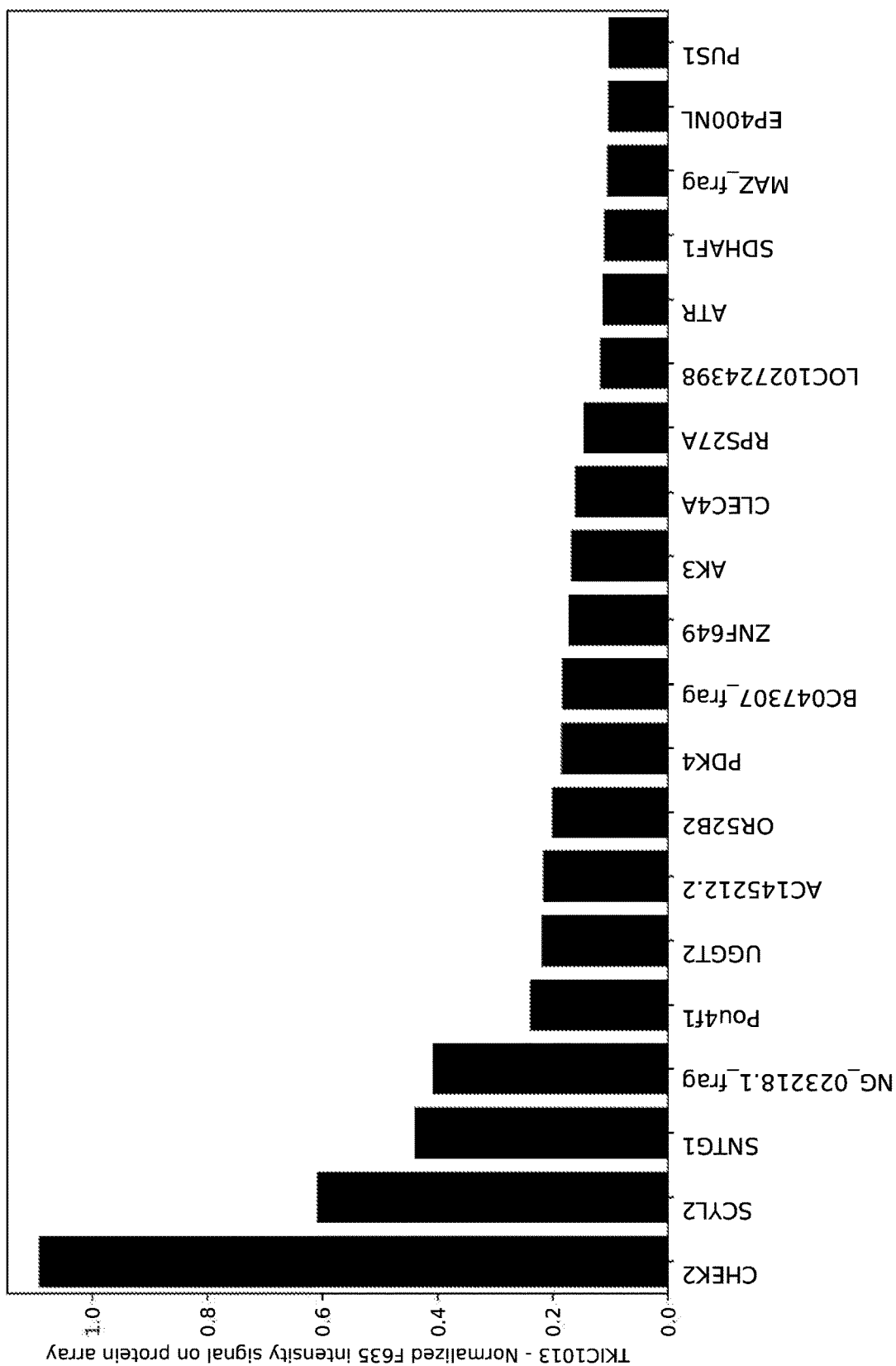

FIG. 85 is protein array data showing specific binding of checkpoint kinase 2, transcript variant 3 by TKIC10013 antibody.

Figure 86A:
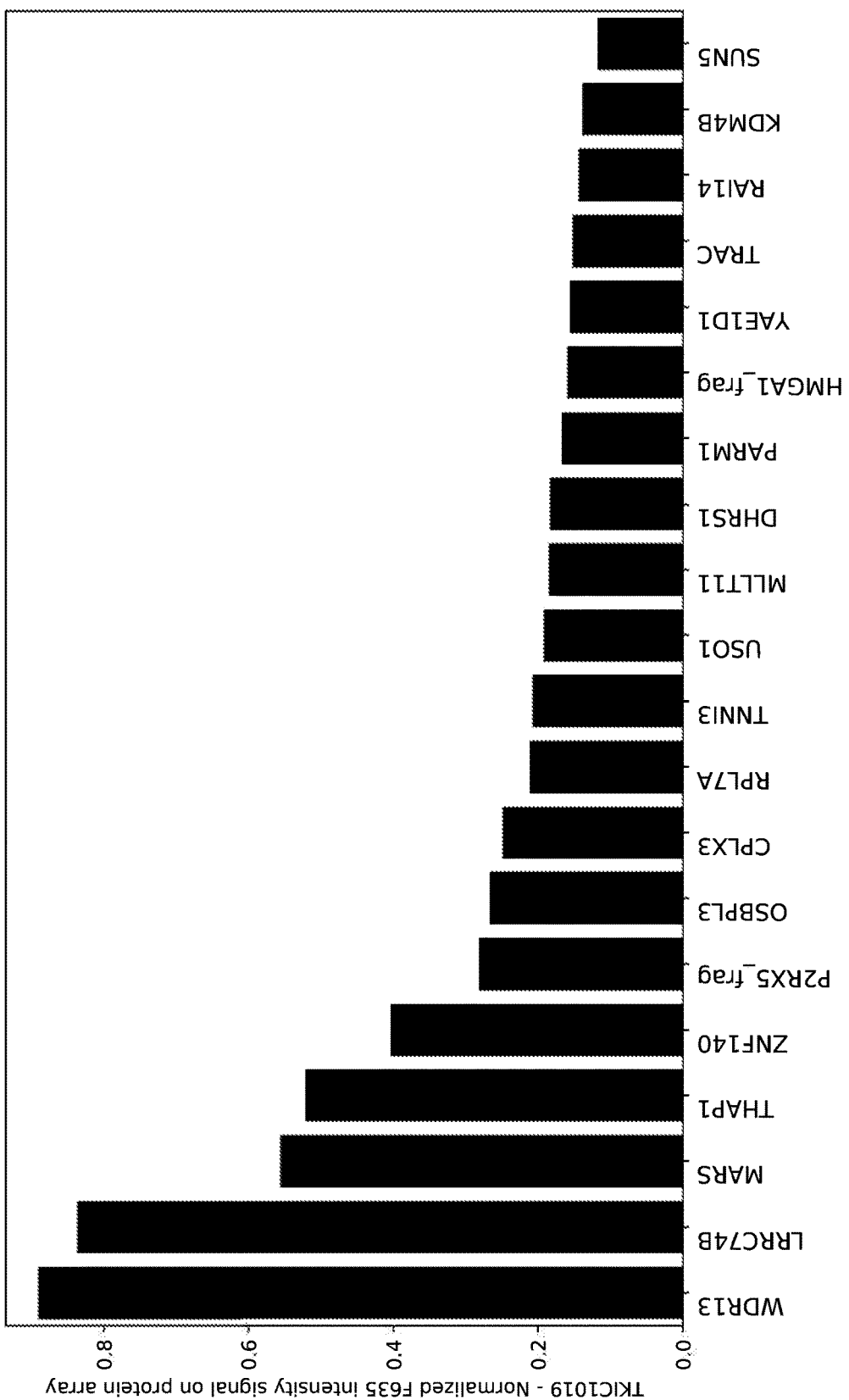
Figure 86B:
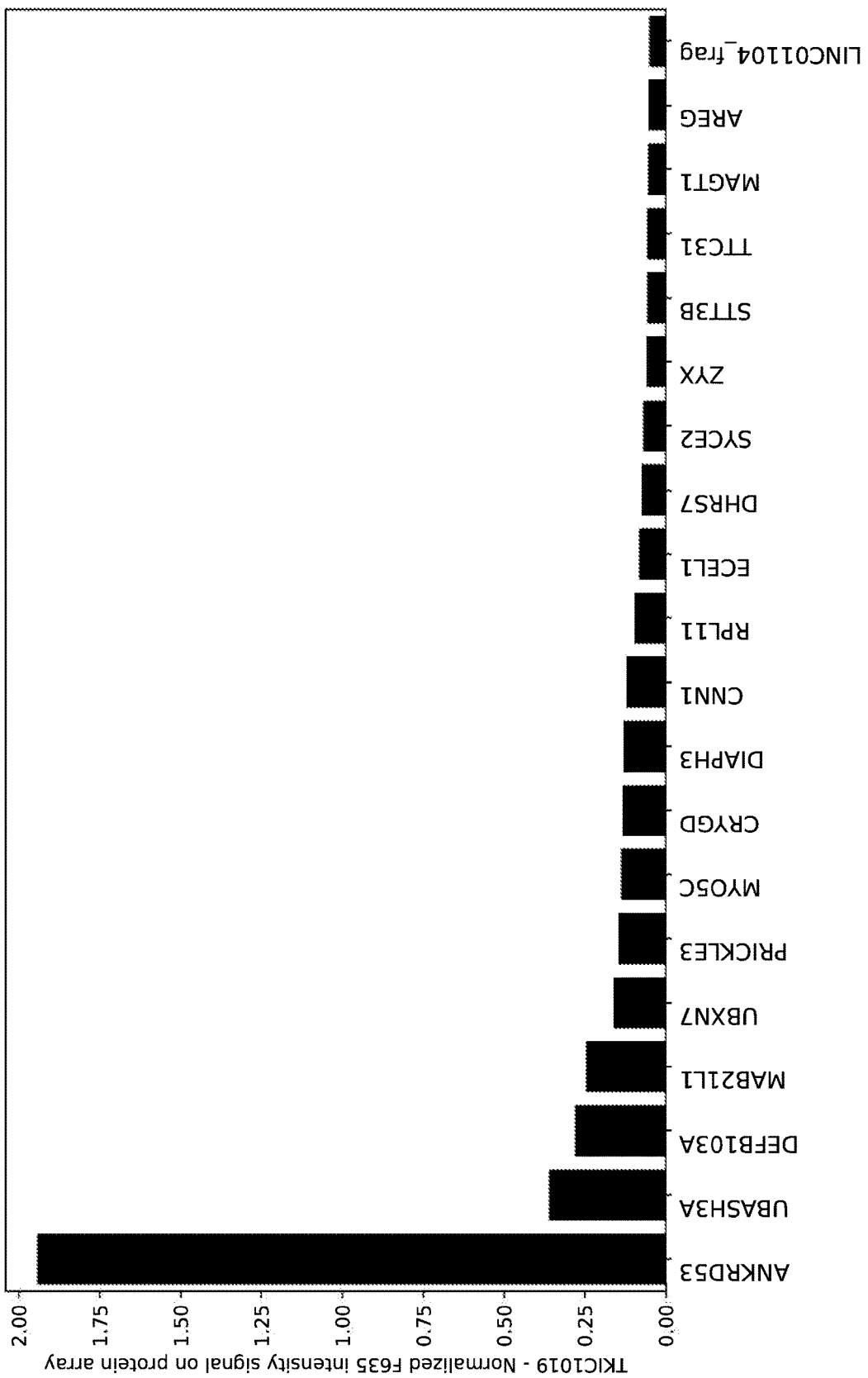

FIG. 86A is protein array data showing specific binding of ankyrin repeat domain 53, transcript variant 2 by TKIC10019 antibody. FIG. 86B is an experimental replicate showing specific binding of ankyrin repeat domain 53, transcript variant 2 by TKIC10019 antibody.

Figure 87:
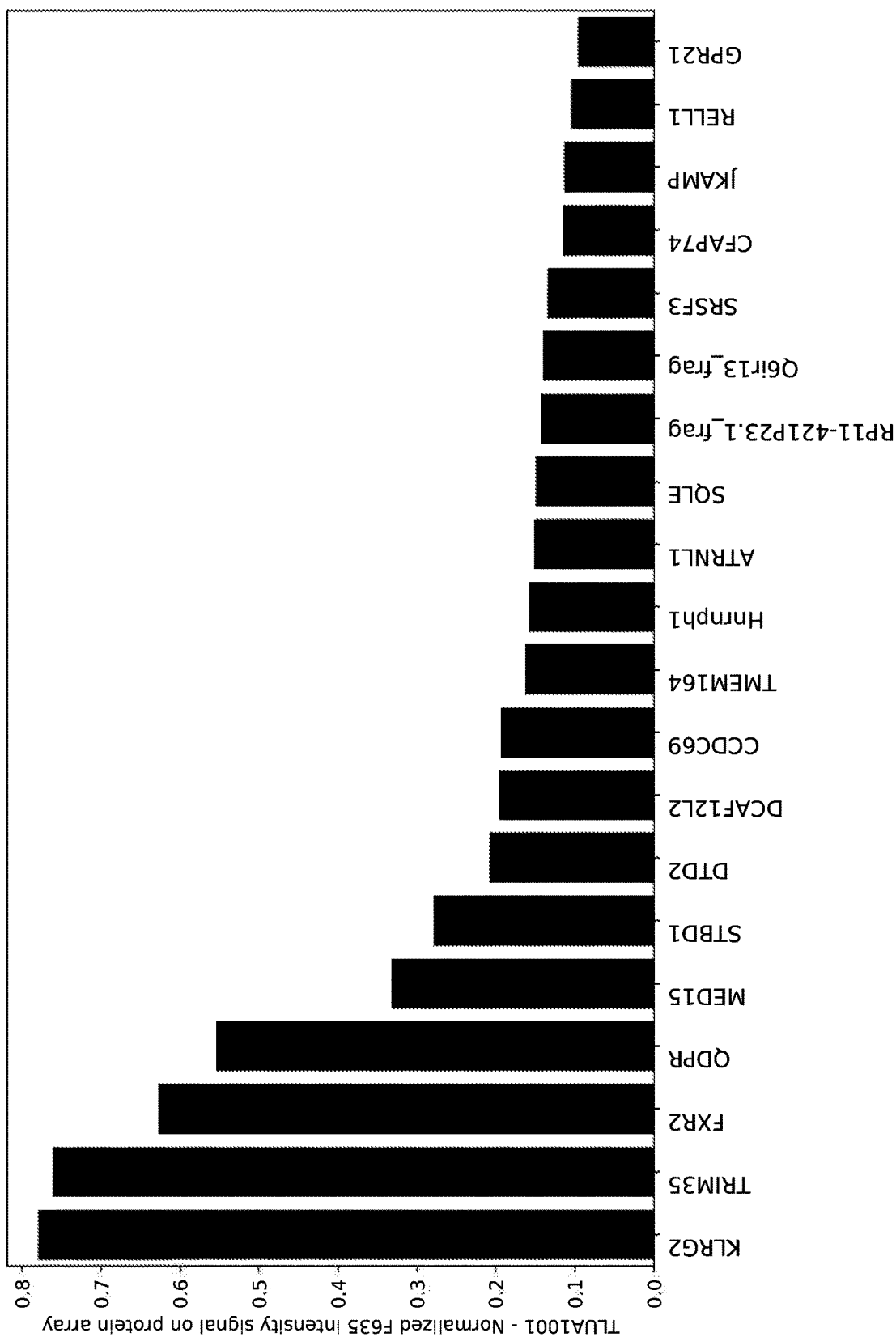

FIG. 87 is protein array data showing specific binding of Killer cell lectin like receptor g2, tripartite motif containing 35, transcript variant 1, and FMR1 autosomal homolog 2 by TLUA1001 antibody.

Figure 88A:
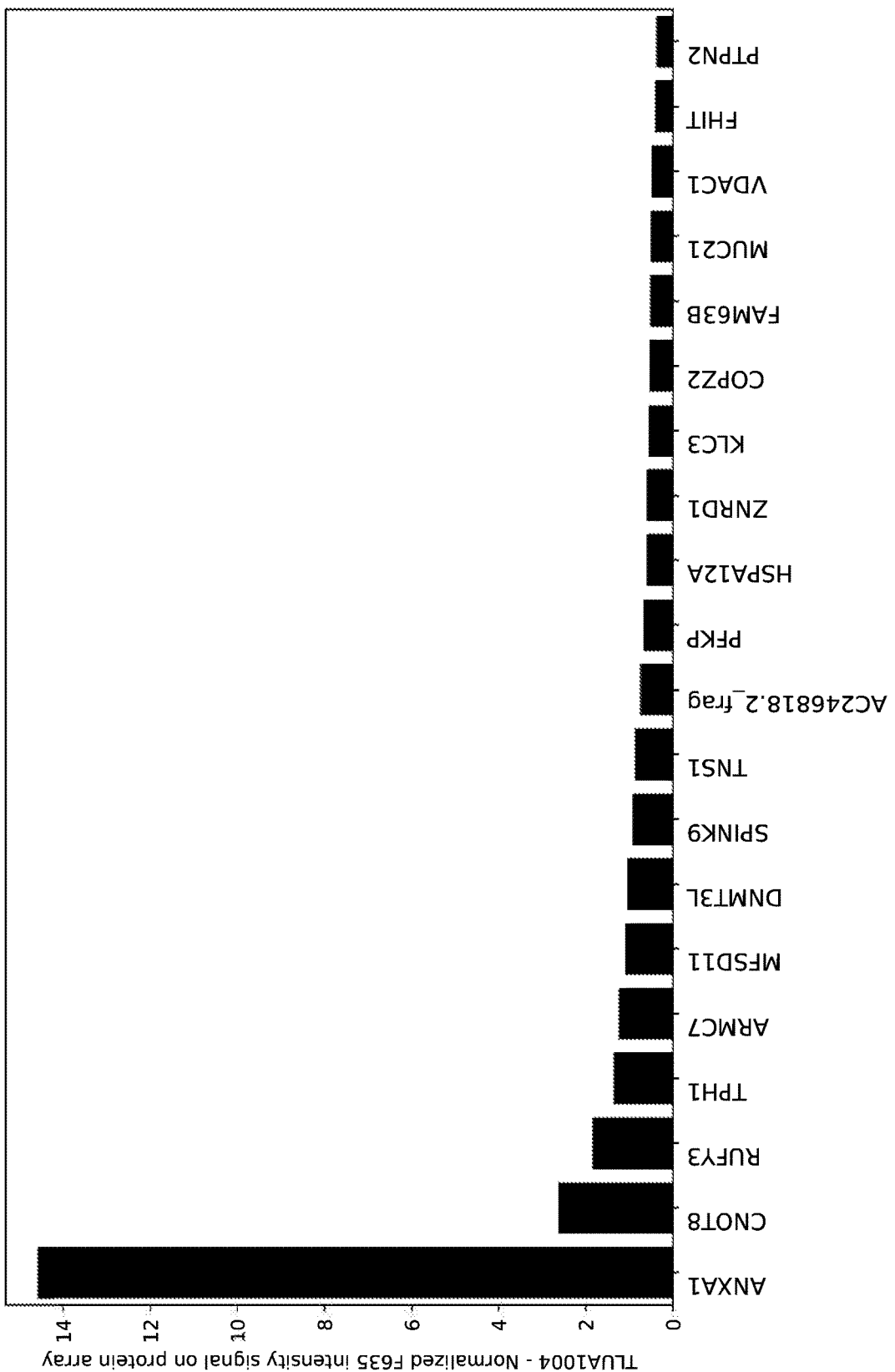
Figure 88B:
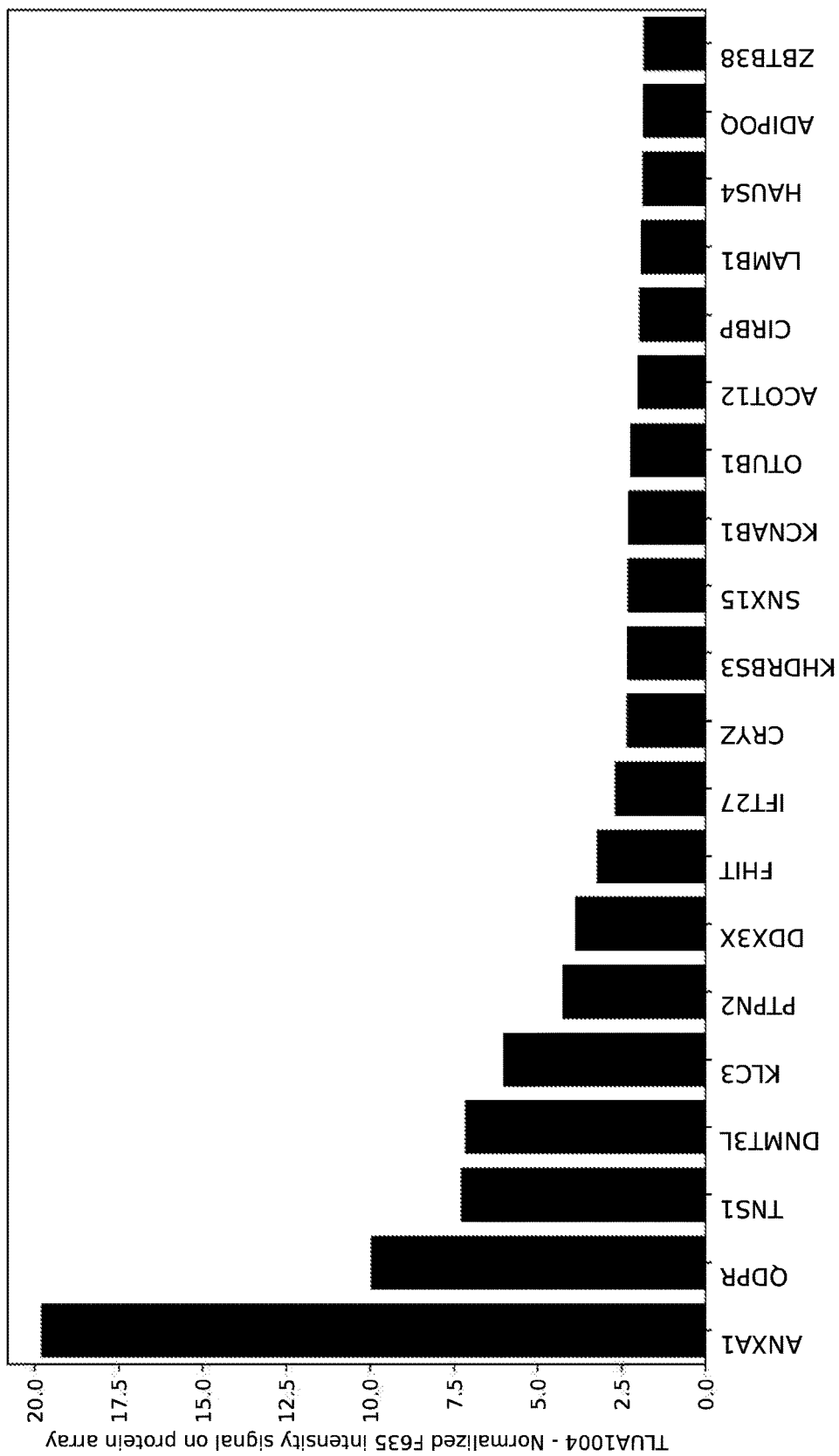

FIG. 88A is protein array data showing specific binding of annexin A1 by TLUA1004 antibody. FIG. 88B is an experimental replicate showing specific binding of annexin A1 by TLUA1004 antibody.

Figure 89:
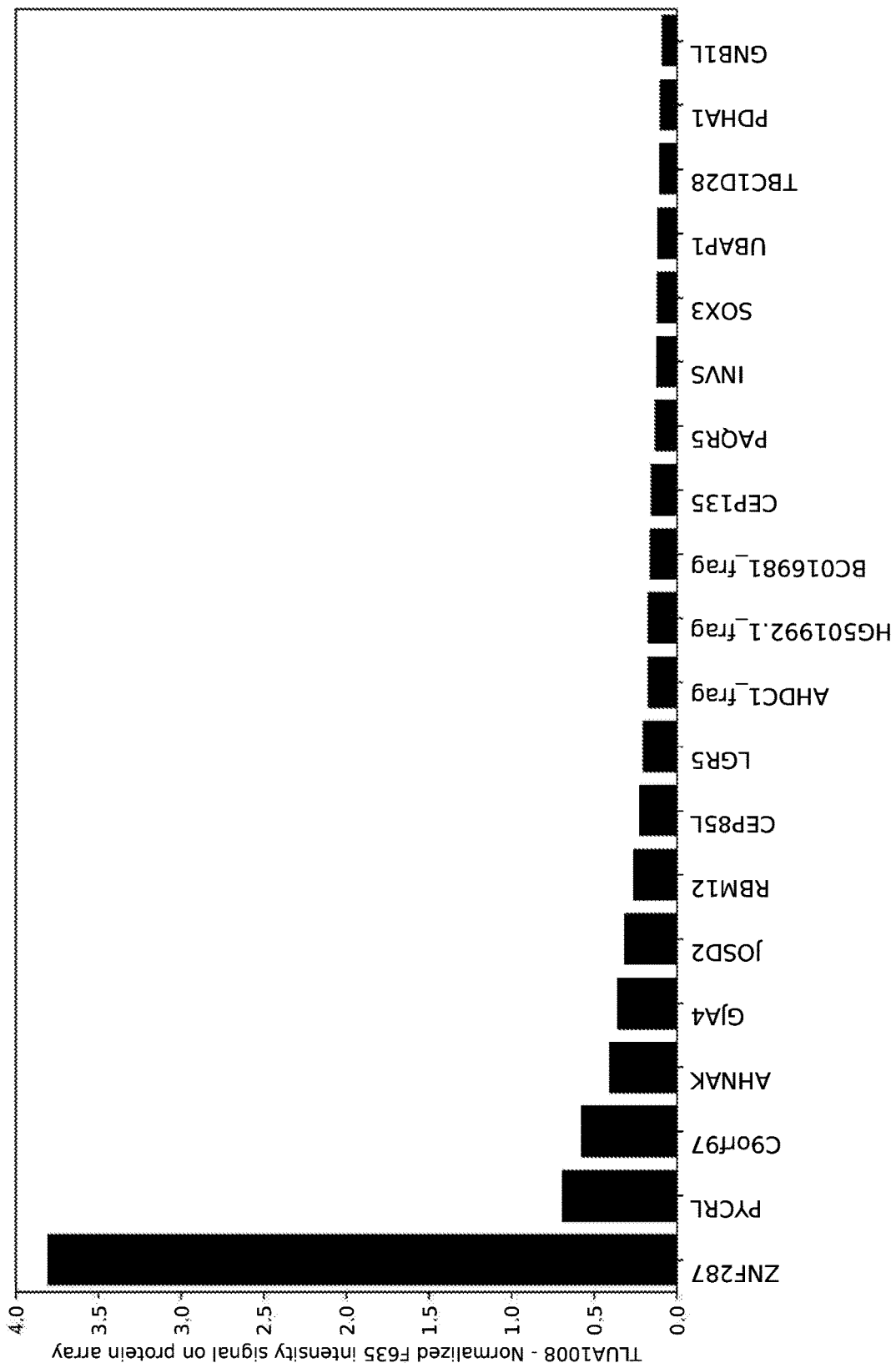

FIG. 89 is protein array data showing specific binding of zinc finger protein 287, transcript variant 2 by TLUA1008 antibody.

Figure 90:
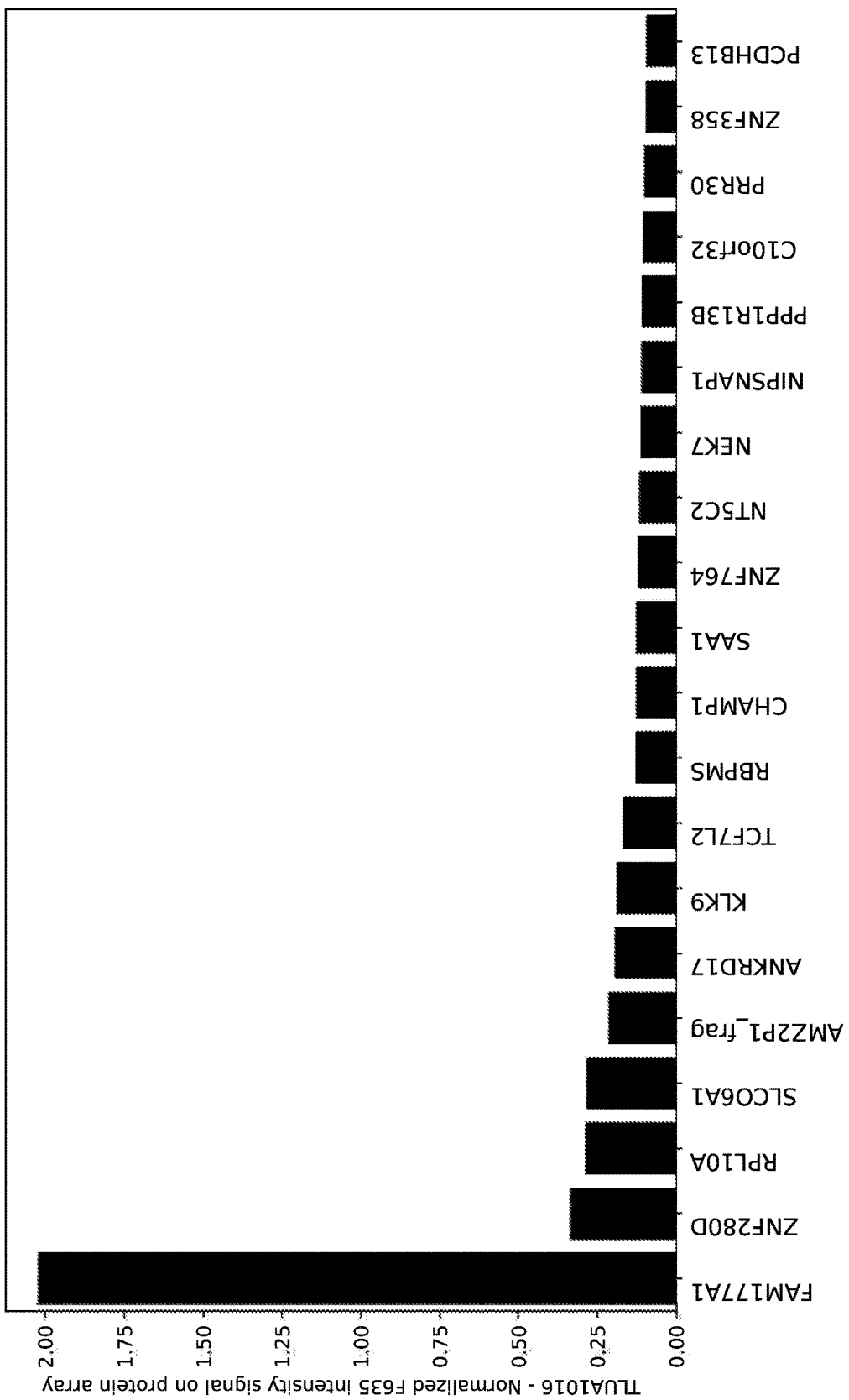

FIG. 90 is protein array data showing specific binding of family with sequence similarity 177 member A1, transcript variant 2 by TLUA1016 antibody.

Figure 91:
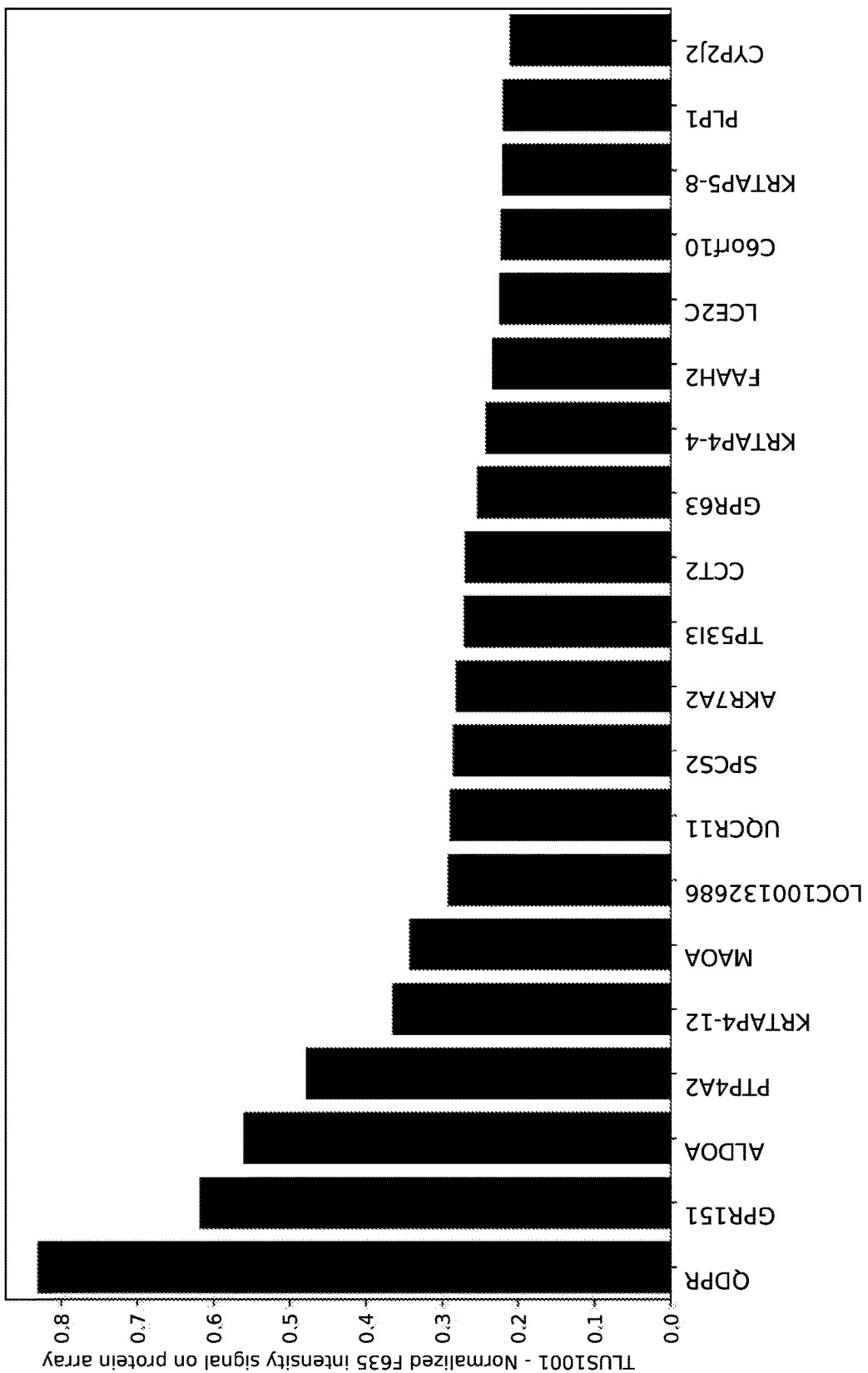

FIG. 91 is protein array data showing specific binding of quinoid dihydropteridine reductase, transcript variant 1 by TLUS1001 antibody.

Figure 92:
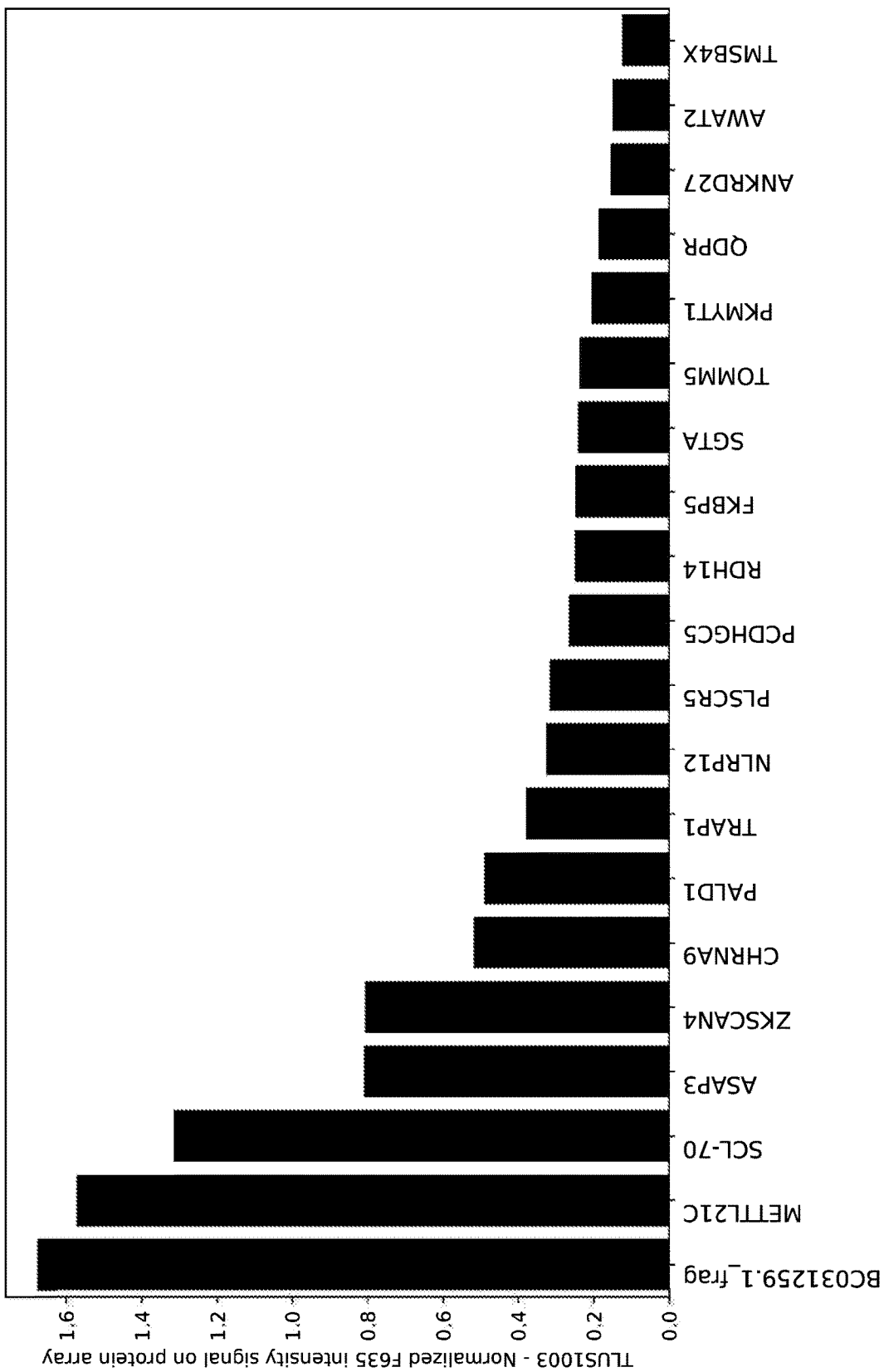

FIG. 92 is protein array data showing specific binding of ELK2, member of ETS oncogene family, pseudogene 1, and methyltransferase like 21C by TLUS1003 antibody.

Figure 93:
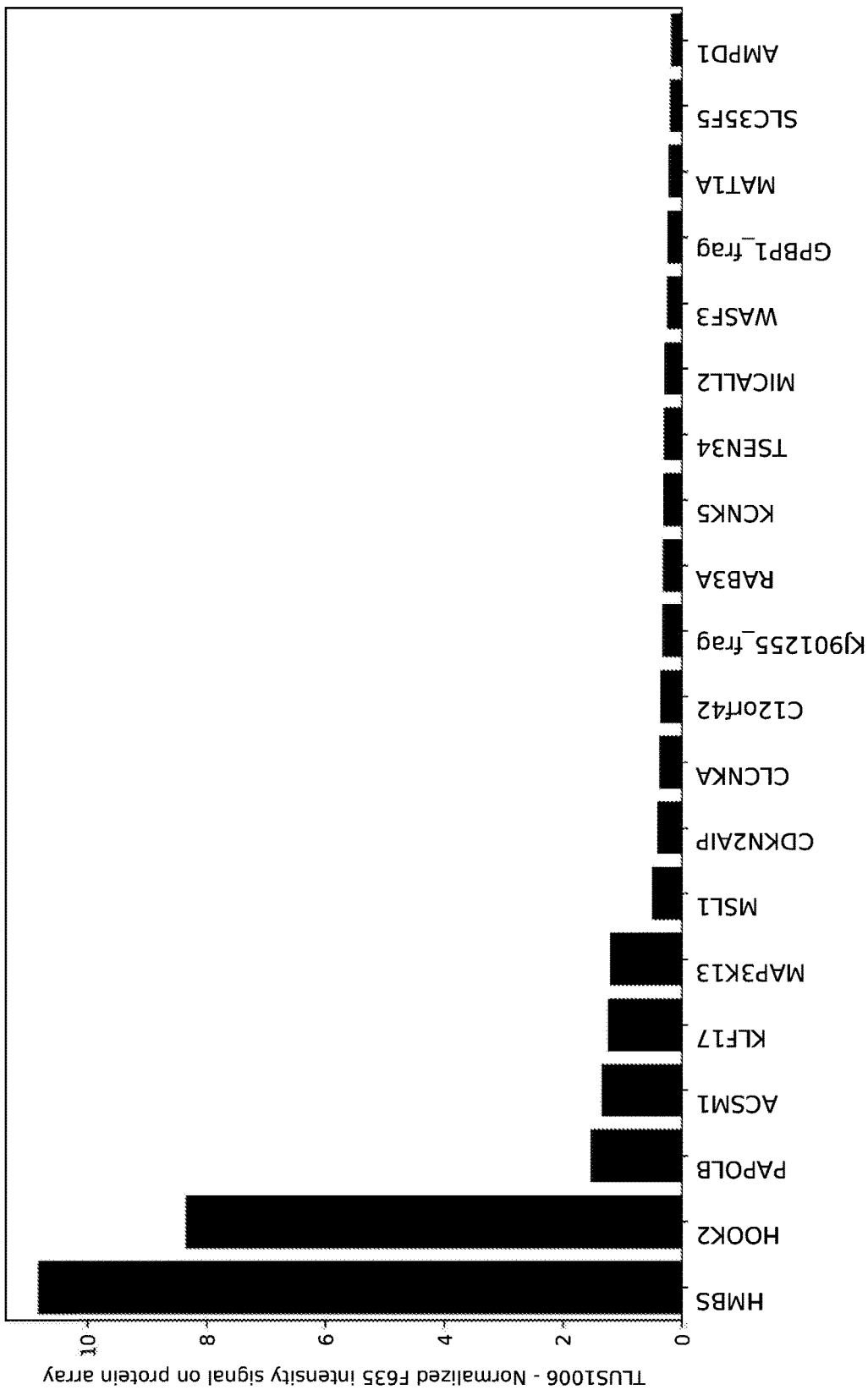

FIG. 93 is protein array data showing specific binding of hydroxymethylbilane synthase, transcript variant X3, and hook microtubule tethering protein 2, transcript variant 2 by TLUS1006 antibody.

Figure 94:
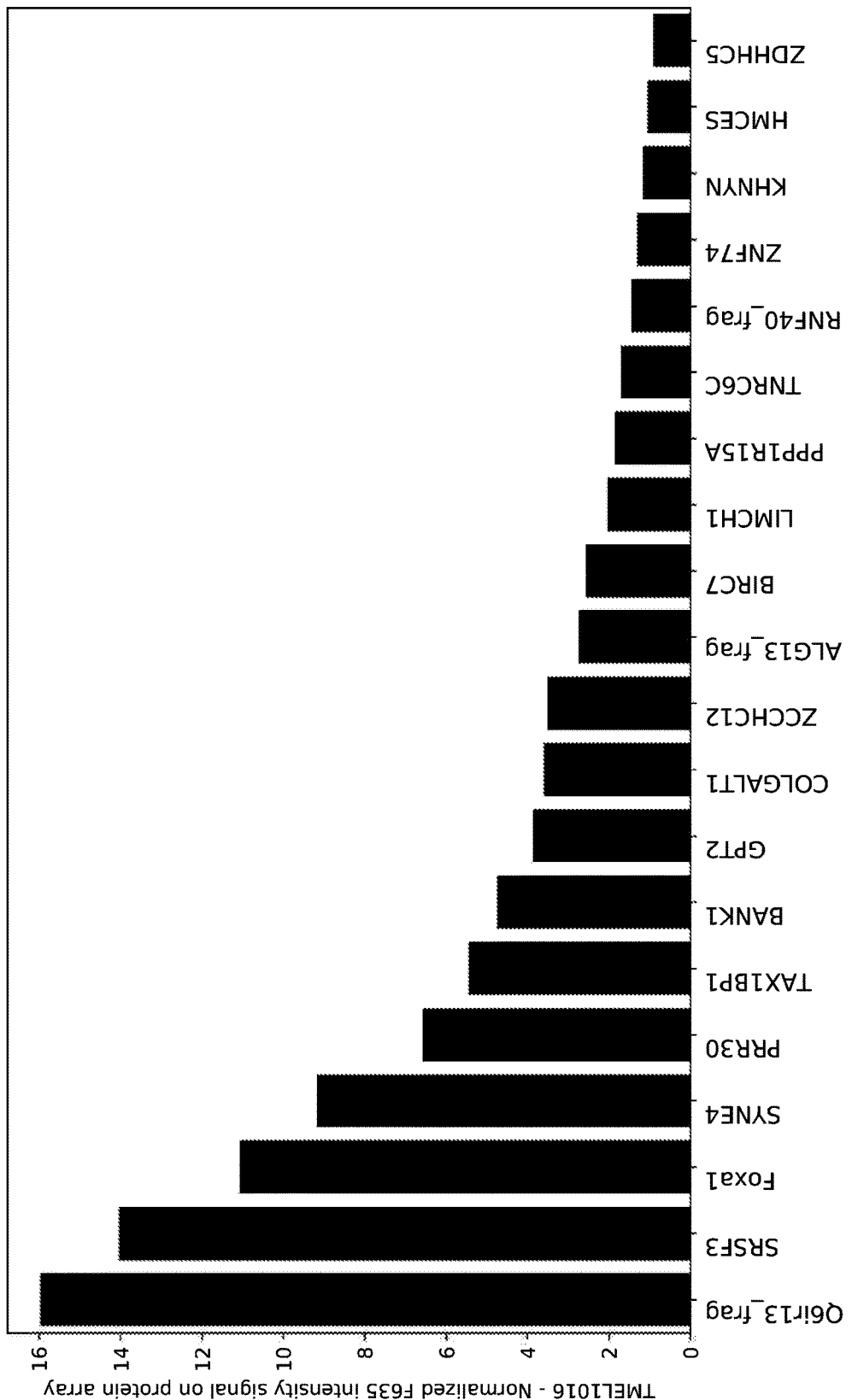

FIG. 94 is protein array data showing specific binding of Magel2, and serine and arginine rich splicing factor 3, transcript variant 1 by TMEL1016 antibody.

Figure 95:
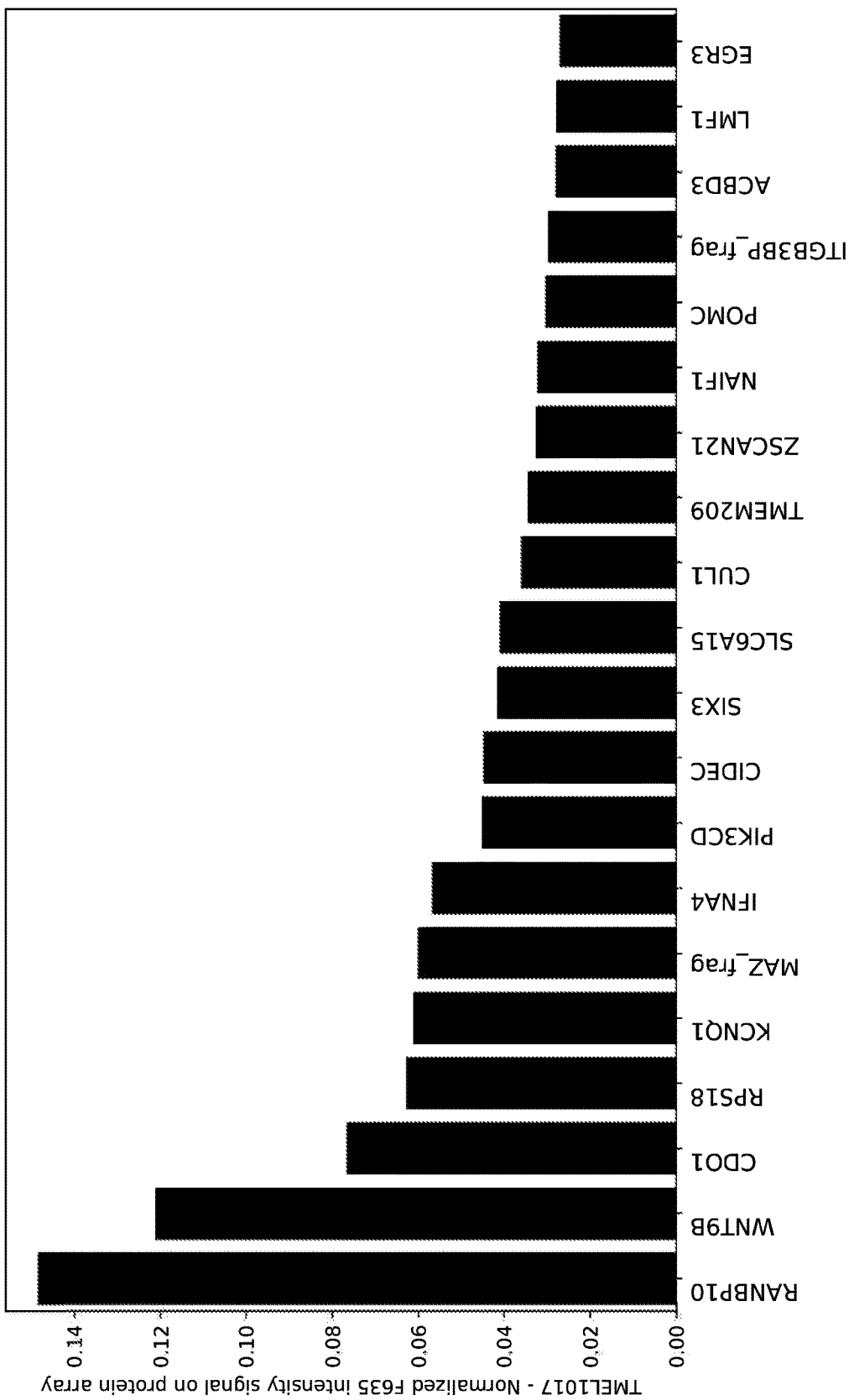

FIG. 95 is protein array data showing specific binding of RAN binding protein 10, transcript variant 1, and Wnt family member 9 by TMEL1017 antibody.

Figure 96:
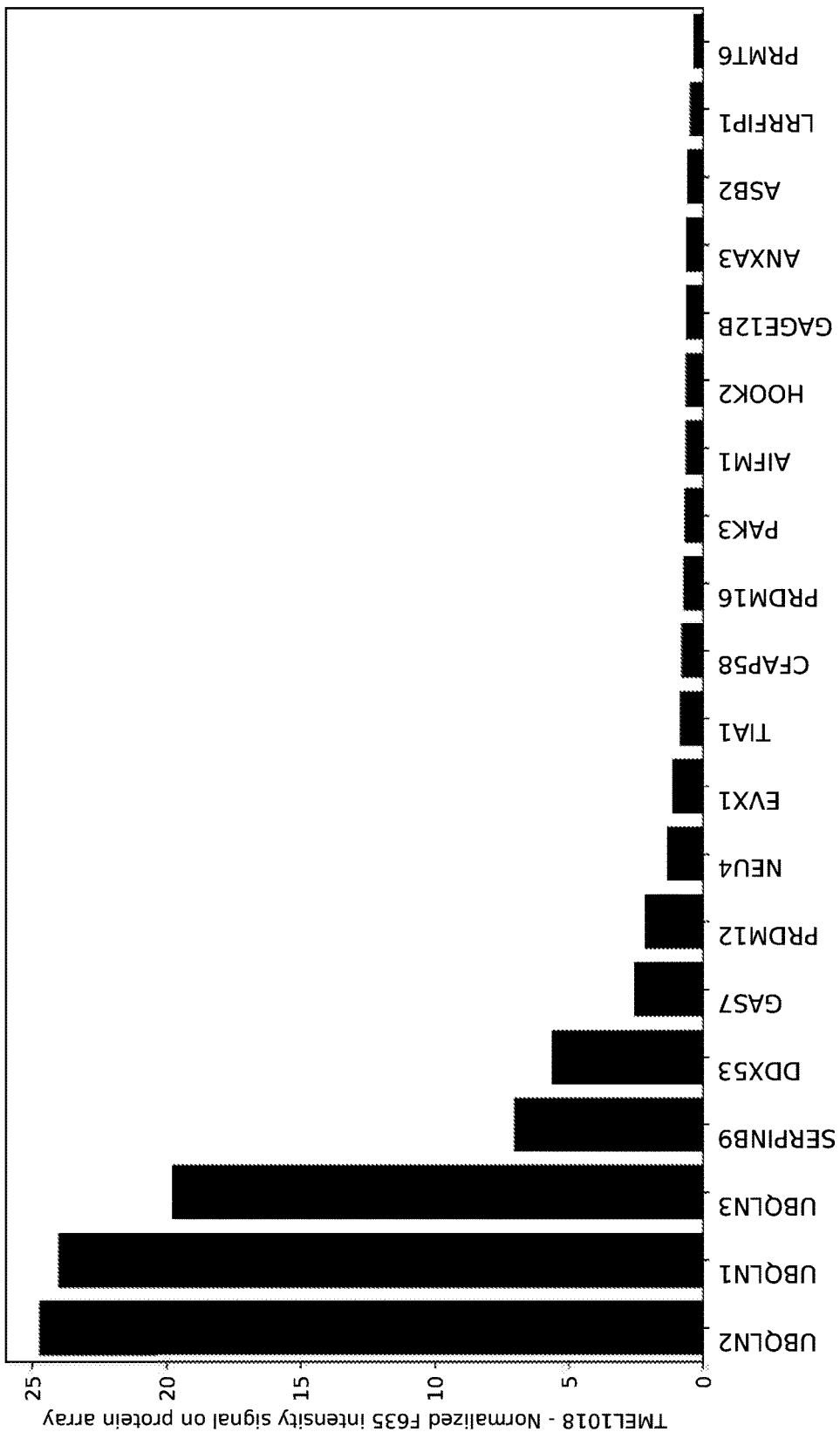

FIG. 96 is protein array data showing specific binding of ubiquilin 2, ubiquilin 1, transcript variant 2, and Ubiquilin 3 by TMEL1018 antibody.

Figure 97:
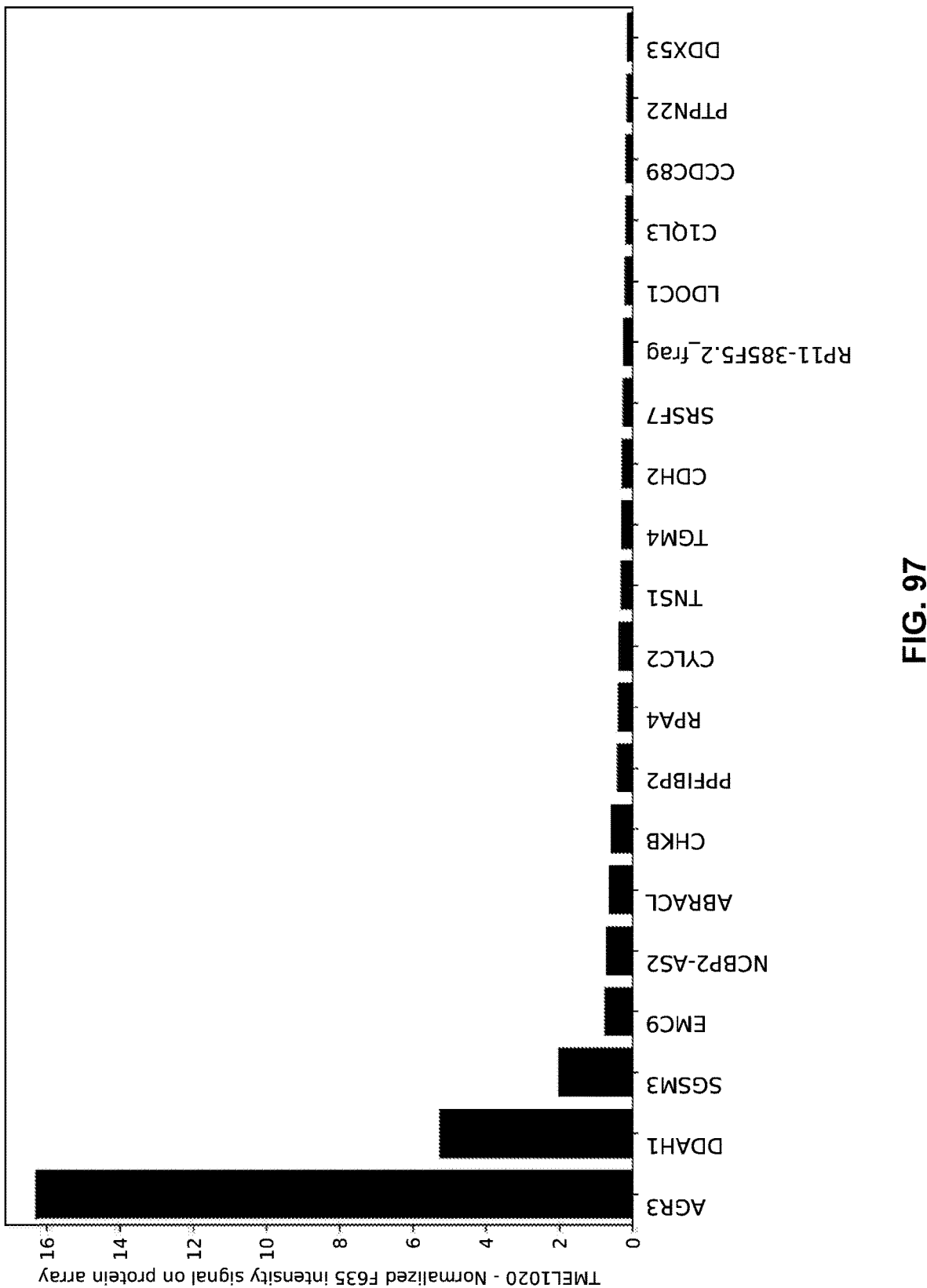

FIG. 97 is protein array data showing specific binding of anterior gradient 3, protein disulphide isomerase family member by TMEL1020 antibody.

Figure 98:
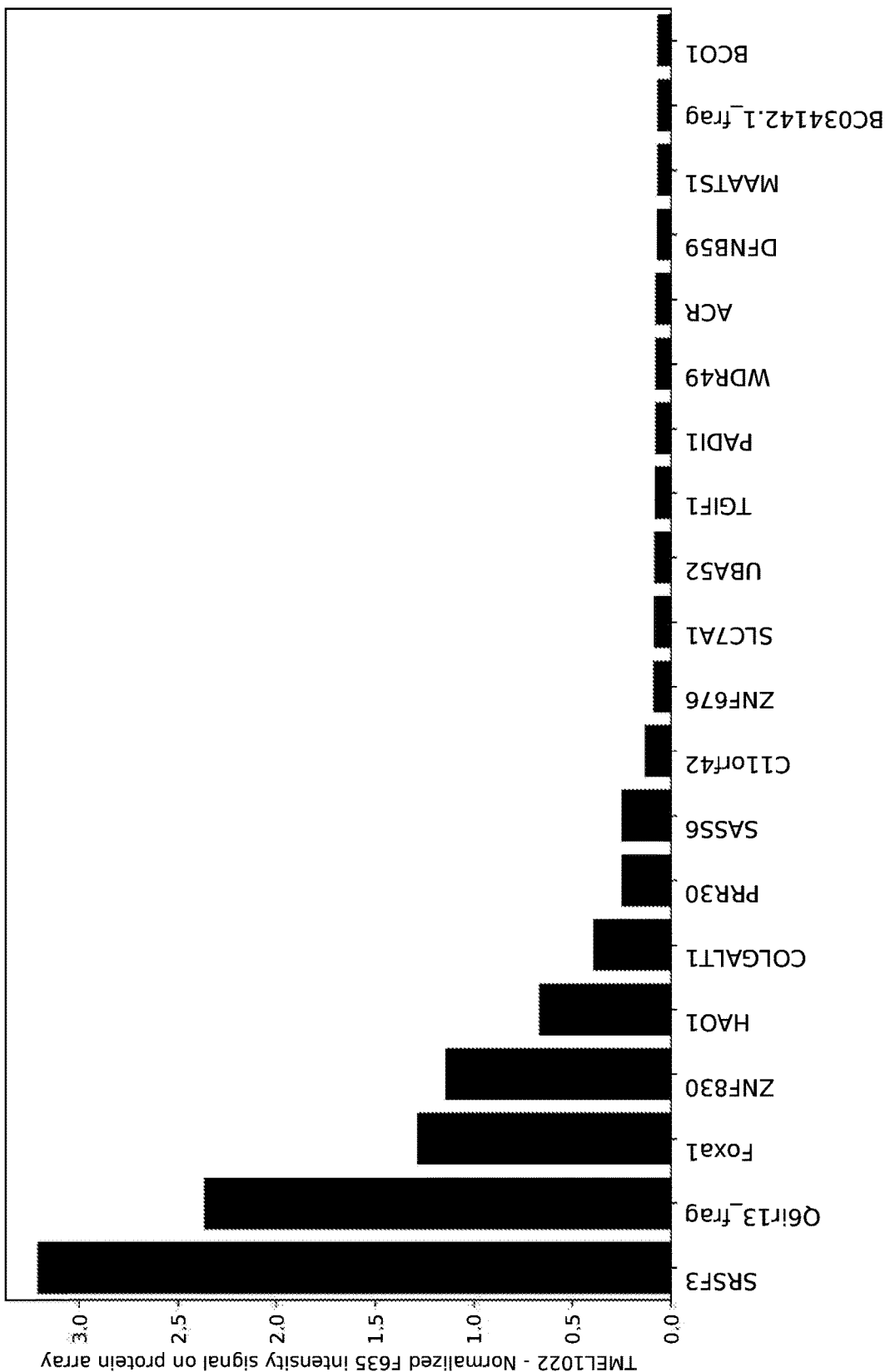

FIG. 98 is protein array data showing specific binding of serine and arginine rich splicing factor 3, transcript variant 1 by TMEL1022 antibody.

Figure 99A:
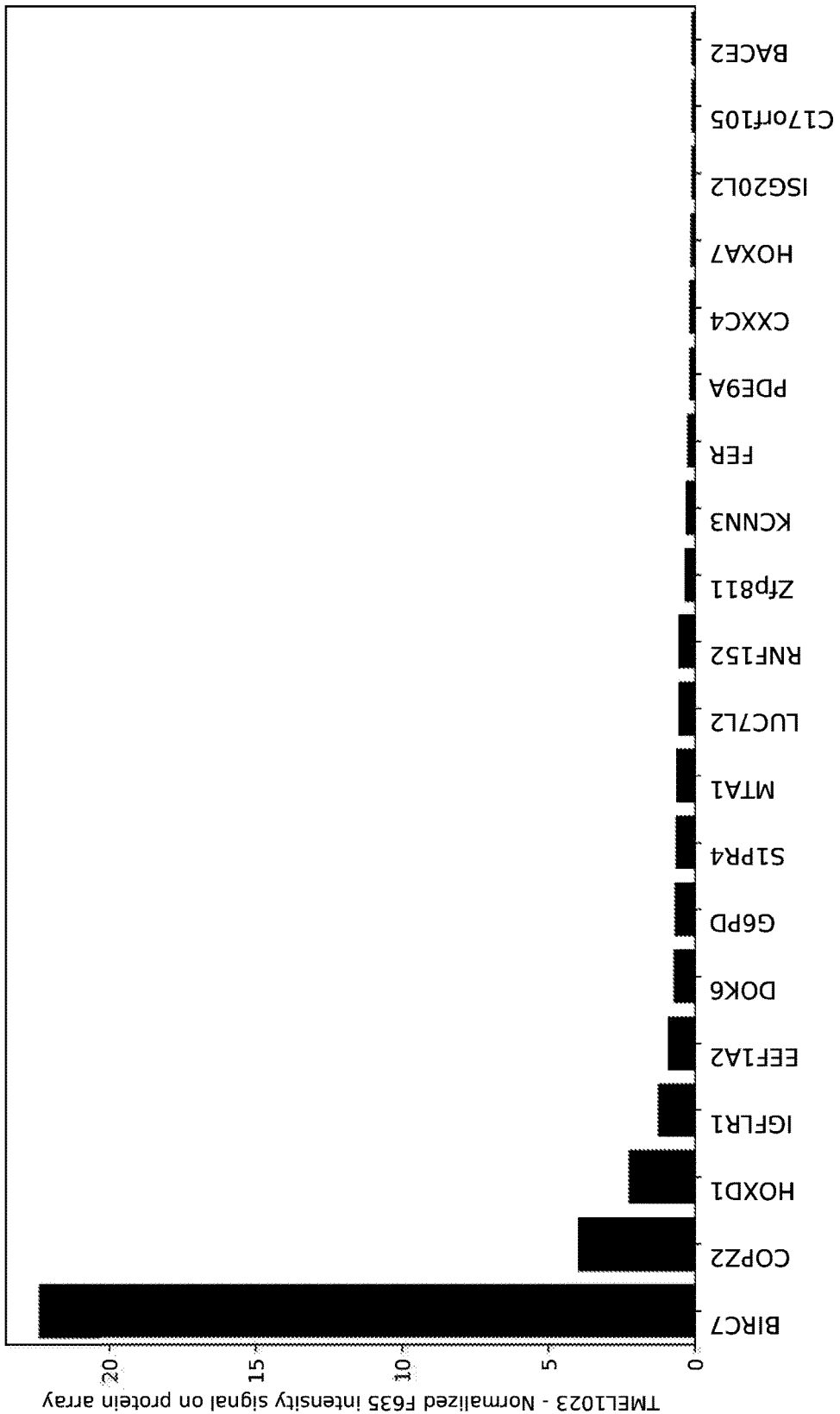
Figure 99B:
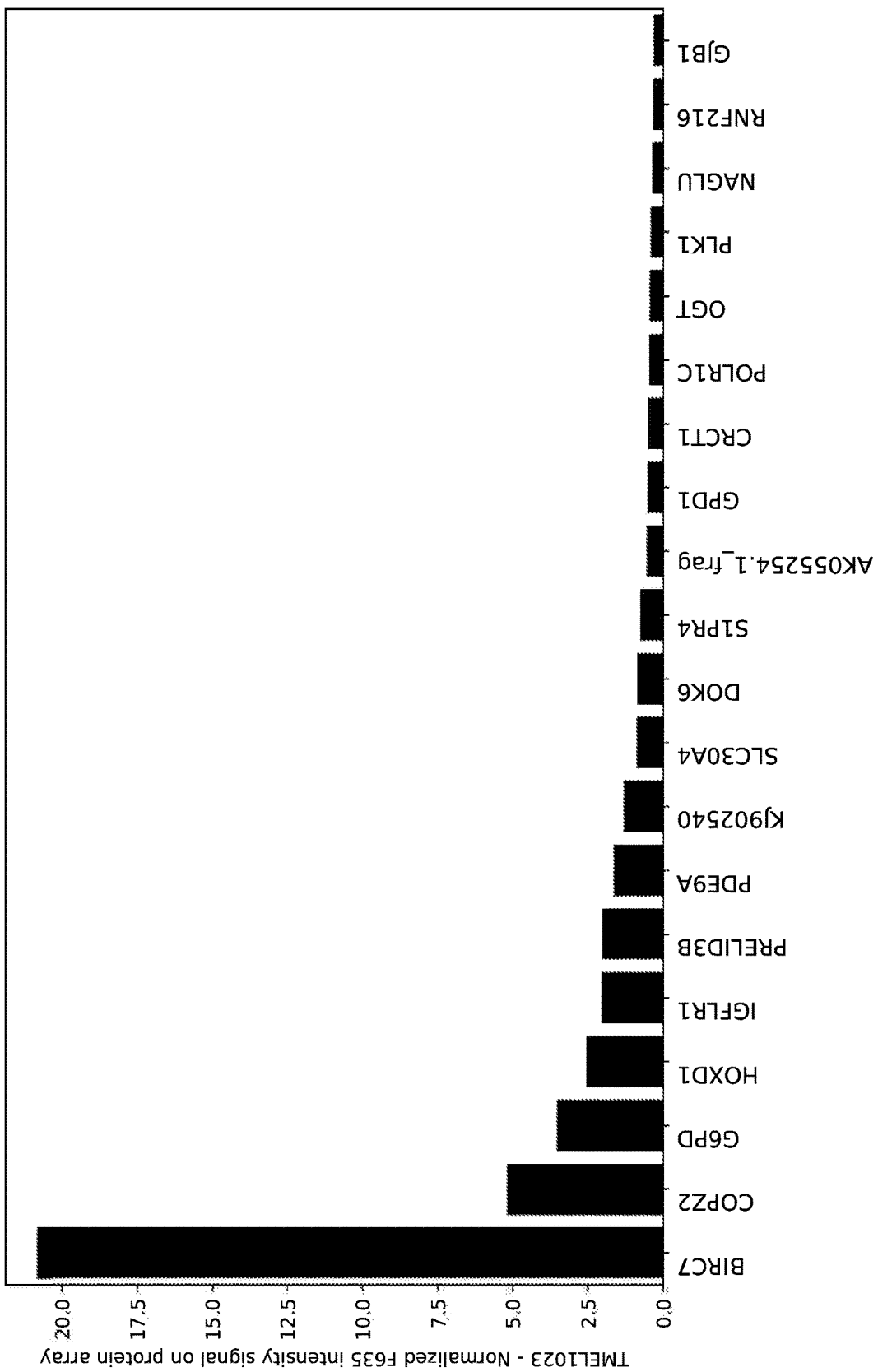

FIG. 99A is protein array data showing specific binding of baculoviral IAP repeat containing 7, transcript variant 1 by TMEL1023 antibody. FIG. 99B is an experimental replicate showing specific binding of baculoviral IAP repeat containing 7, transcript variant 1 by TMEL1023 antibody.

Figure 100:
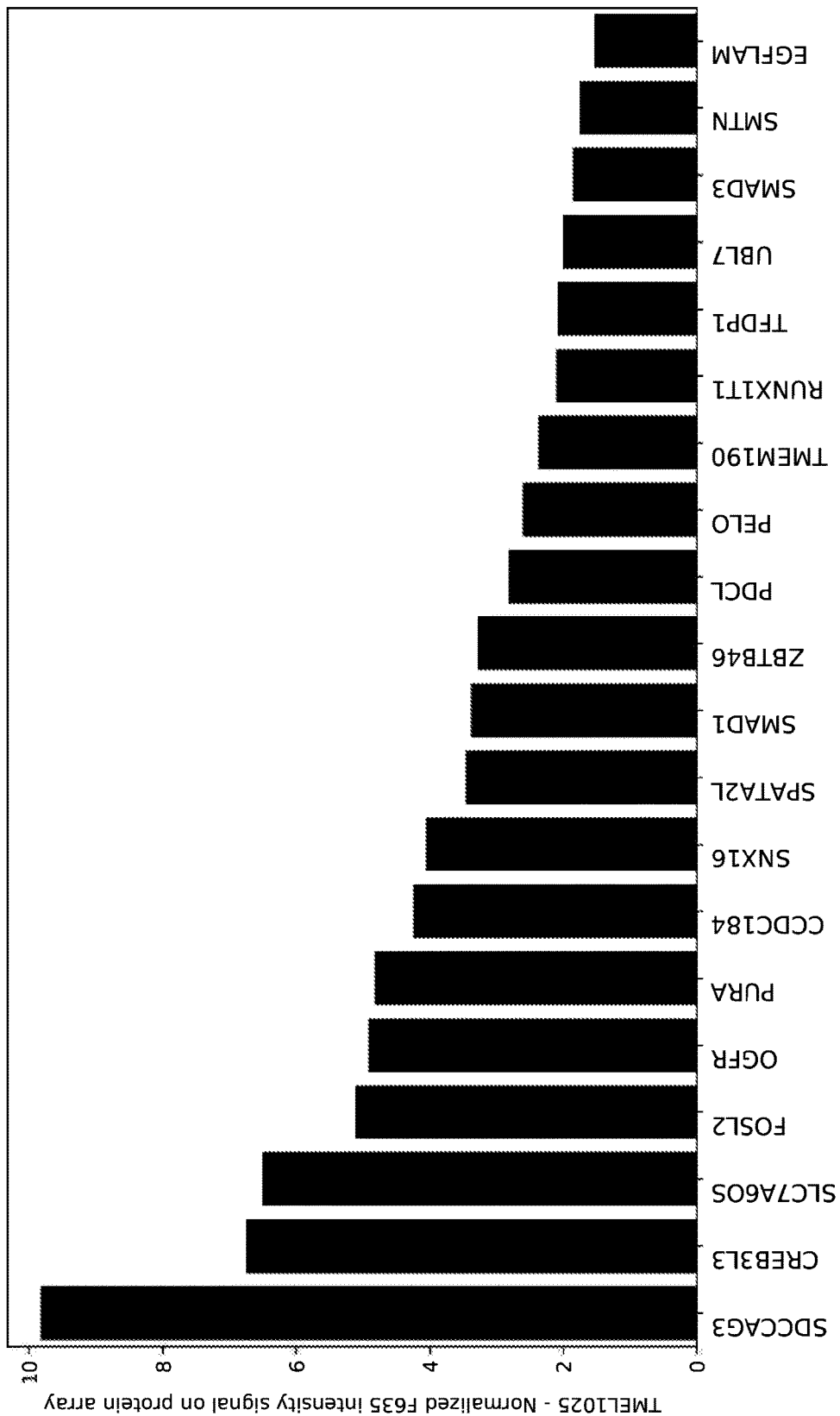

FIG. 100 is protein array data showing specific binding of endosome associated trafficking regulator 1, transcript variant 2 by TMEL1025 antibody.

Figure 101:
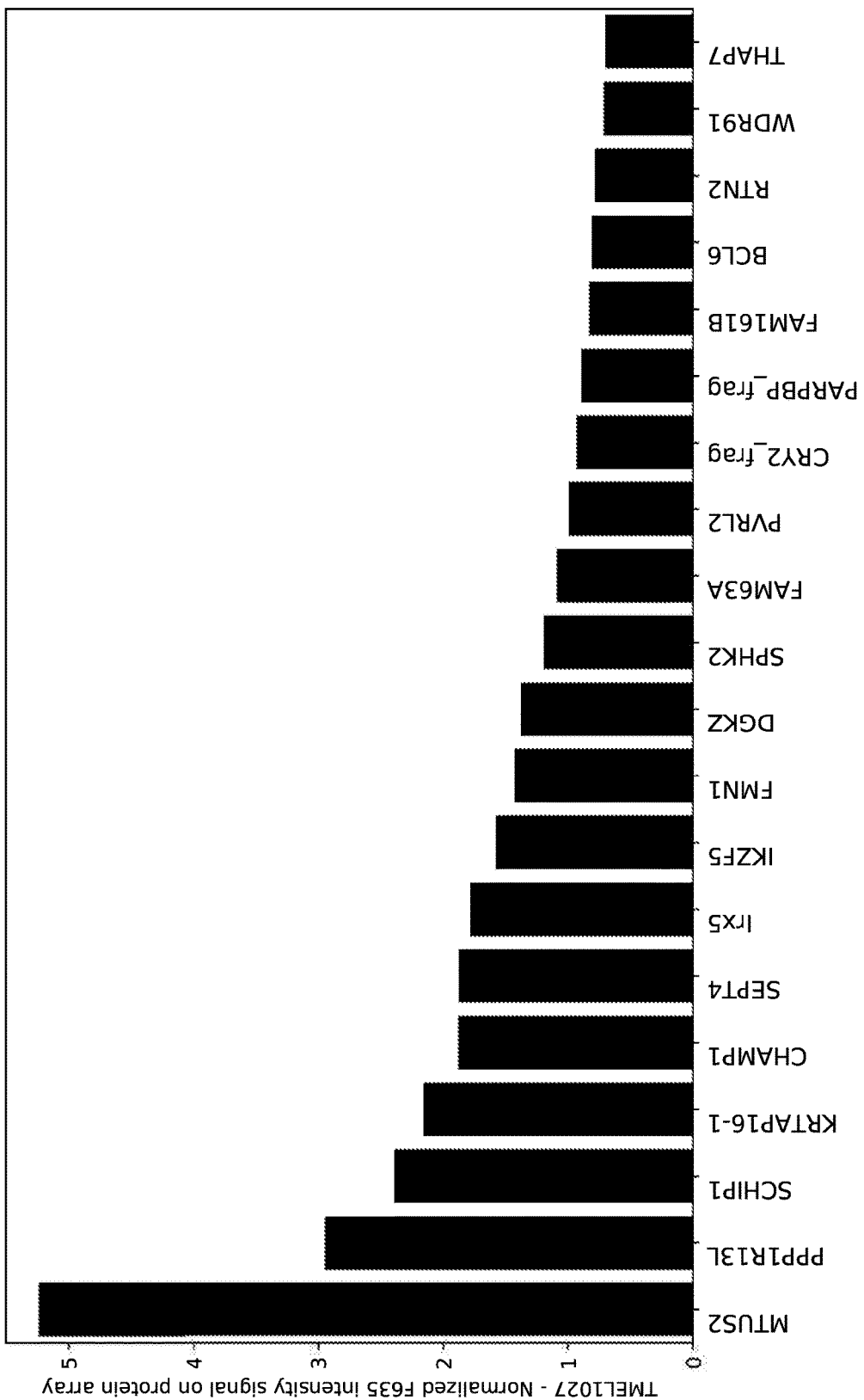

FIG. 101 is protein array data showing specific binding of microtubule associated scaffold protein 2, transcript variant 2 by TMEL1027 antibody.

Figure 102:
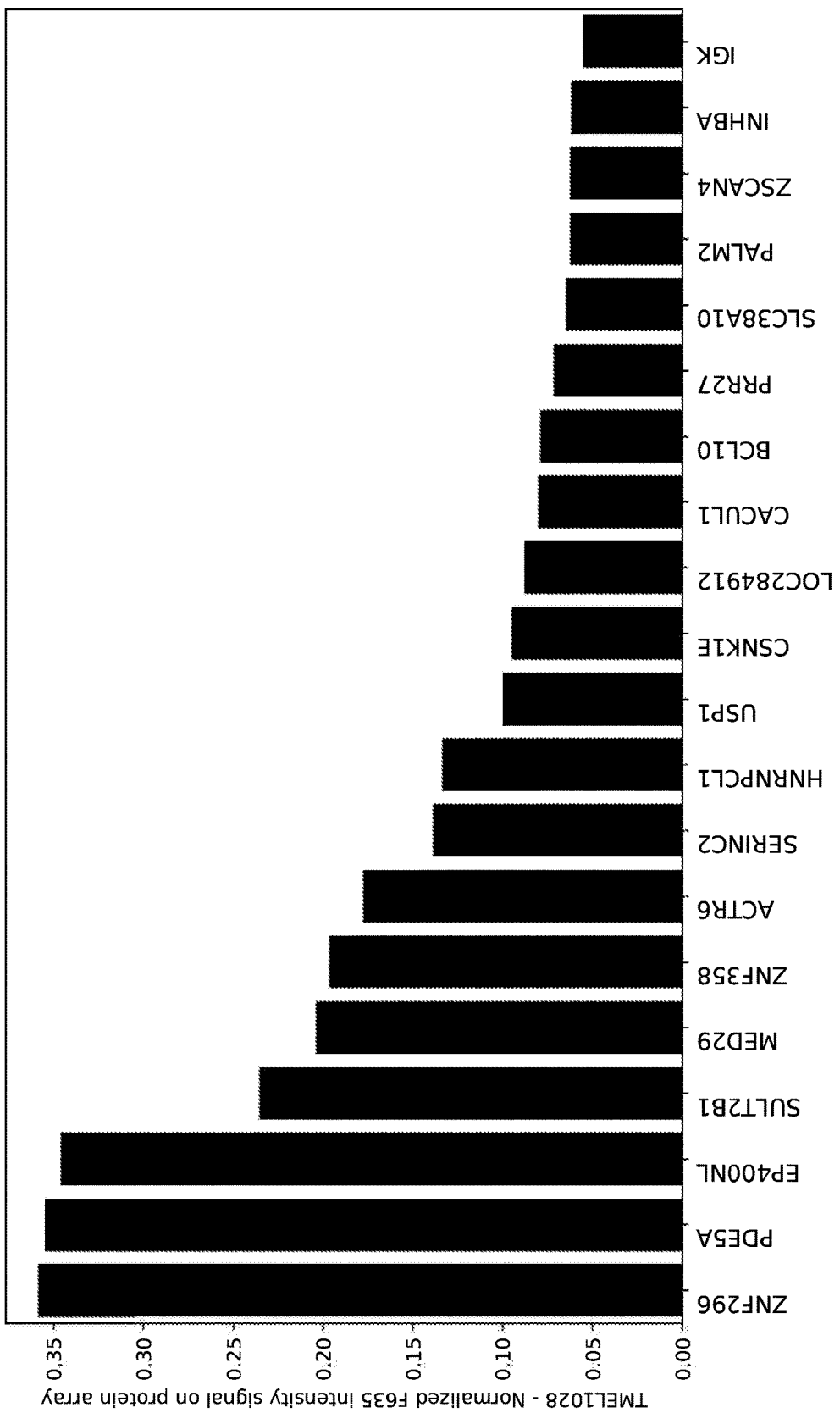

FIG. 102 is protein array data showing specific binding of zinc finger protein 296 phosphodiesterase 5A, transcript variant 1, and Ep400 pseudogene 1 by TMEL1028 antibody.

Figure 103:
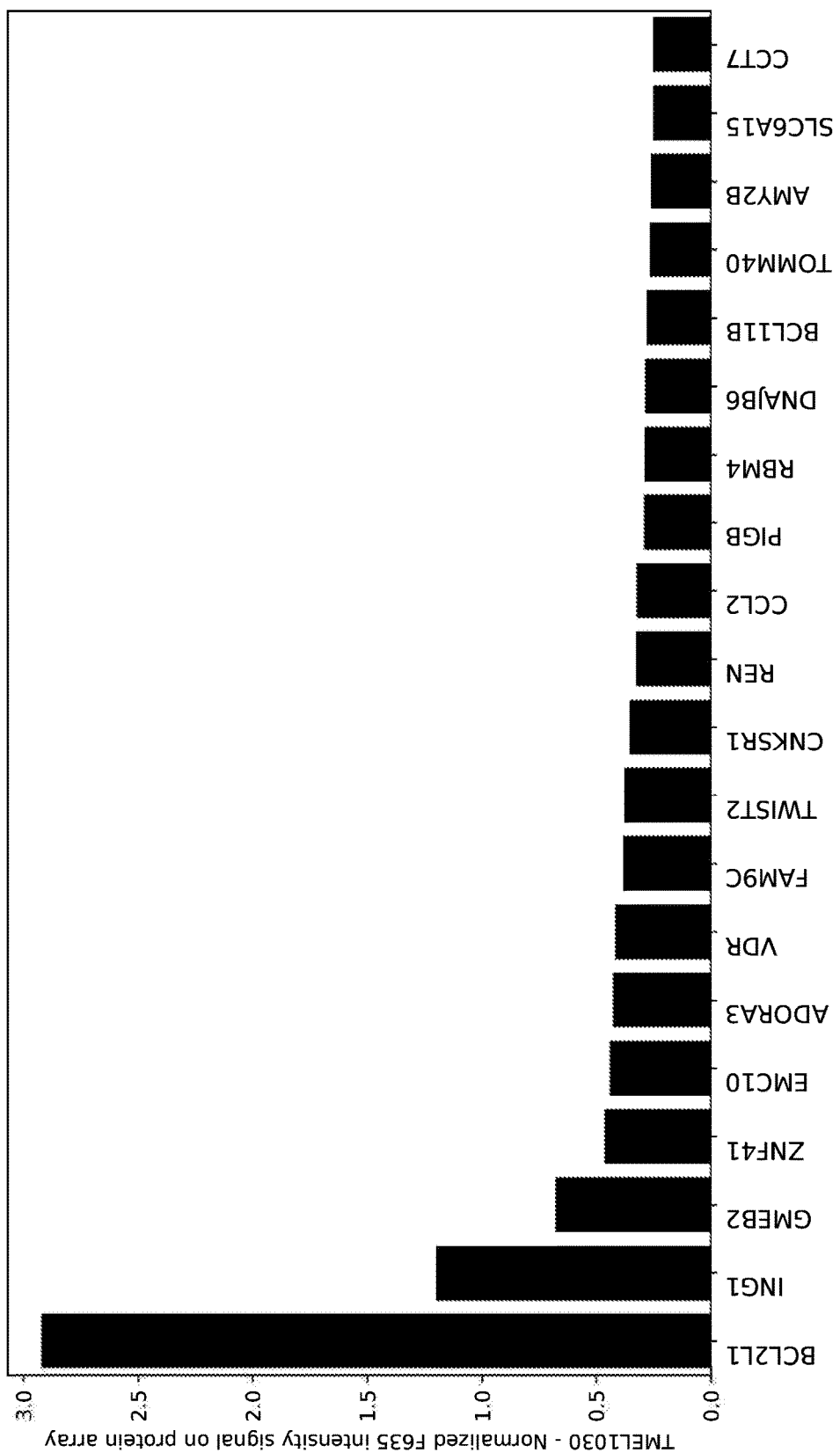

FIG. 103 is protein array data showing specific binding of Bcl2 like 1 by TMEL1030 antibody.

Figure 104:
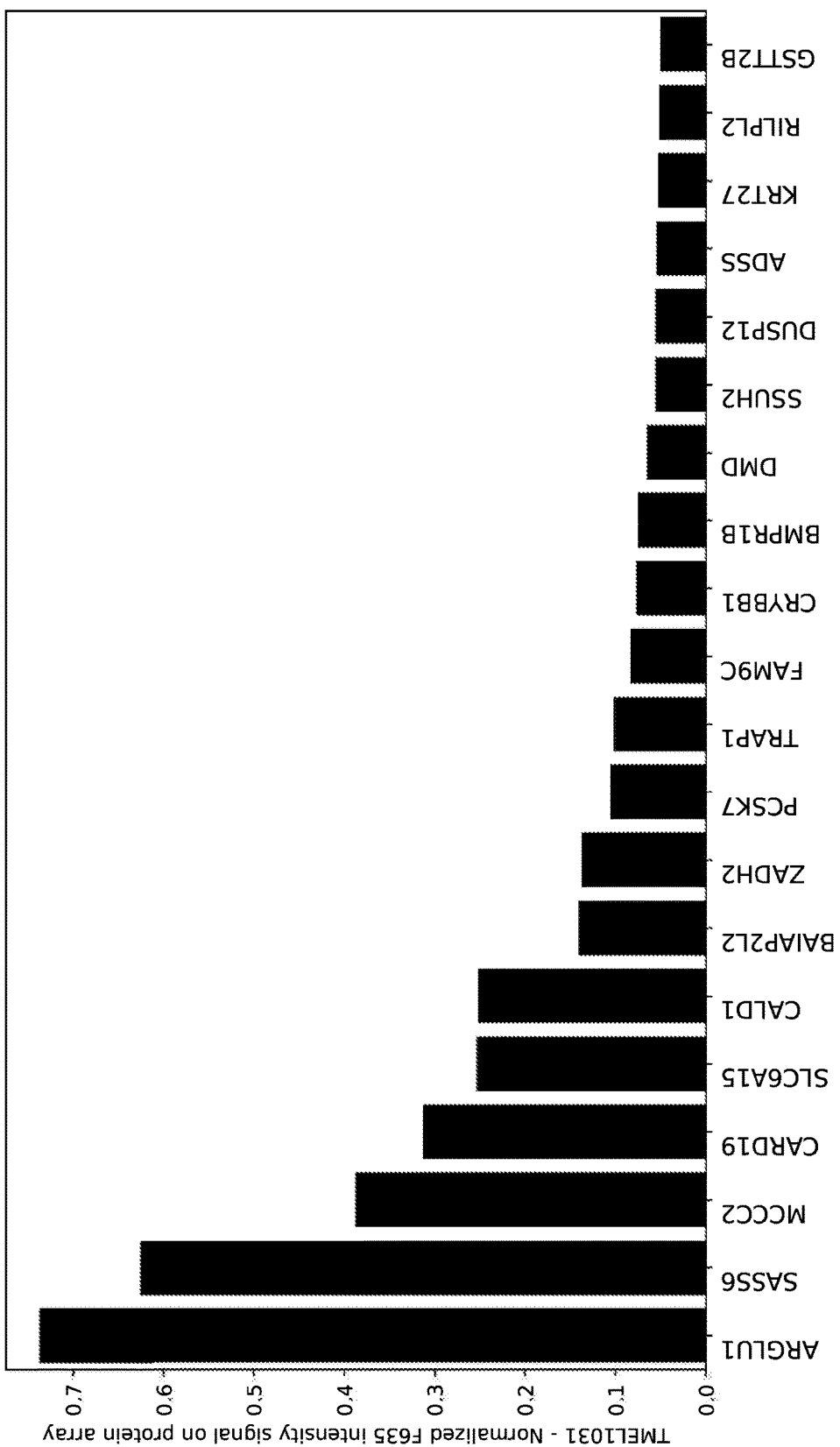

FIG. 104 is protein array data showing specific binding of arginine and glutamate rich 1, and SAS-6 centriolar assembly protein, transcript variant 2 by TMEL1031 antibody.

Figure 105:
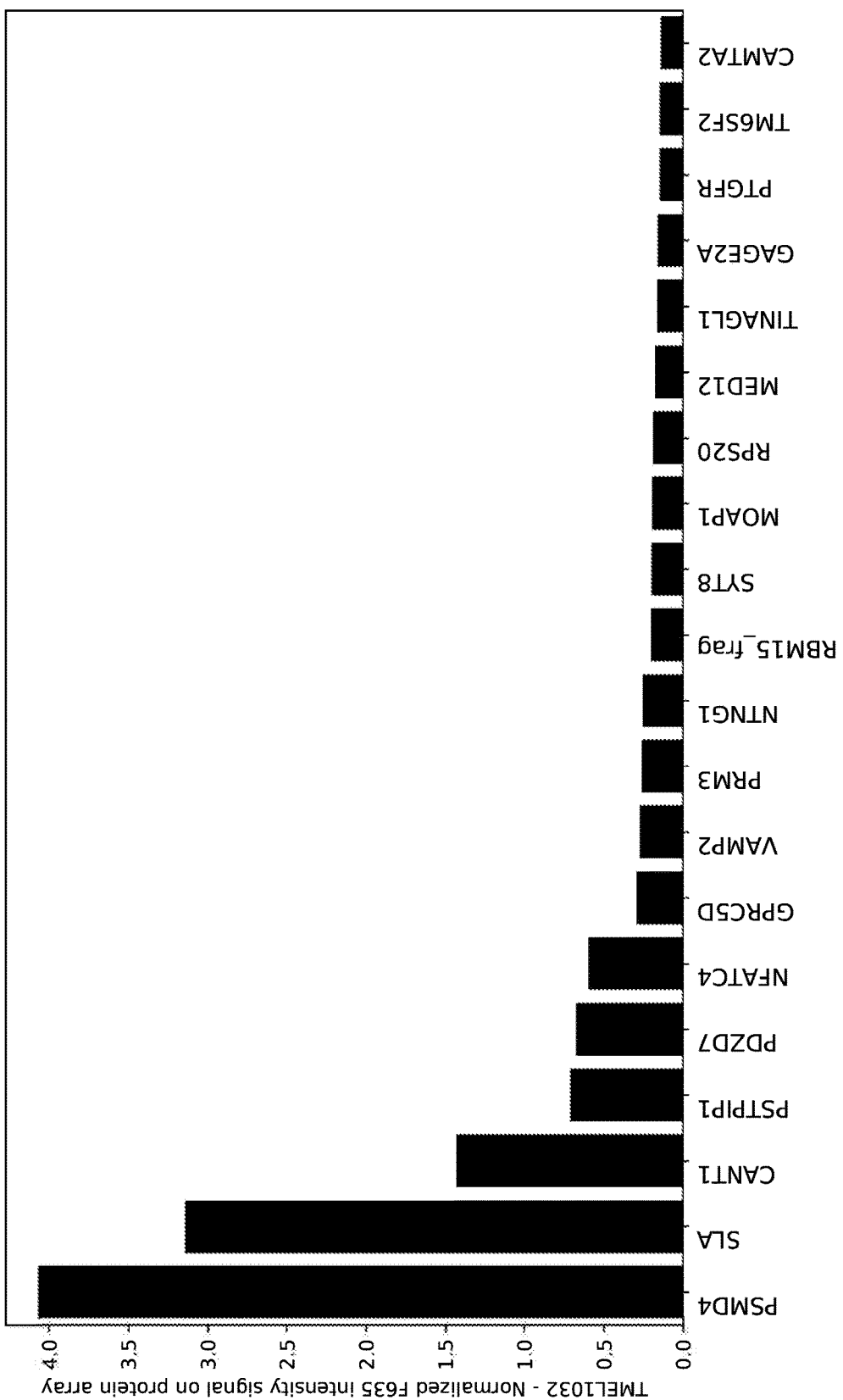

FIG. 105 is protein array data showing specific binding of proteasome 26S subunit, non-ATPase 4, transcript variant 2, and Src like adaptor, transcript variant 1 by TMEL1032 antibody.

Figure 106:
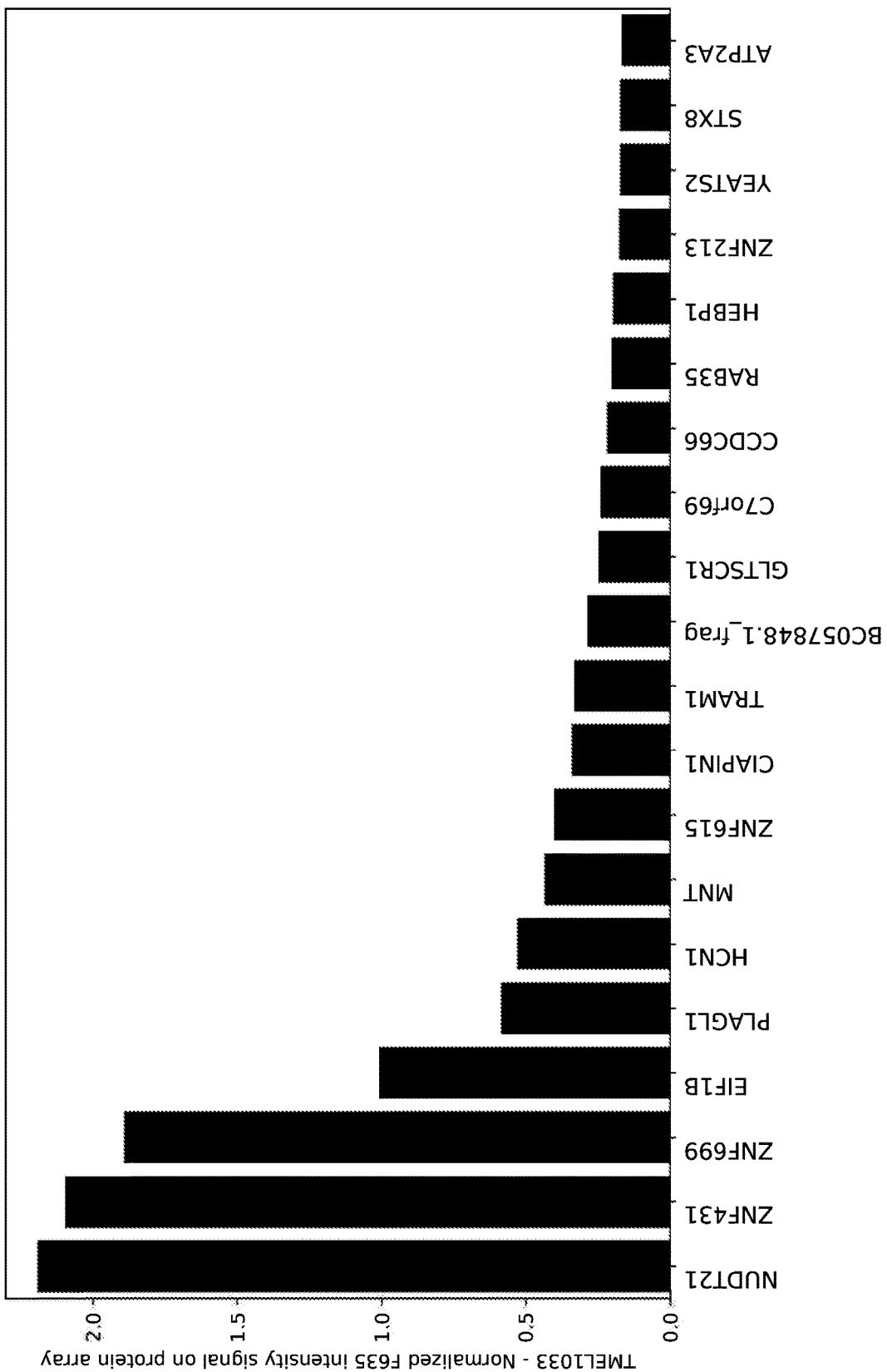

FIG. 106 is protein array data showing specific binding of nudix hydrolase 21 zinc finger protein 431, transcript variant 2, and Zinc finger protein 699 by TMEL1033 antibody.

Figure 107:
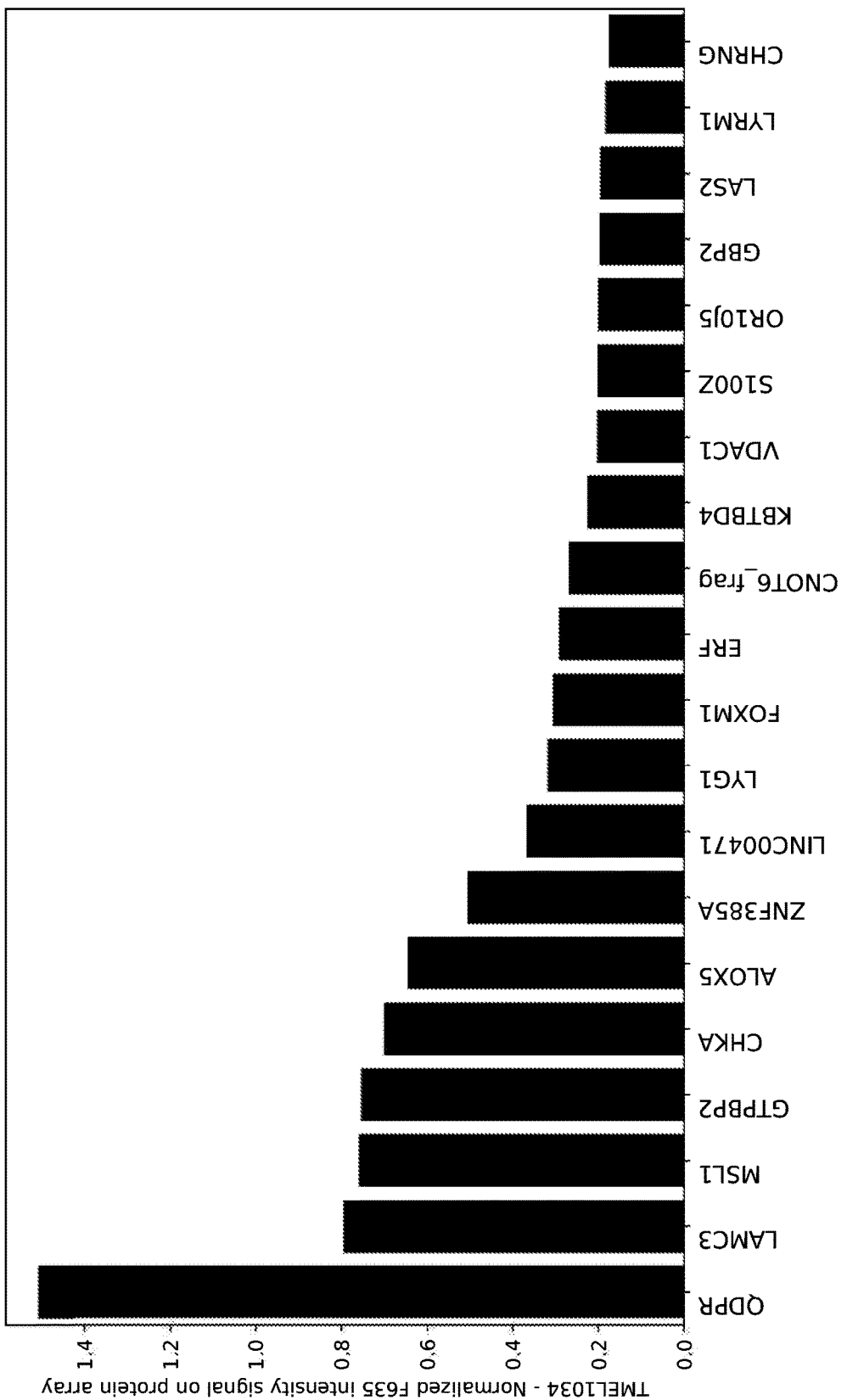

FIG. 107 is protein array data showing specific binding of quinoid dihydropteridine reductase, transcript variant 1 by TMEL1034 antibody.

Figure 108:
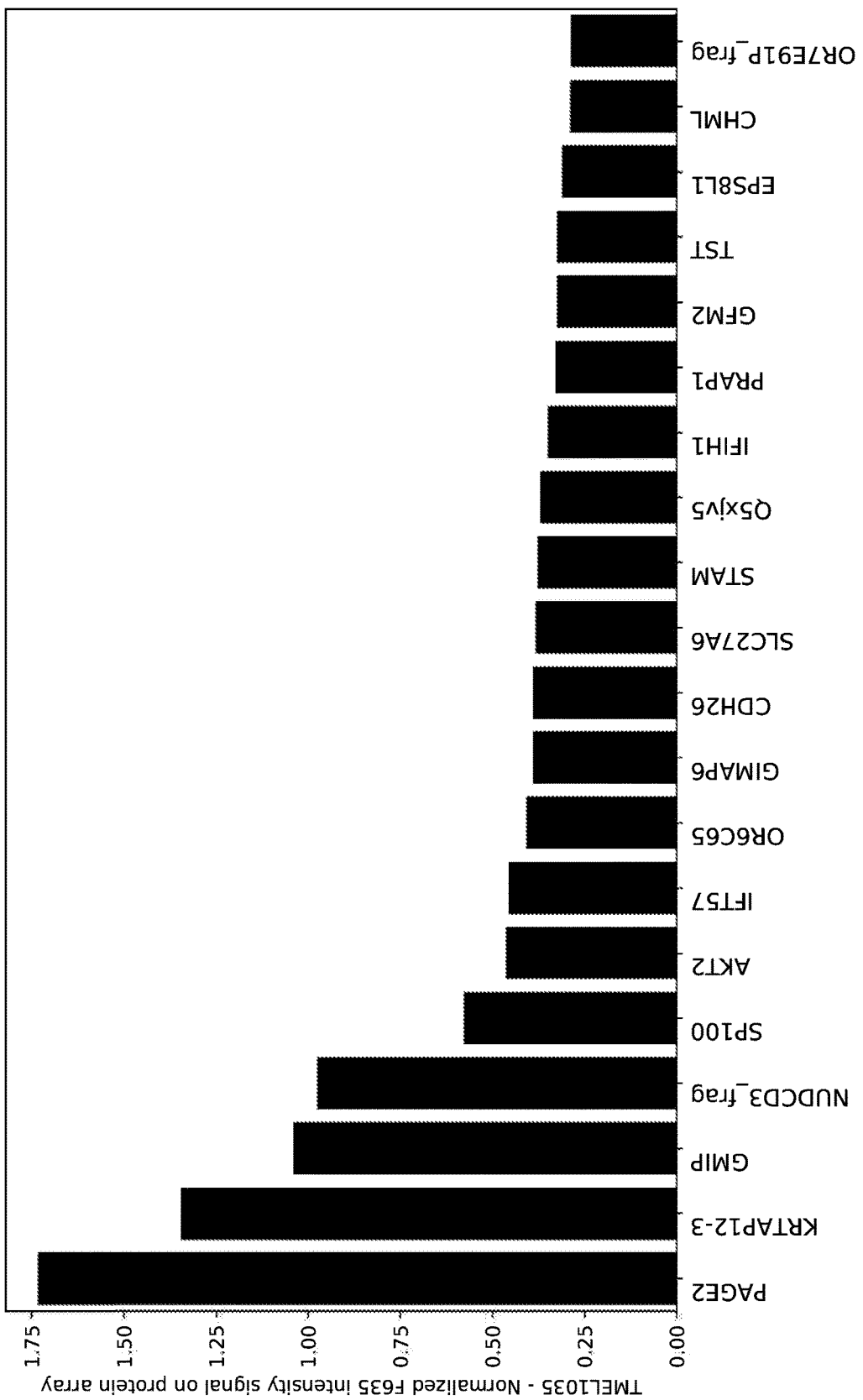

FIG. 108 is protein array data showing specific binding of PAGE family member 2 keratin associated protein 12-3 by TMEL1035 antibody.

Figure 109:
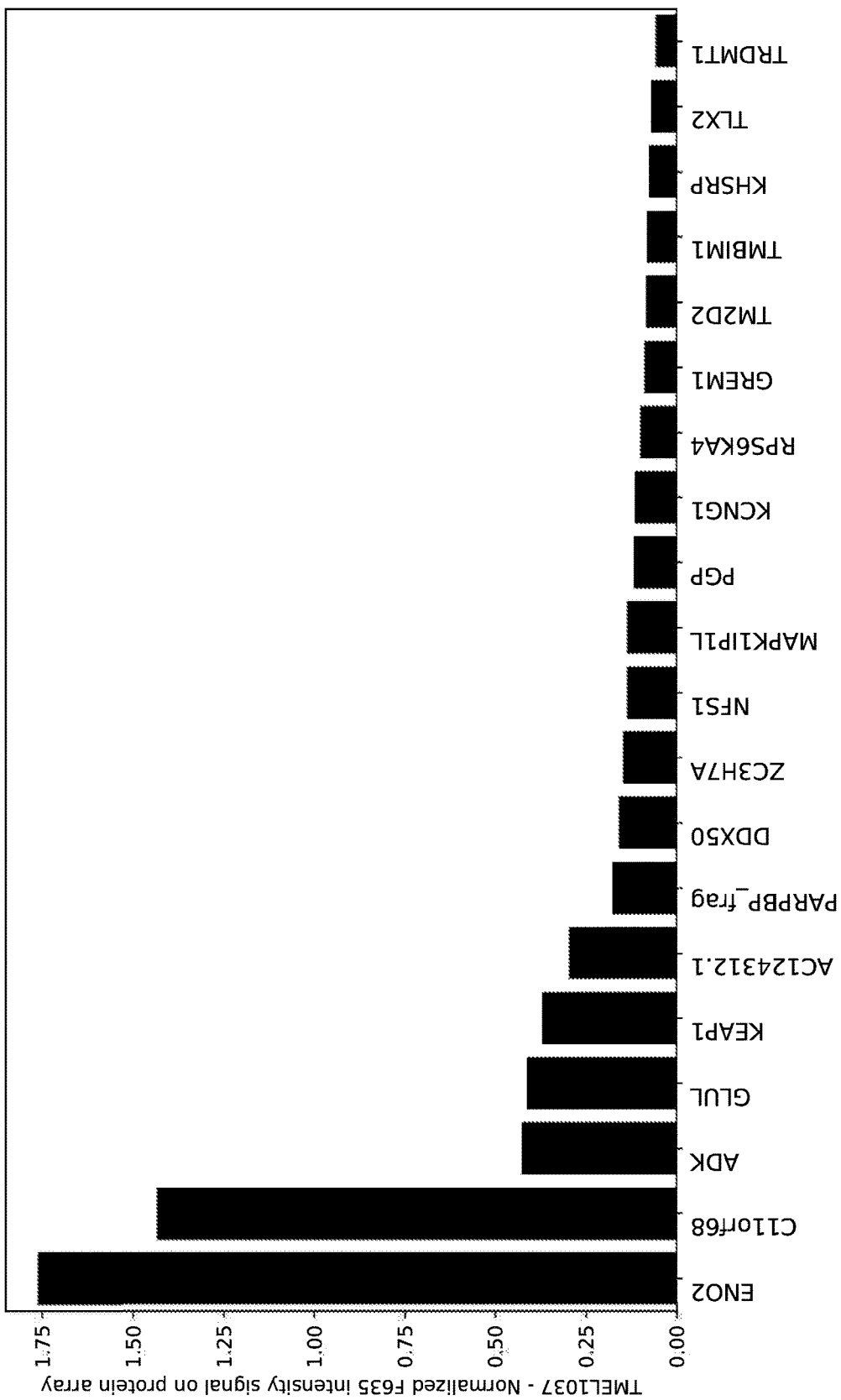

FIG. 109 is protein array data showing specific binding of enolase 2 chromosome 11 open reading frame 68, transcript variant 1 by TMEL1037 antibody.

Figure 110:
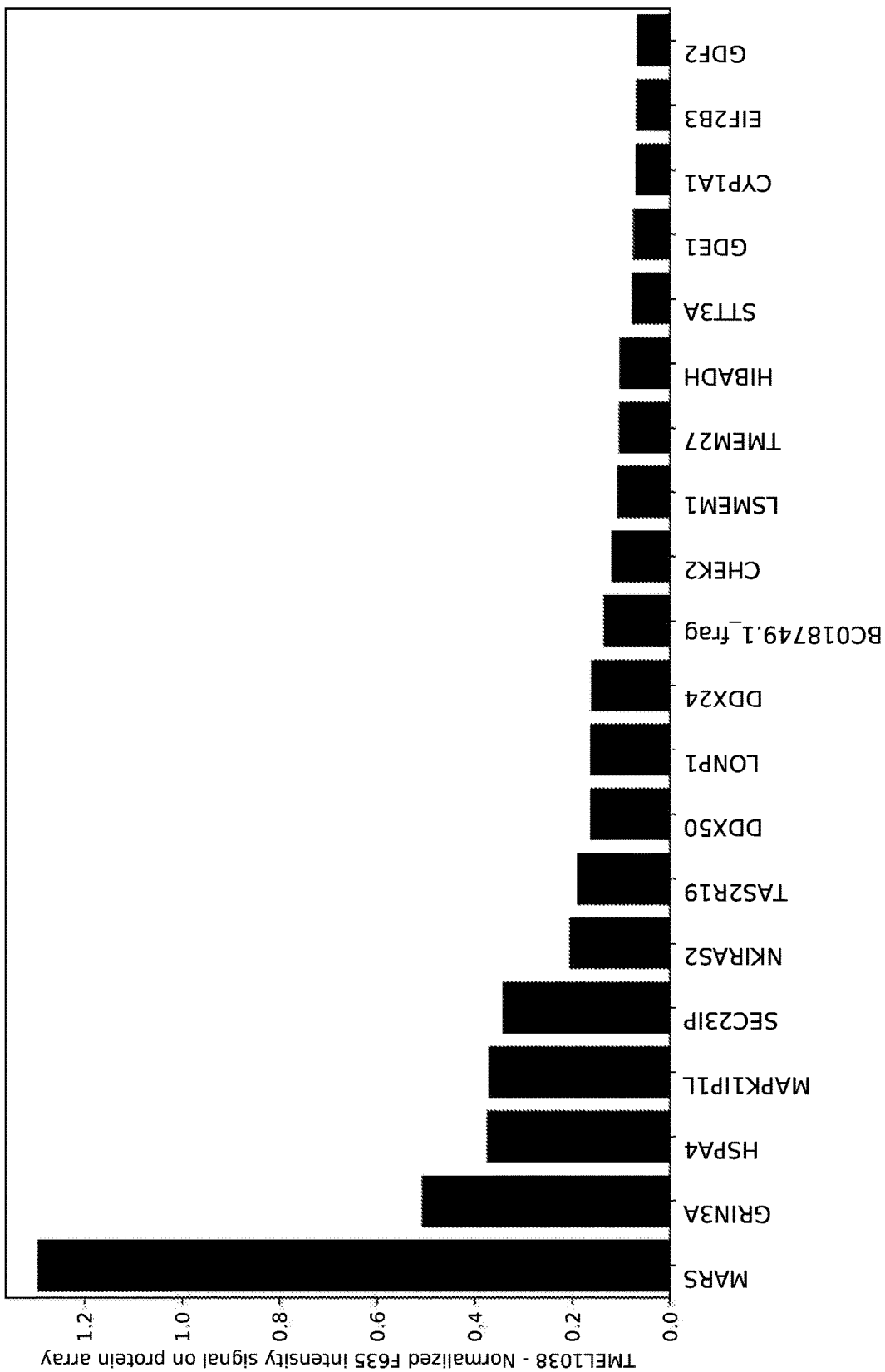

FIG. 110 is protein array data showing specific binding of enolase 2 chromosome 11 open reading frame 68, transcript variant 1 by TMEL1037 antibody.

Figure 111:
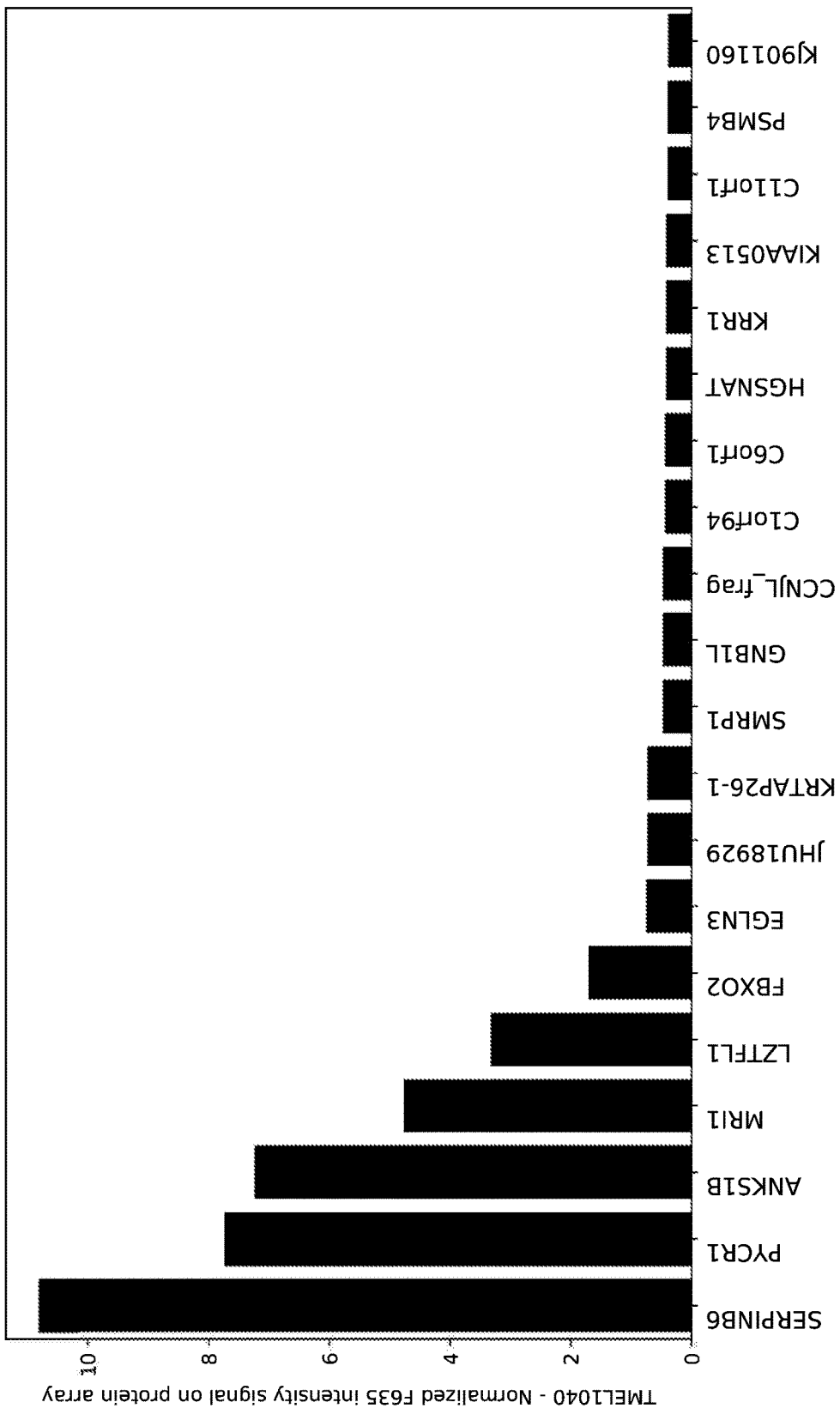

FIG. 111 is protein array data showing specific binding of serpin family B member 6, transcript variant 2 by TMEL1040 antibody.

Figure 112:
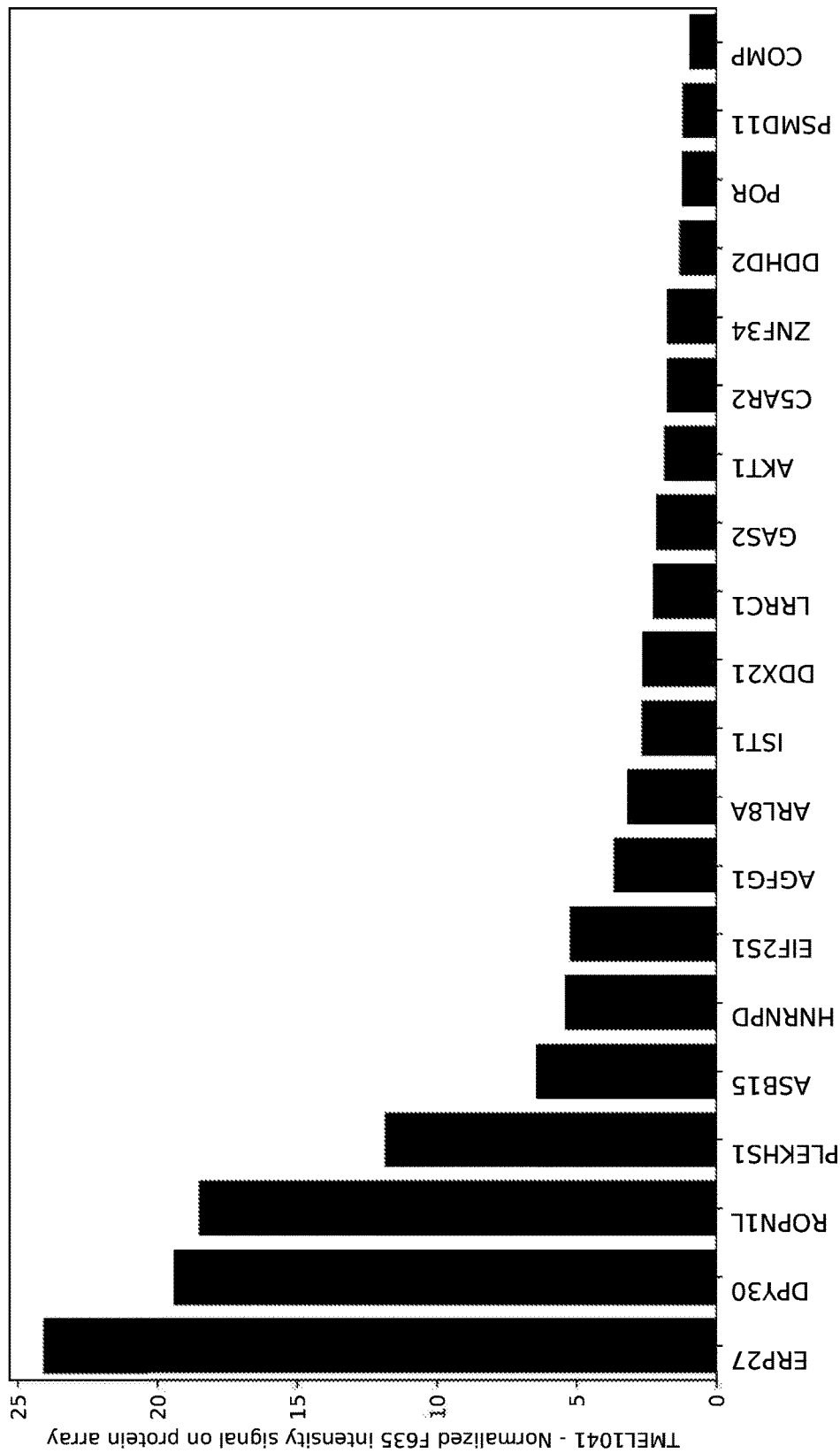

FIG. 112 is protein array data showing specific binding of Dpy-30 histone methyltransferase complex regulatory subunit, and rhophilin associated tail protein 1 like, transcript variant 2 by TMEL1041 antibody.

Figure 113:
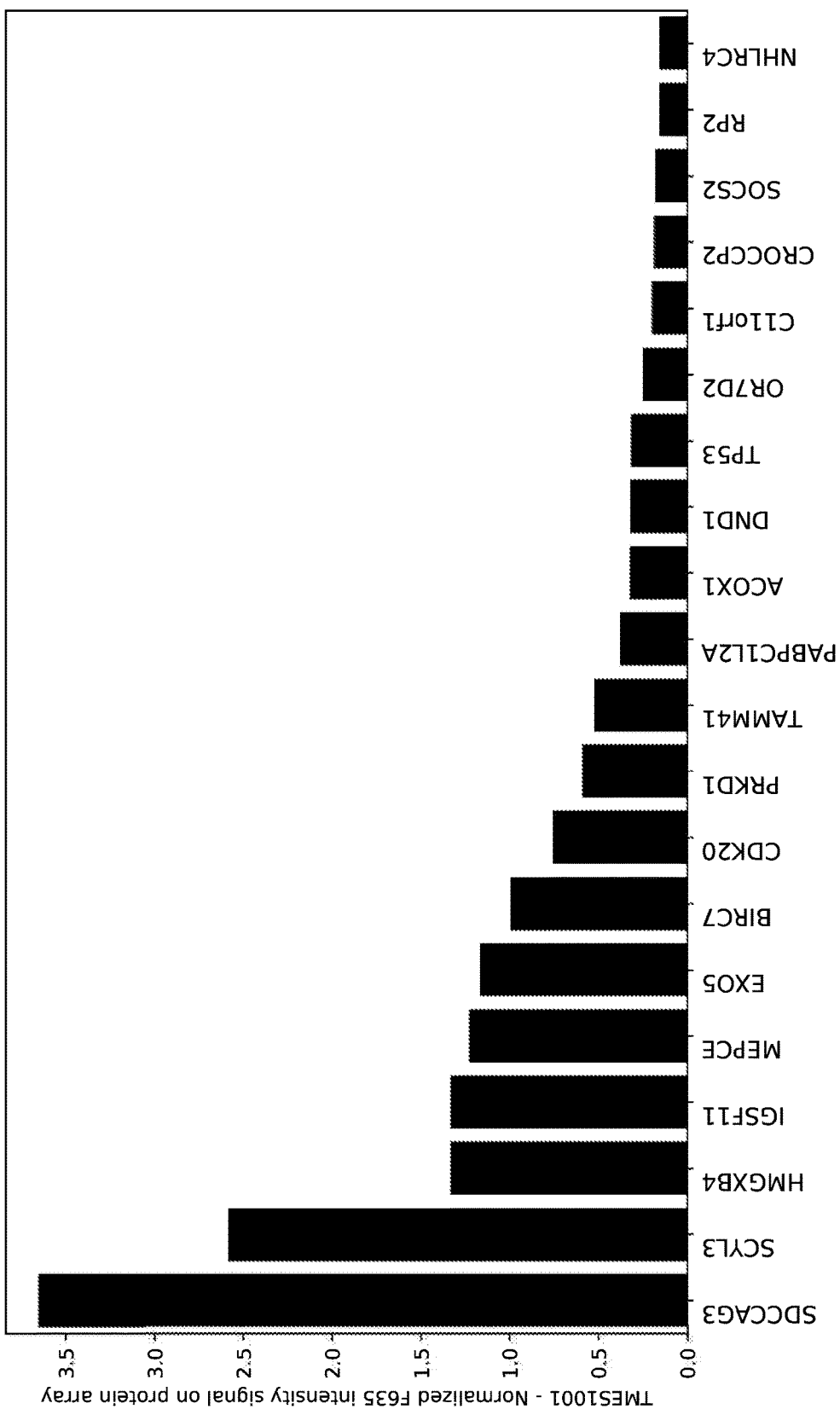

FIG. 113 is protein array data showing specific binding of endosome associated trafficking regulator 1, transcript variant 2 by TMES1001 antibody.

Figure 114:
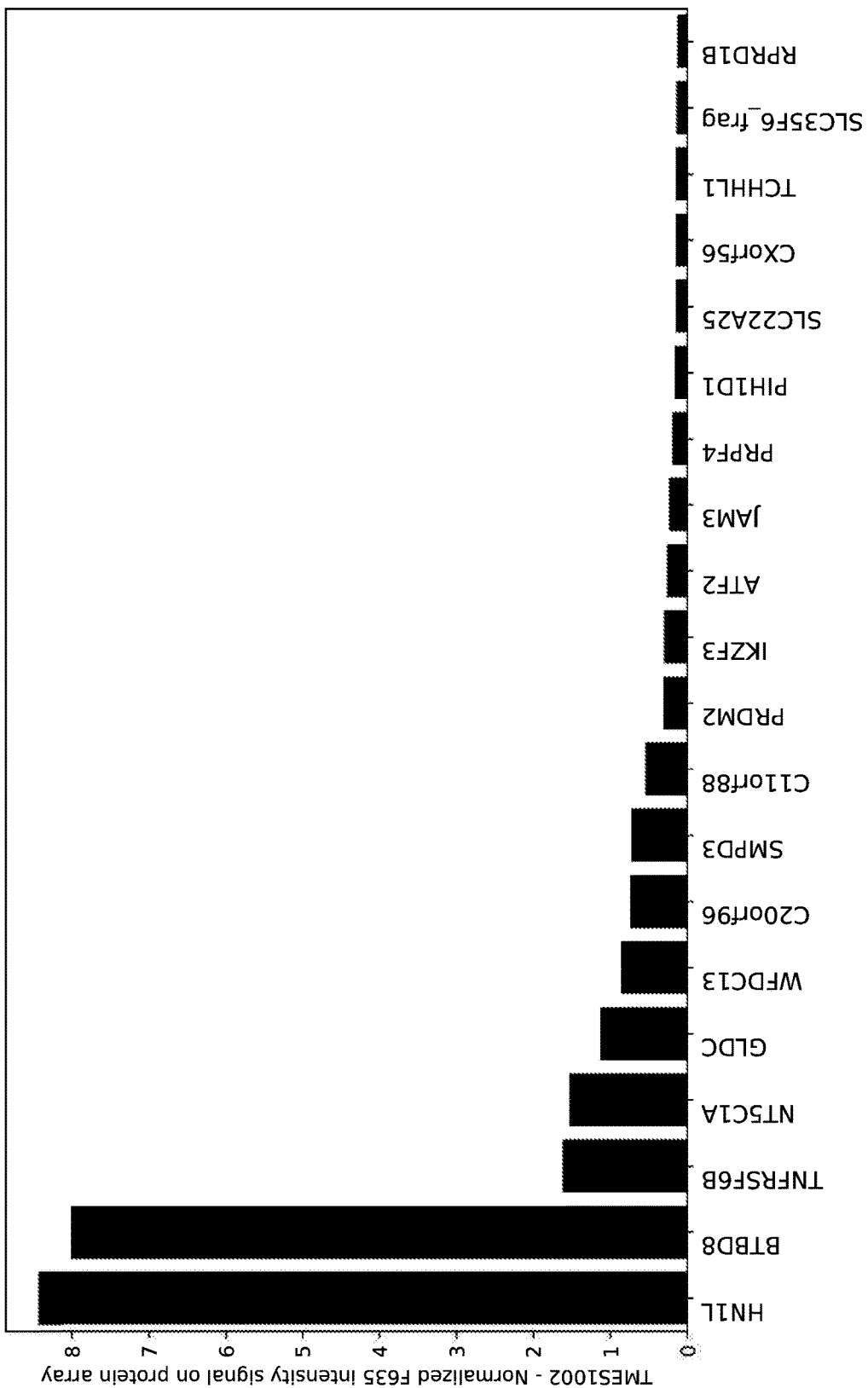

FIG. 114 is protein array data showing specific binding of Jupiter microtubule associated homolog 2, and BTB domain containing 8 by TMES1002 antibody.

Figure 115:
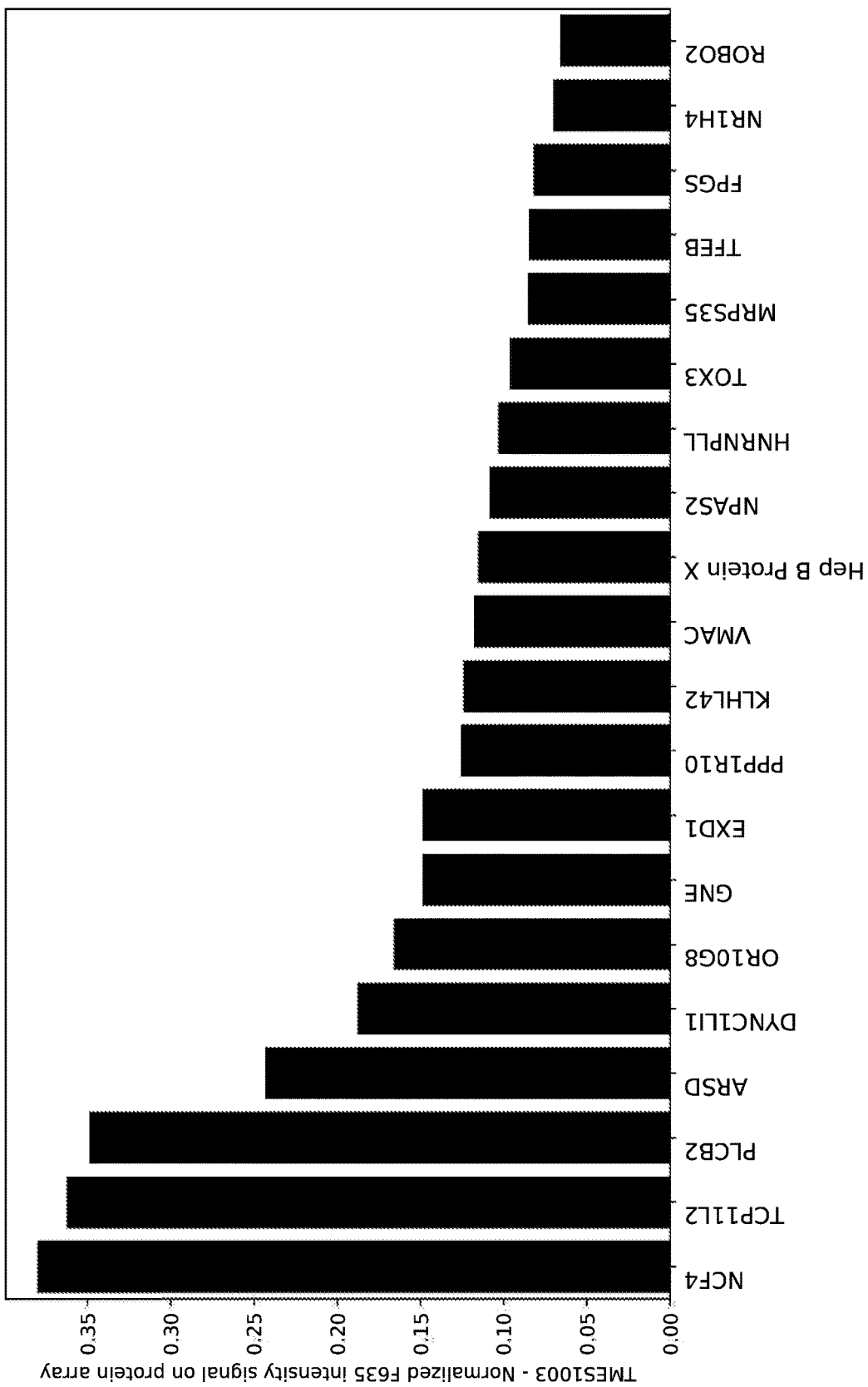

FIG. 115 is protein array data showing specific binding of neutrophil cytosolic factor 4, transcript variant 2, t-complex 11 like 2, transcript variant X2, and phospholipase C beta 2, transcript variant 4 by TMES1003 antibody.

Figure 116:
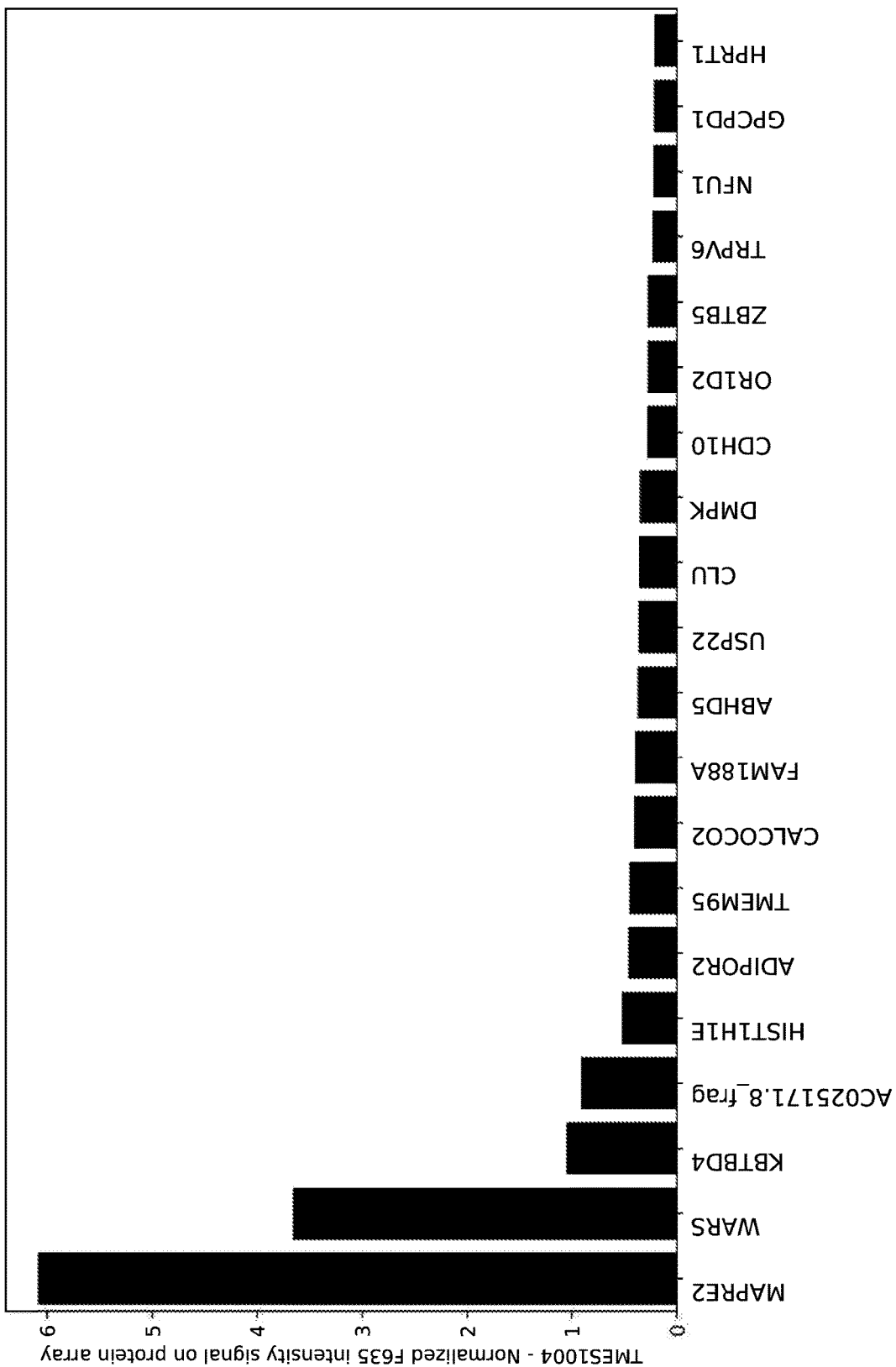

FIG. 116 is protein array data showing specific binding of microtubule associated protein RP/EB family member 2, transcript variant 1 by TMES1004 antibody.

Figure 117:
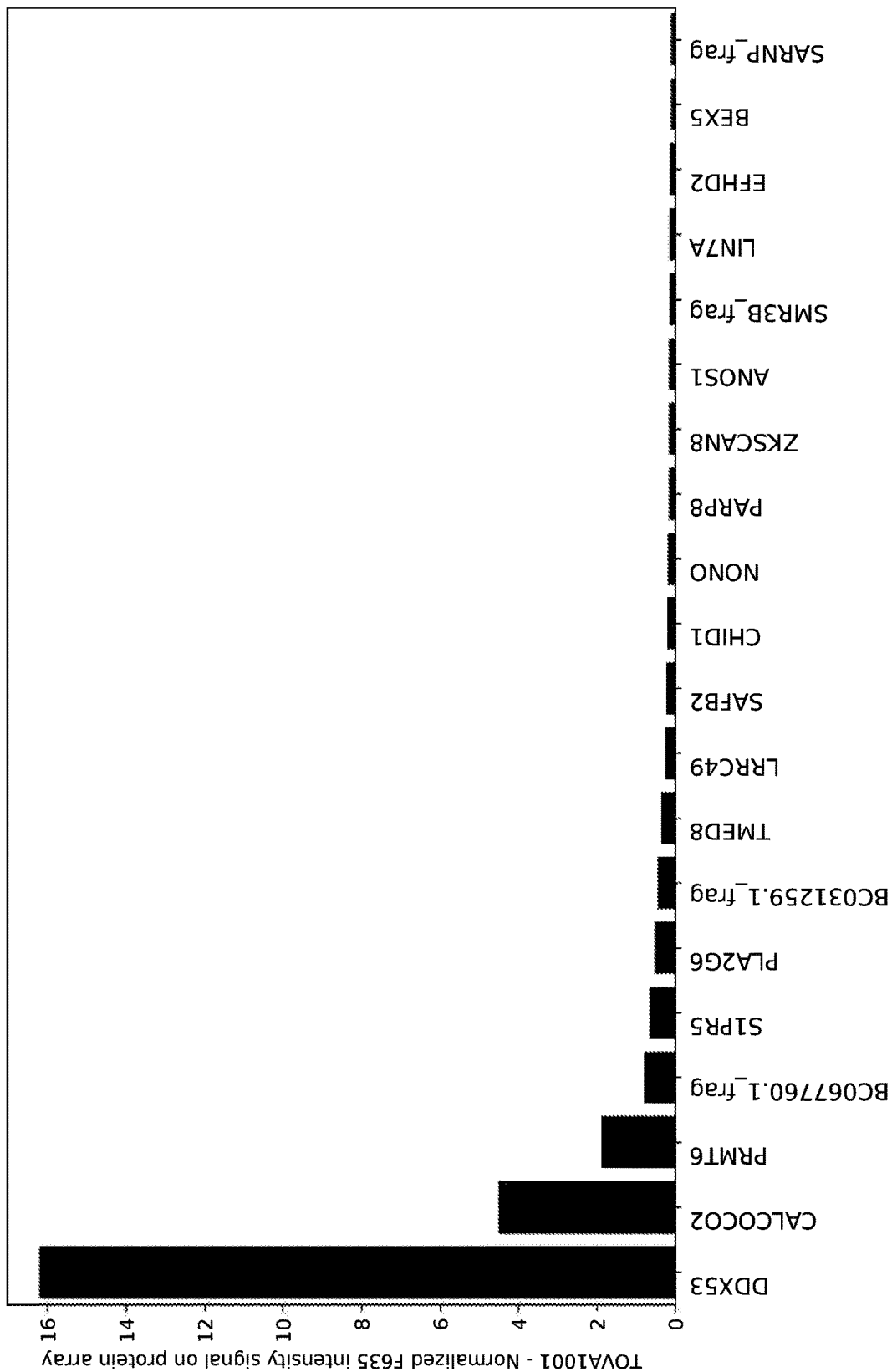

FIG. 117 is protein array data showing specific binding of DEAD-box helicase 53 by TOVA1001 antibody.

Figure 118:
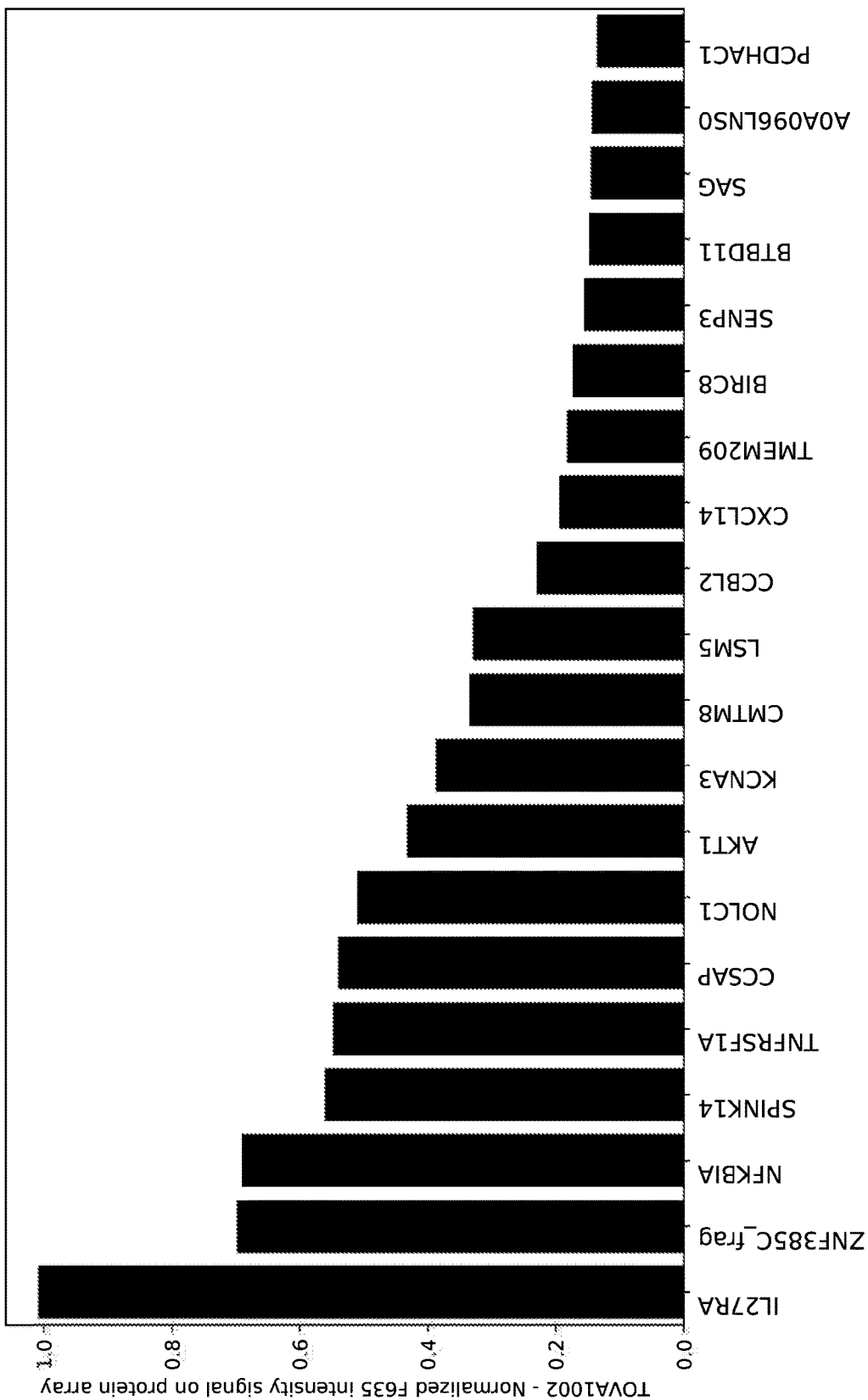

FIG. 118 is protein array data showing specific binding of interleukin 27 receptor subunit alpha by TOVA1002 antibody.

Figure 119:
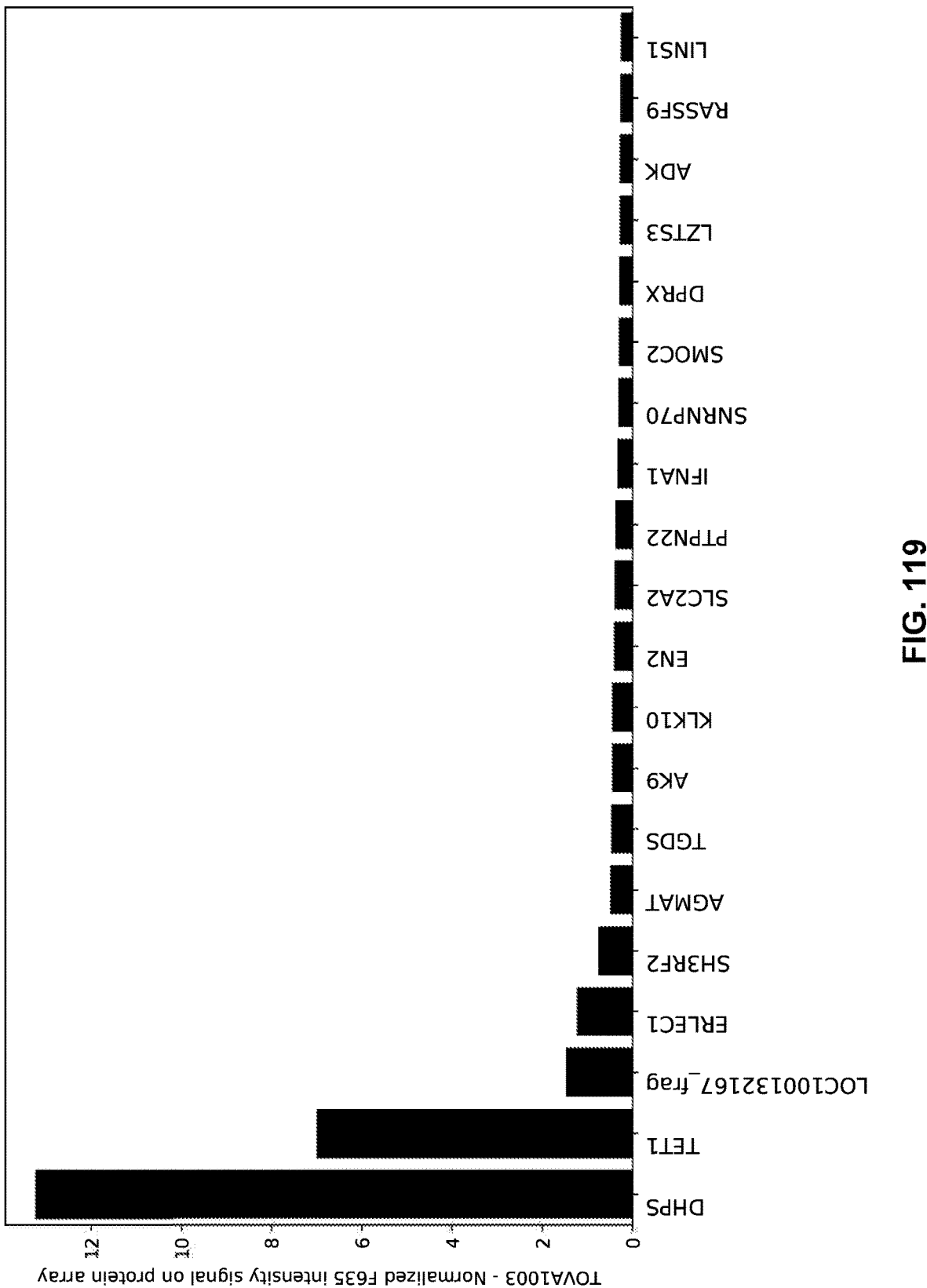

FIG. 119 is protein array data showing specific binding of Deoxyhypusine synthase by TOVA1003 antibody.

Figure 120A:
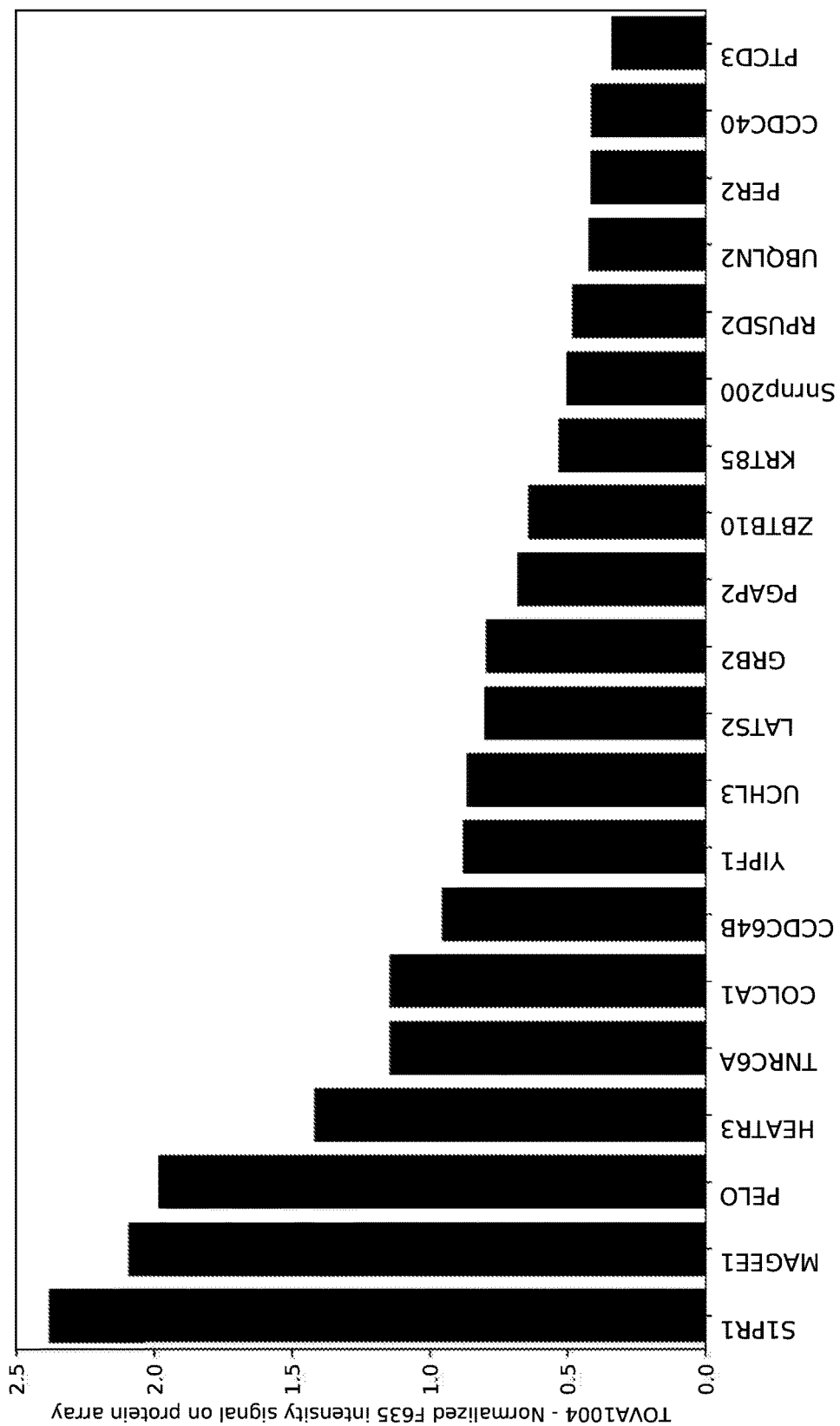
Figure 120B:
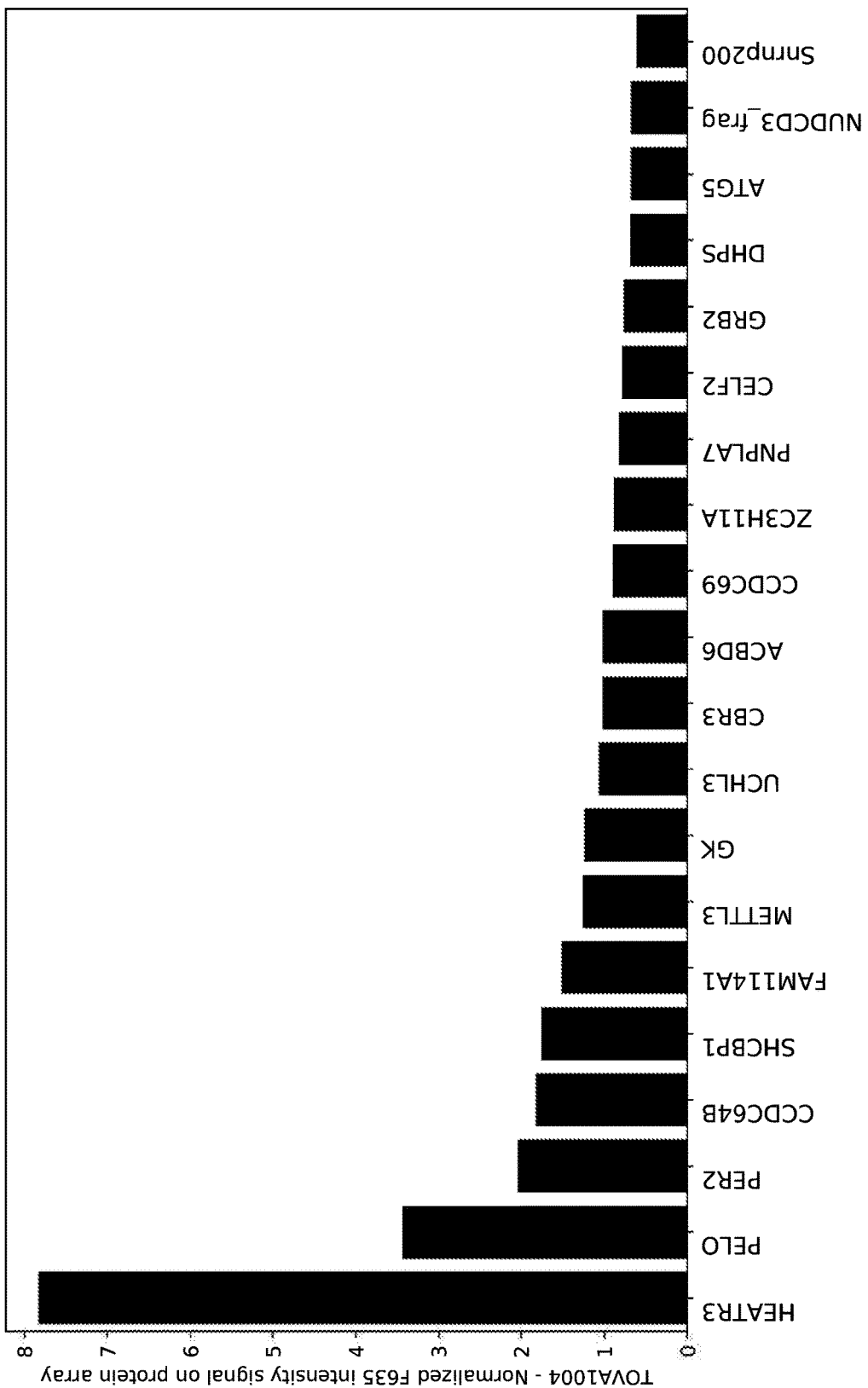

FIG. 120A is protein array data showing specific binding of HEAT repeat containing 3, transcript variant 1 by TOVA1004 antibody. FIG. 120B is an experimental replicate showing specific binding of HEAT repeat containing 3, transcript variant 1 by TOVA1004 antibody.

Figure 121:
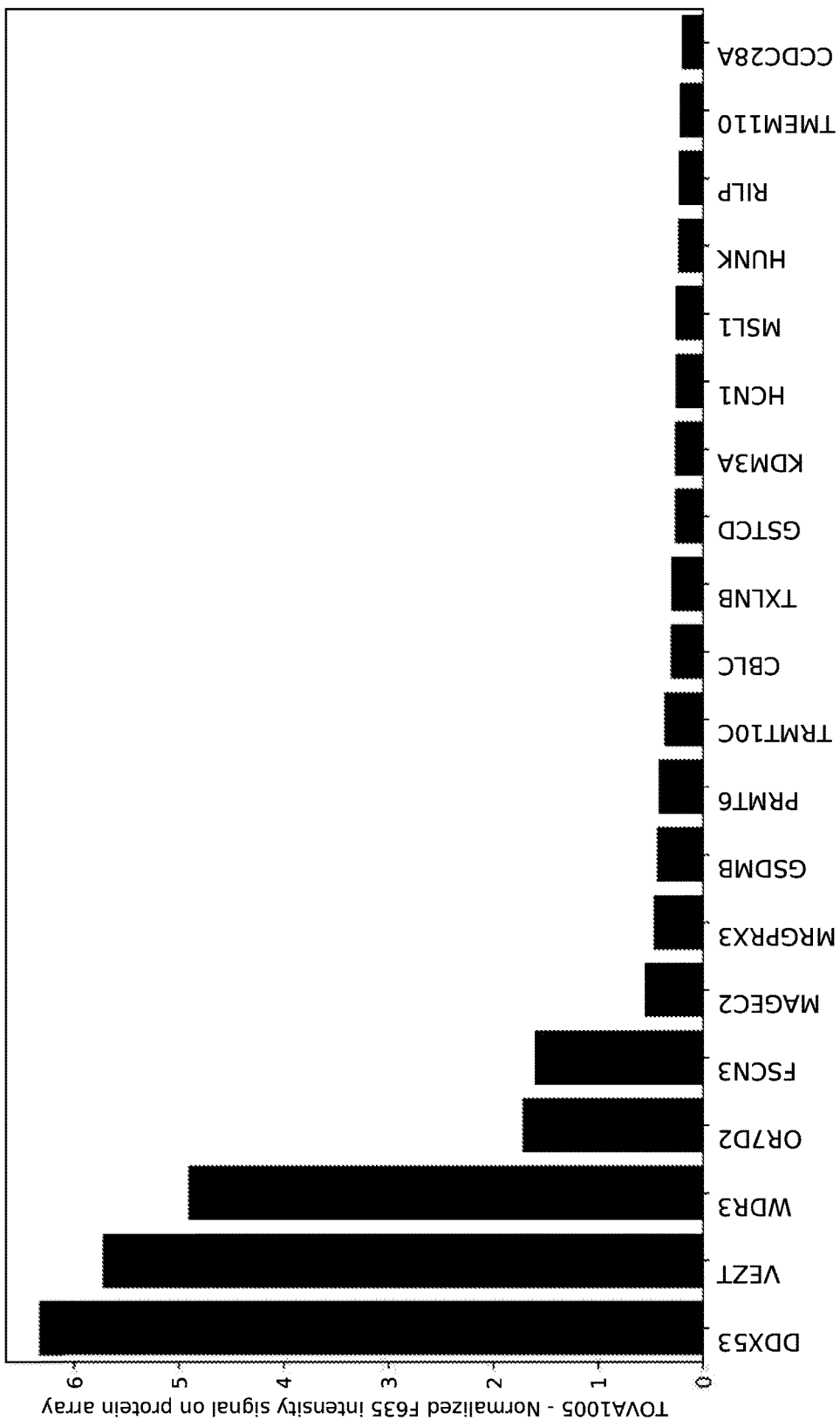

FIG. 121 is protein array data showing specific binding of DEAD-box helicase 53, Vezatin, adherens junctions transmembrane protein, and Wd repeat domain 3 by TOVA1005 antibody.

Figure 122A:
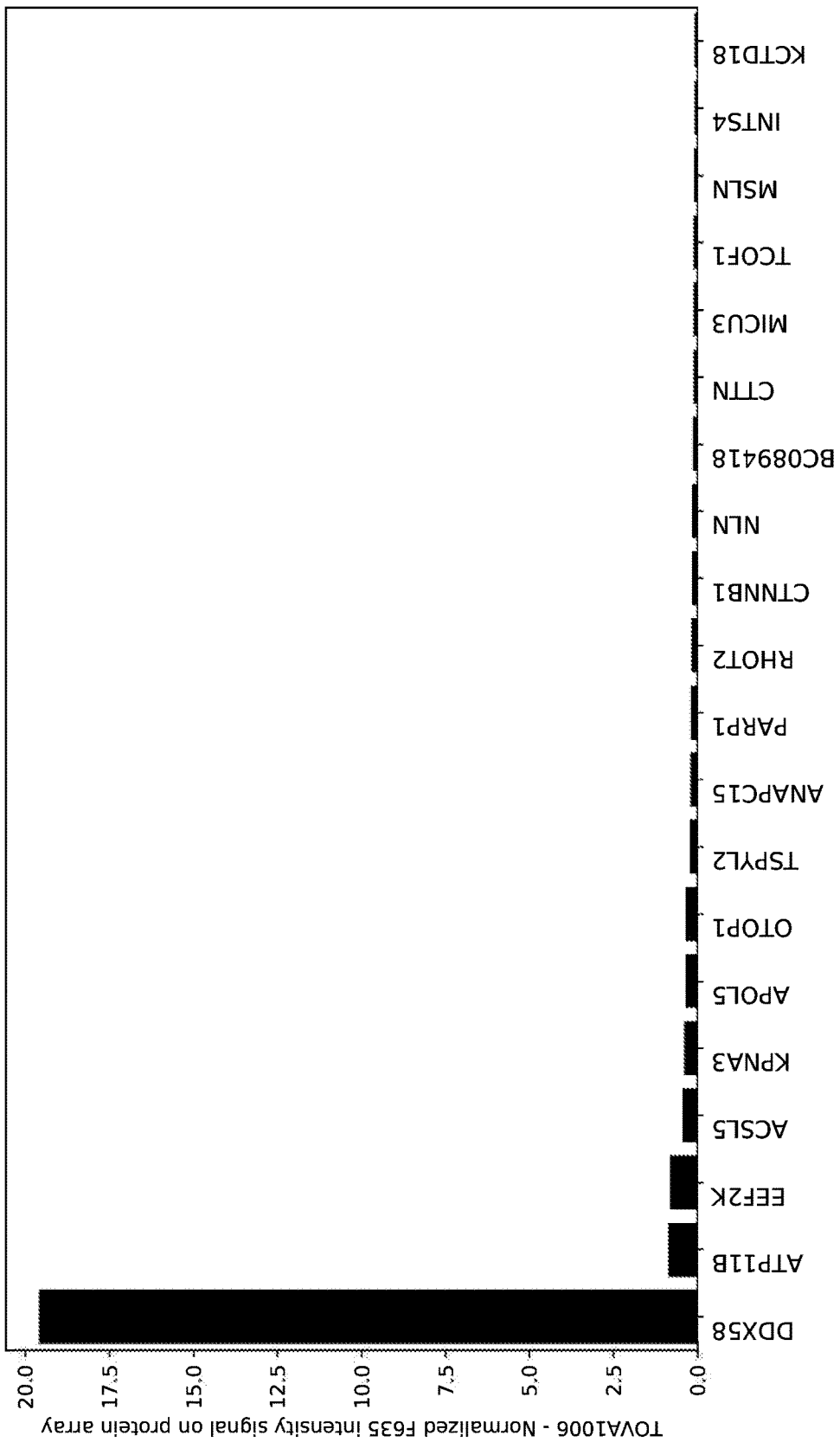
Figure 122B:
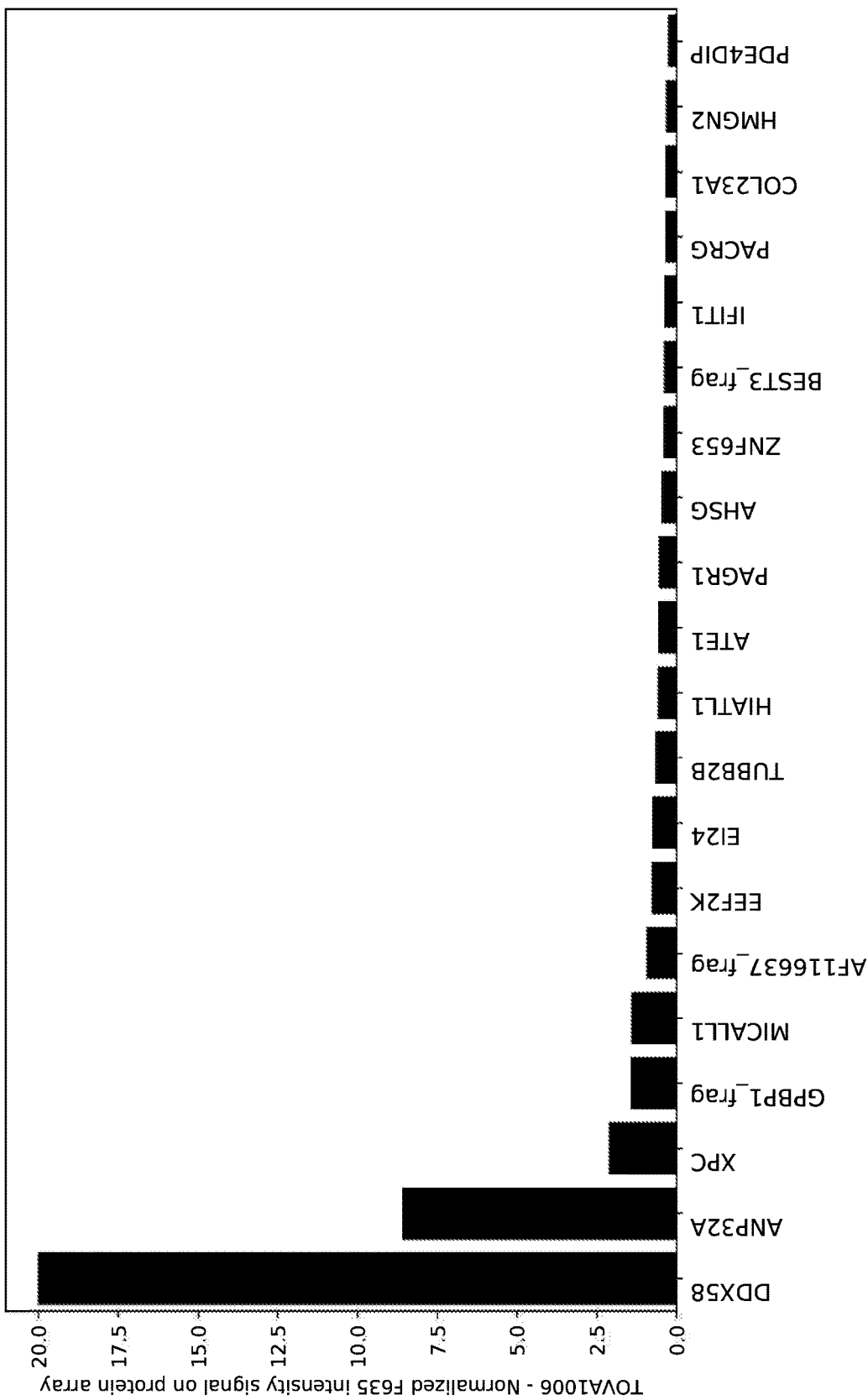

FIG. 122A is protein array data showing specific binding of DExD/H-box helicase 58 by TOVA1006 antibody. FIG. 122B is an experimental replicate showing specific binding of DExD/H-box helicase 58 by TOVA1006 antibody.

Figure 123:
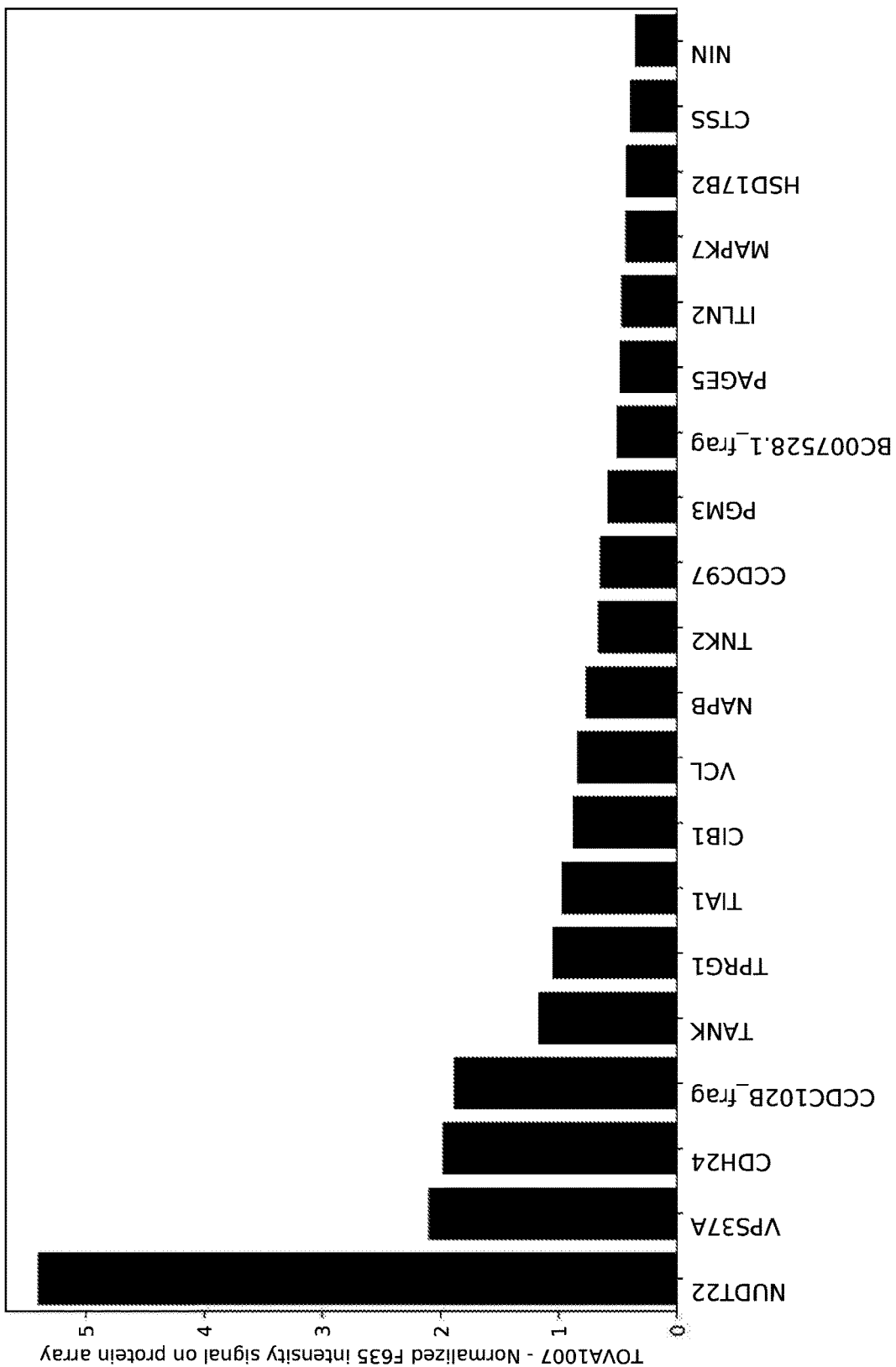

FIG. 123 is protein array data showing specific binding of nudix hydrolase 22, transcript variant 2 by TOVA1007 antibody.

Figure 124:
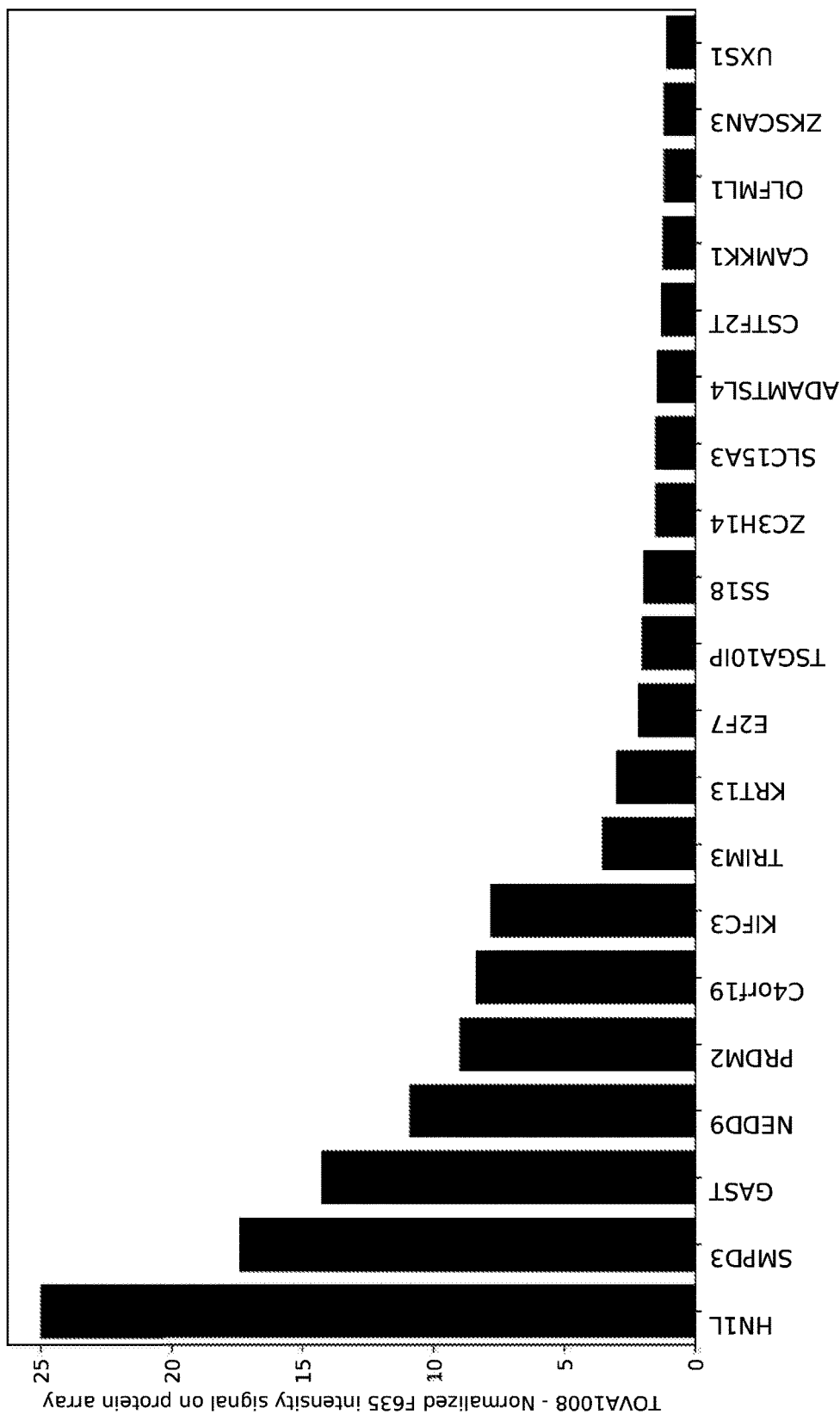

FIG. 124 is protein array data showing specific binding of Jupiter microtubule associated homolog 2 by TOVA1008 antibody.

Figure 125:
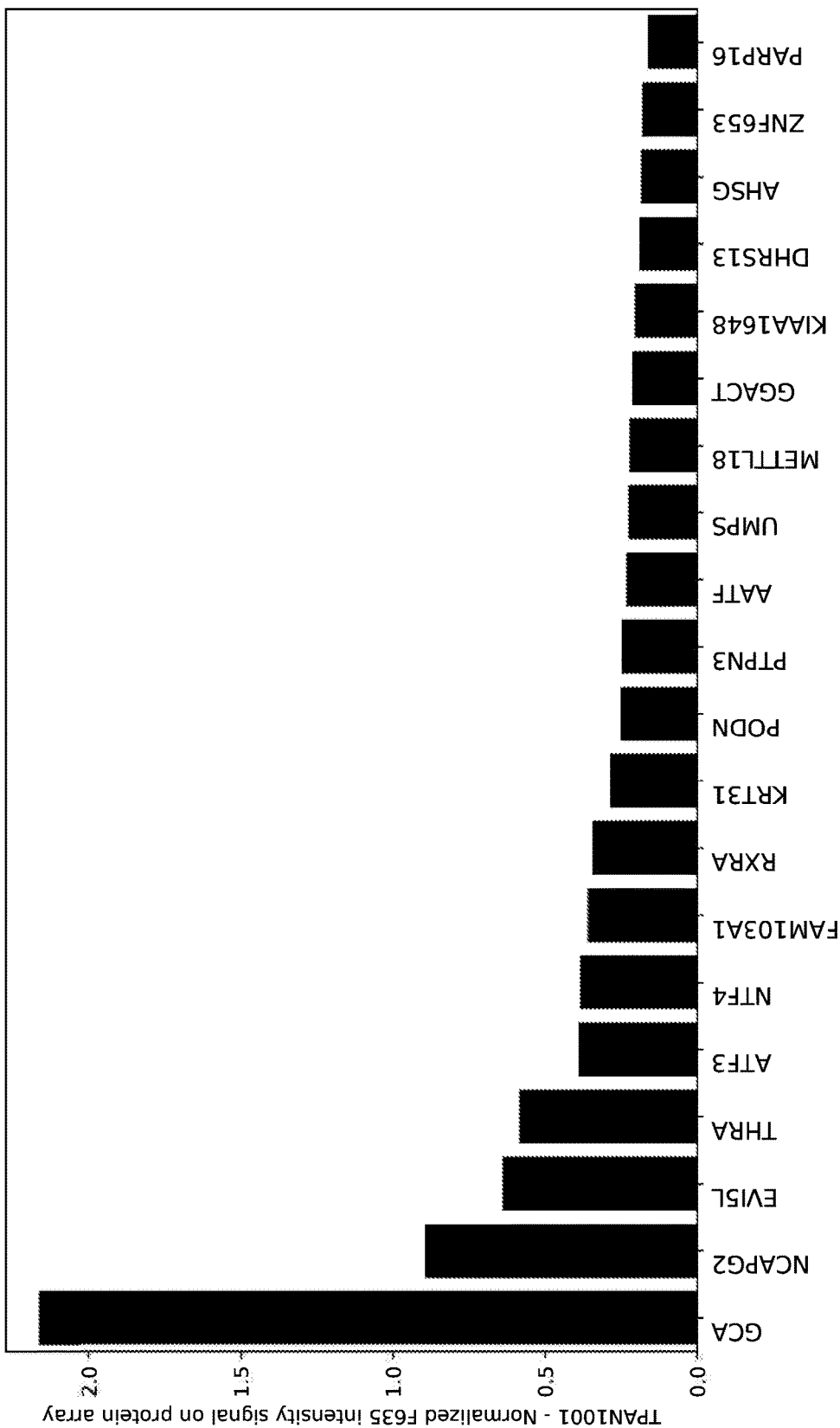

FIG. 125 is protein array data showing specific binding of grancalcin, transcript variant 4 by TPAN1001 antibody.

Figure 126:
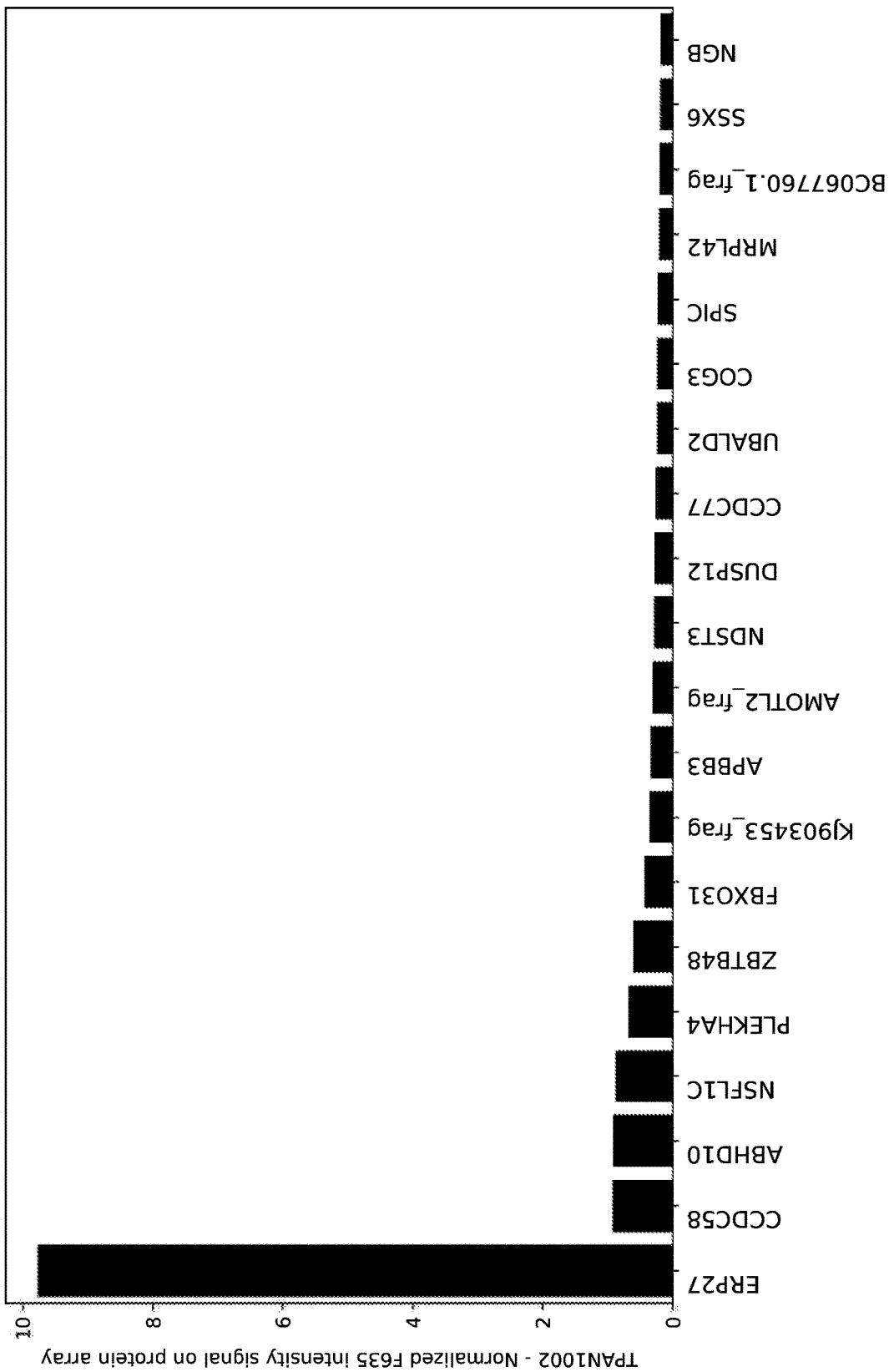

FIG. 126 is protein array data showing specific binding of endoplasmic reticulum protein 27, transcript variant 1 by TPAN1002 antibody.

Figure 127:
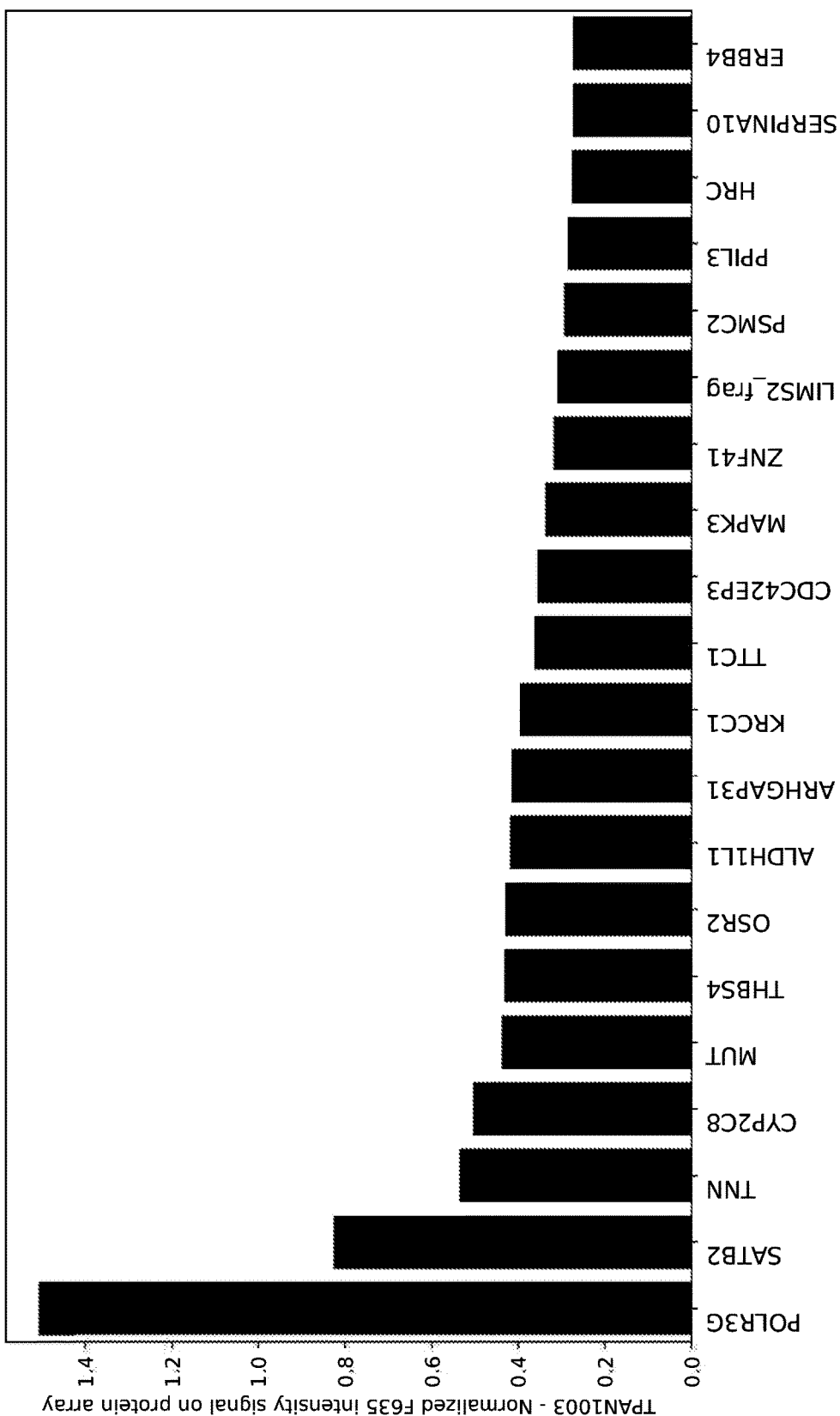

FIG. 127 is protein array data showing specific binding of Rna polymerase iii subunit g by TPAN1003 antibody.

Figure 128:
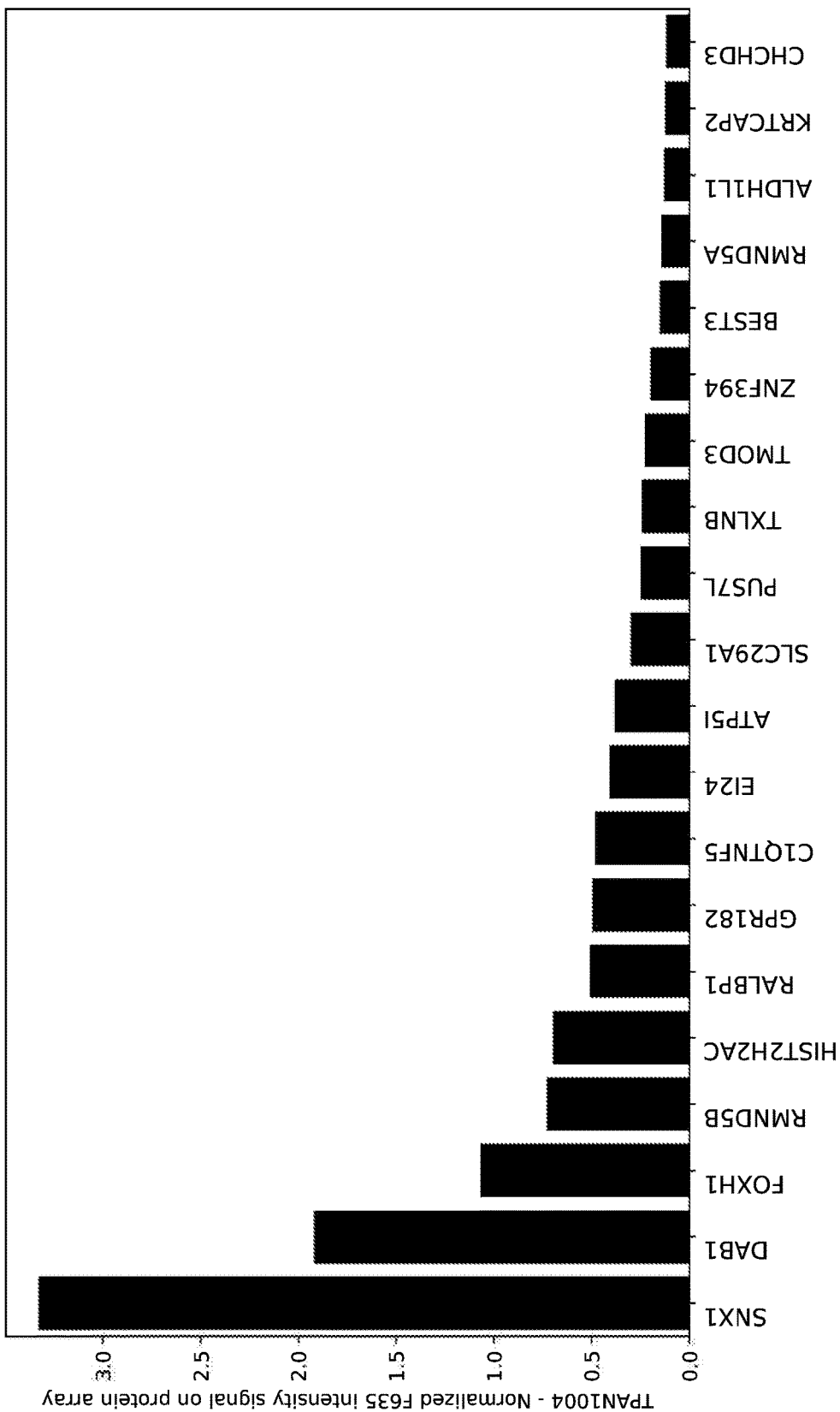

FIG. 128 is protein array data showing specific binding of sorting nexin 1, transcript variant 1 by TPAN1004 antibody.

Figure 129:
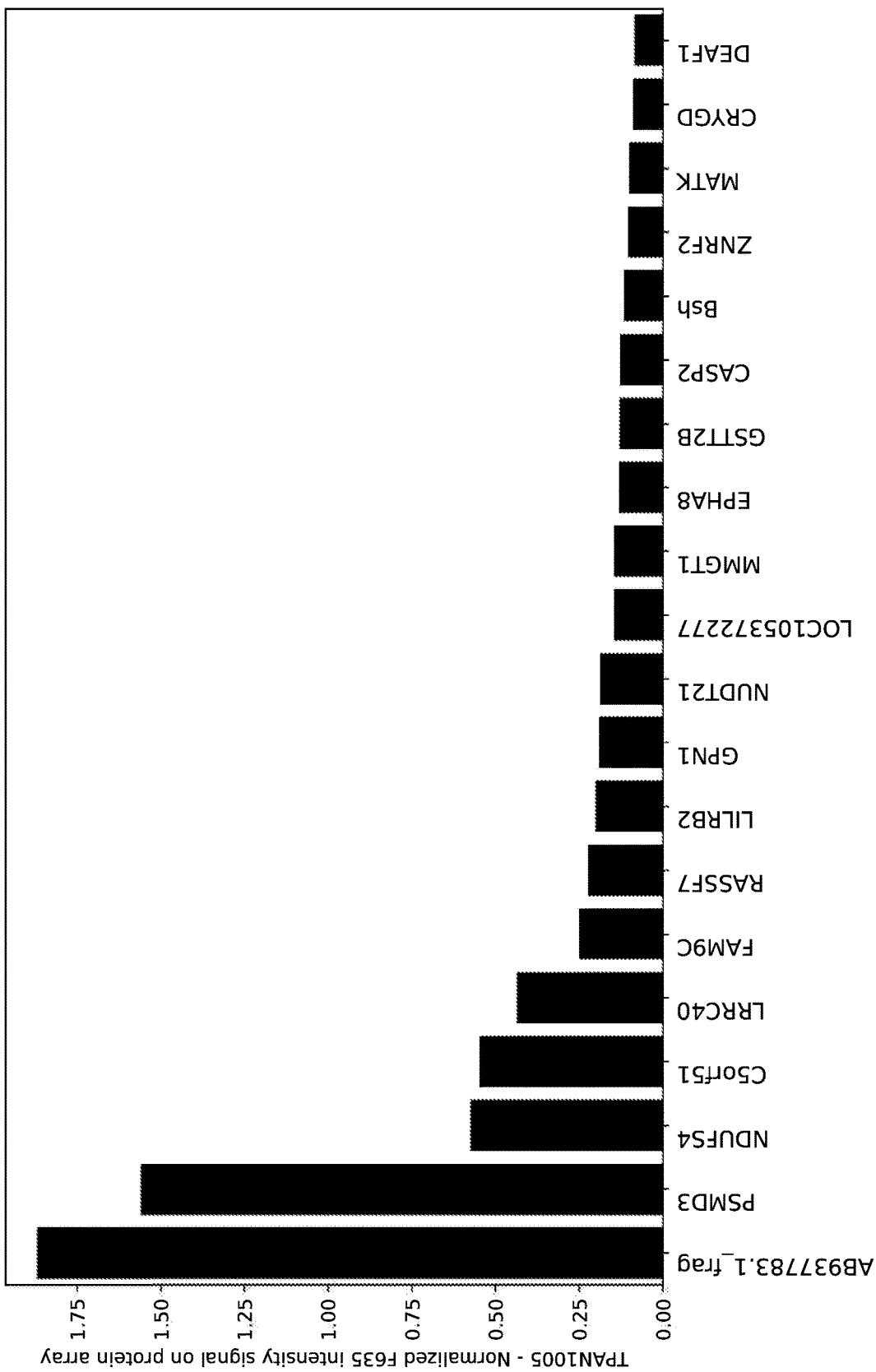

FIG. 129 is protein array data showing specific binding of SAA2-SAA3, and proteasome 26S subunit, non-ATPase 3 by TPAN1005 antibody.

Figure 130A:
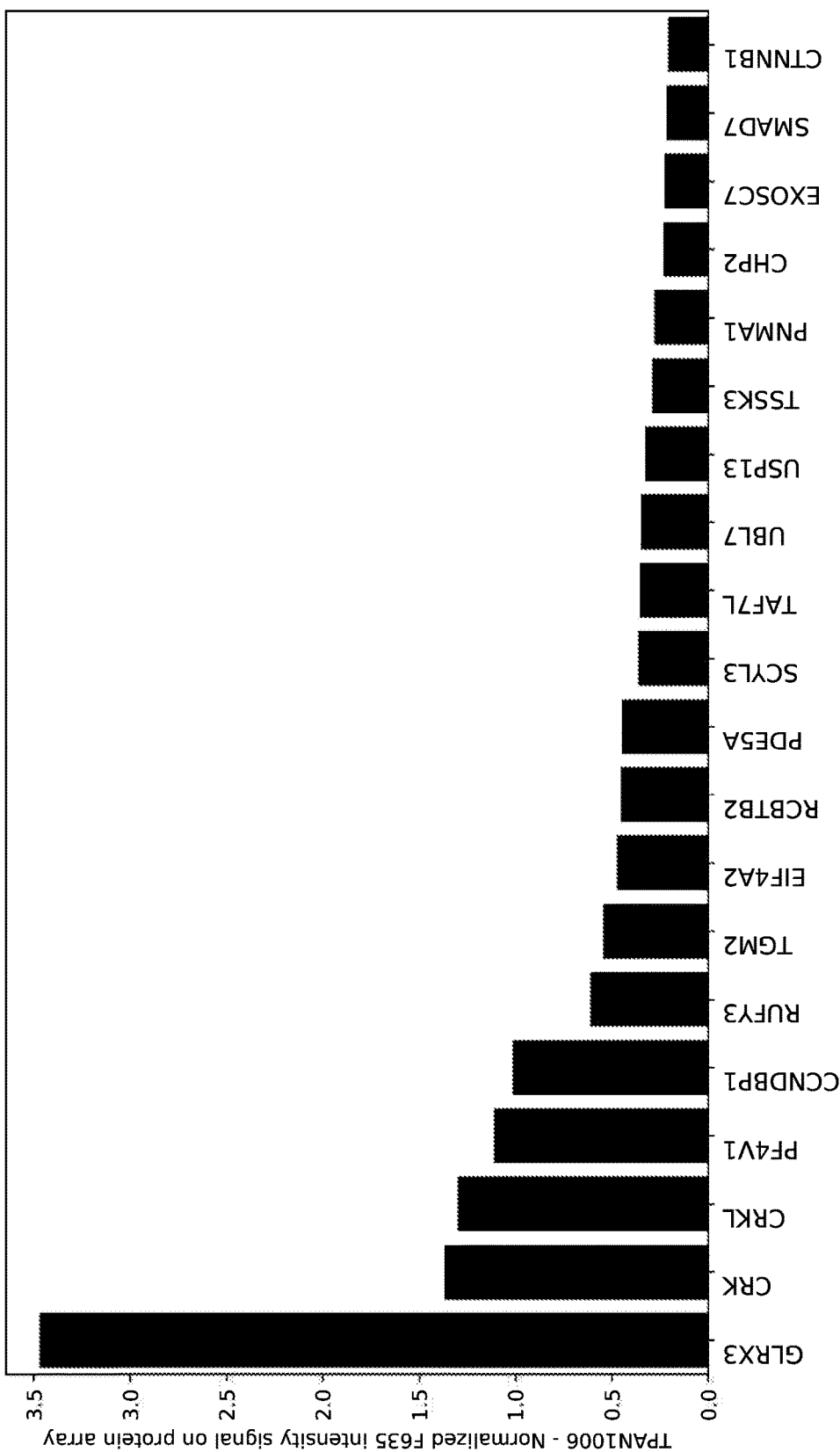
Figure 130B:
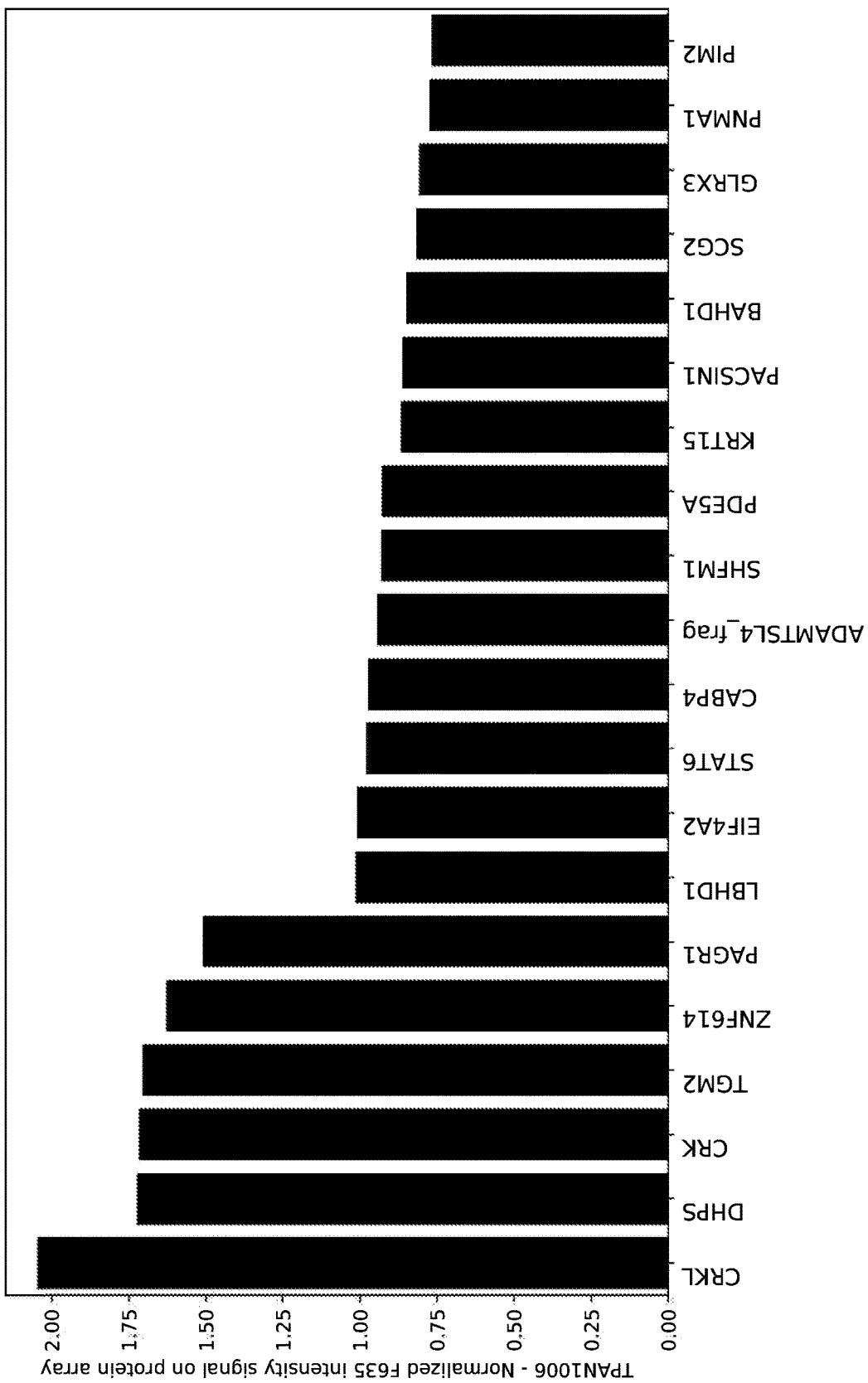

FIG. 130A is protein array data showing specific binding of CRK like proto-oncogene, adaptor protein, transcript variant 1 by TPAN1006 antibody. FIG. 130B is an experimental replicate showing specific binding of CRK like proto-oncogene, adaptor protein, transcript variant 1 by TPAN1006 antibody.

Figure 131:
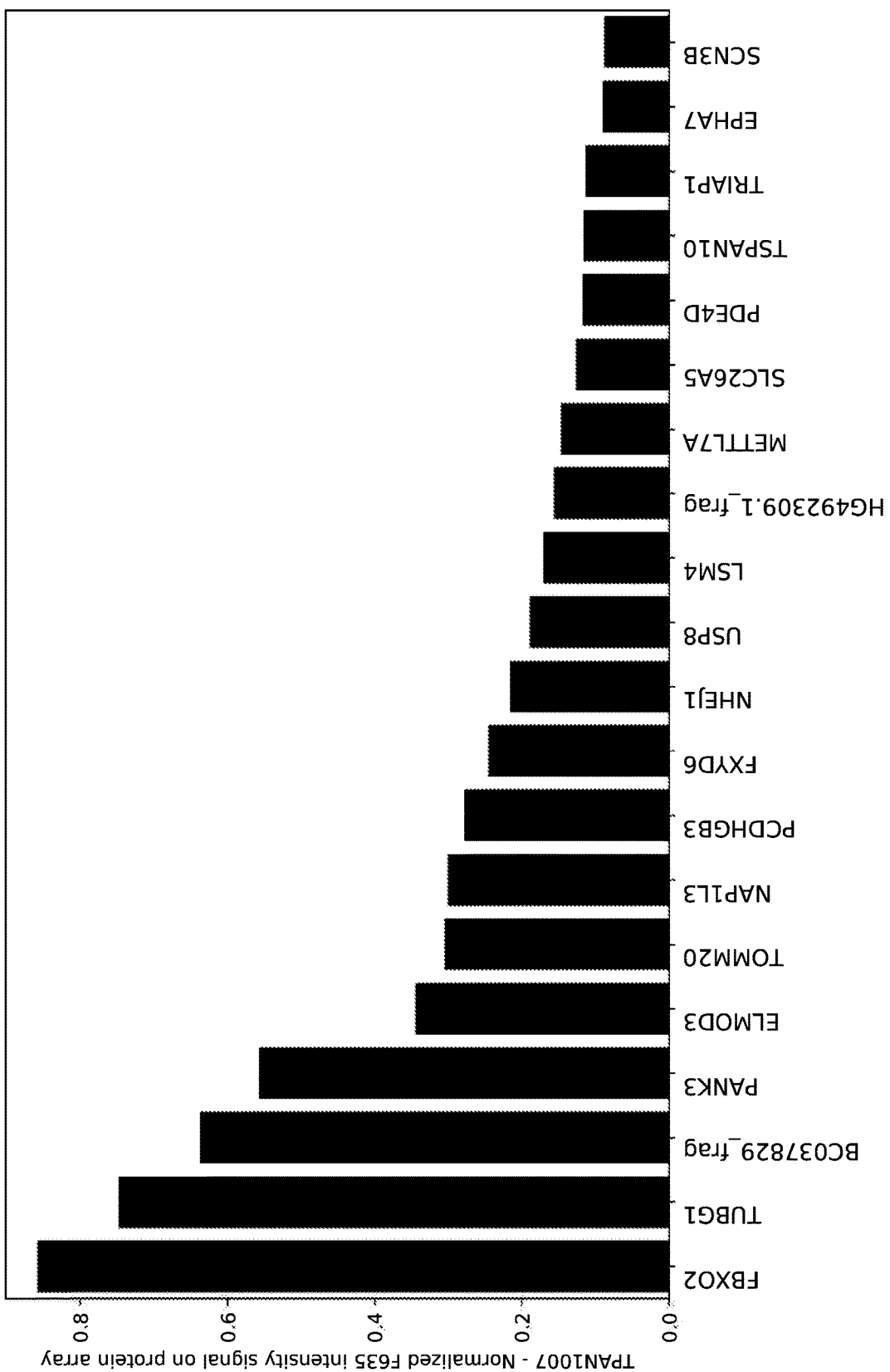

FIG. 131 is protein array data showing specific binding of F-box protein 2, and tubulin gamma 1 by TPAN1007 antibody.

Figure 132:
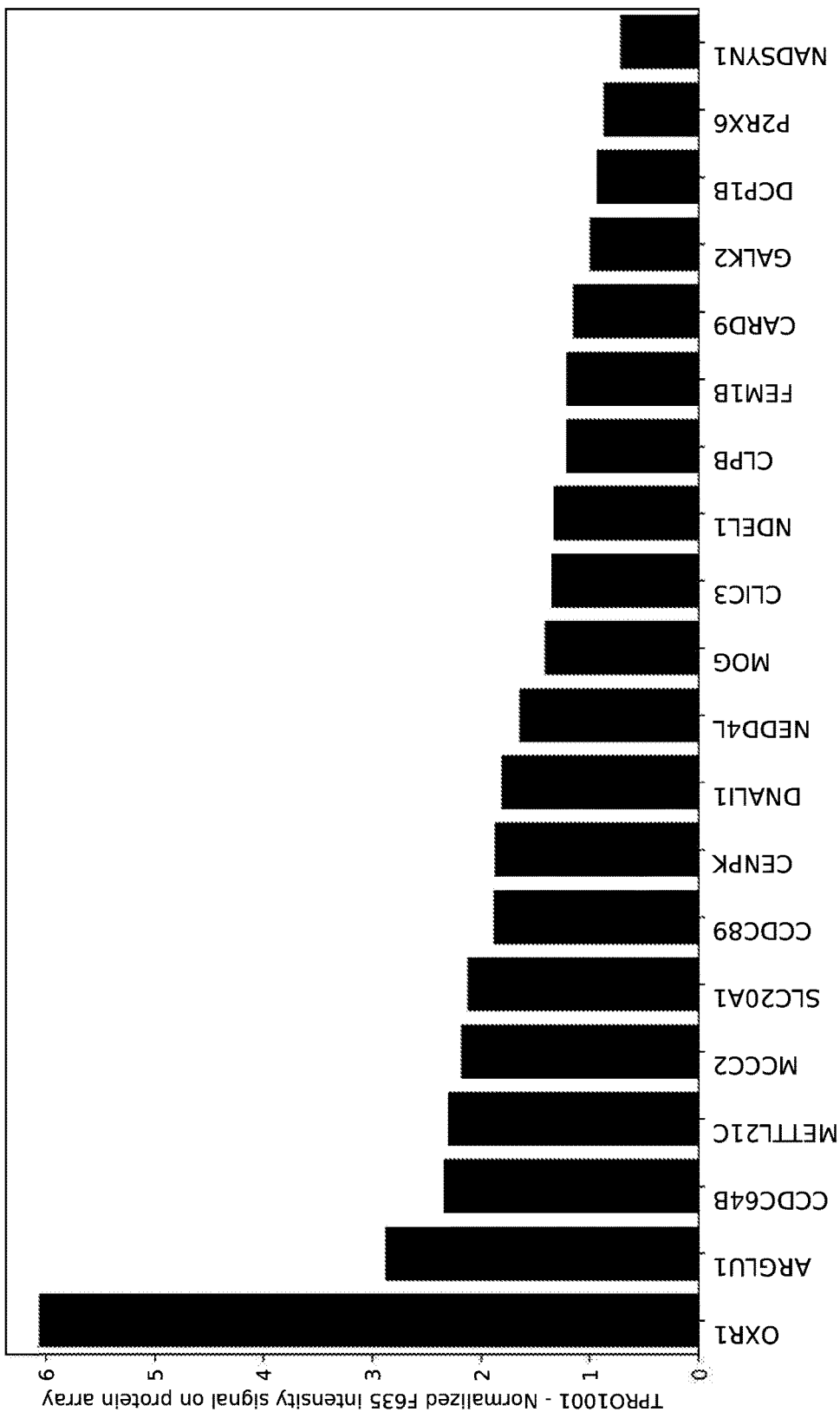

FIG. 132 is protein array data showing specific binding of oxidation resistance 1, transcript variant 1 by TPRO1001 antibody.

Figure 133:
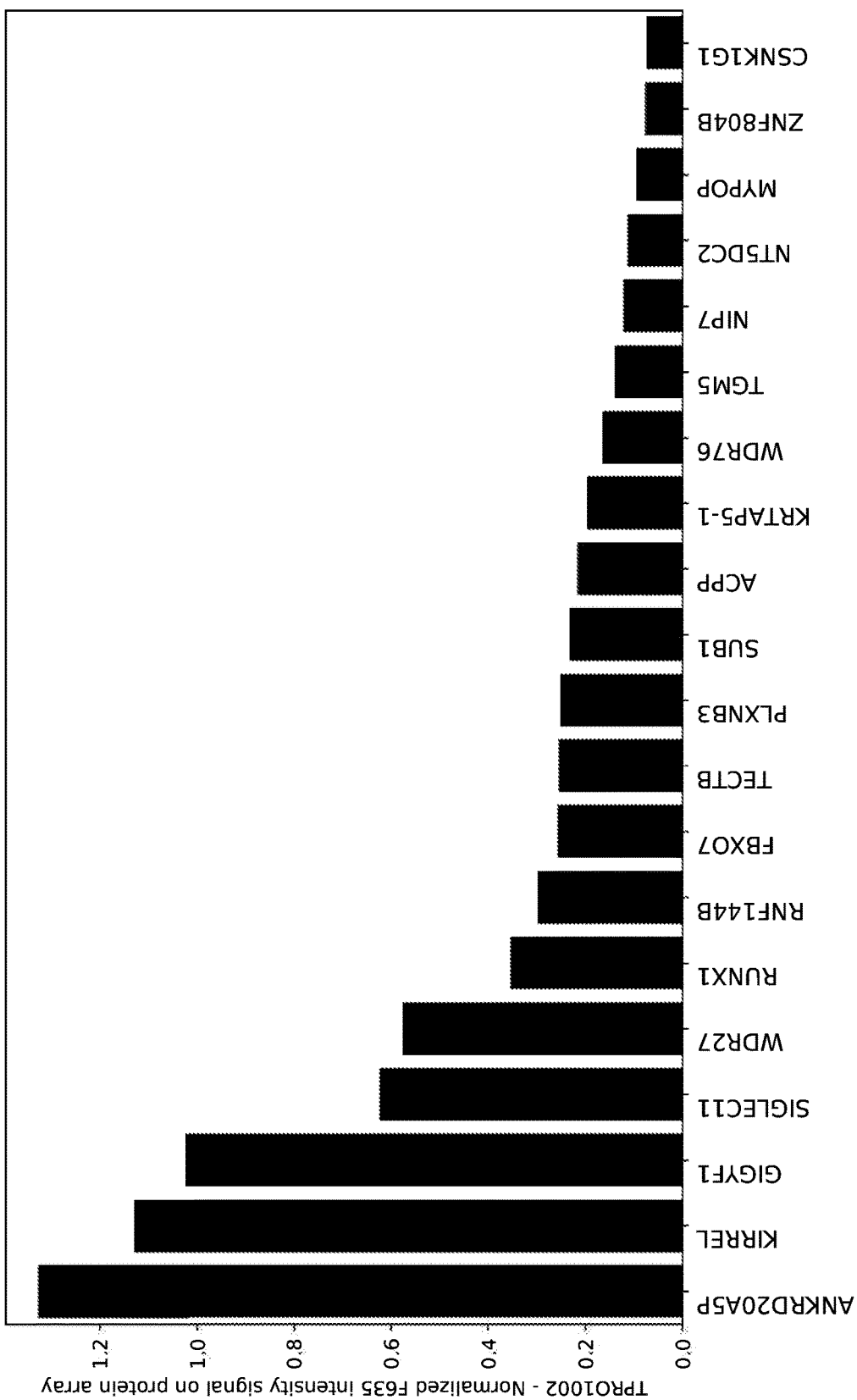

FIG. 133 is protein array data showing specific binding of Ankyrin repeat domain 20 family member a5, pseudogene, Kirre like nephrin family adhesion molecule 1, and GRB10 interacting GYF protein 1, transcript variant X10 by TPRO1002 antibody.

Figure 134:
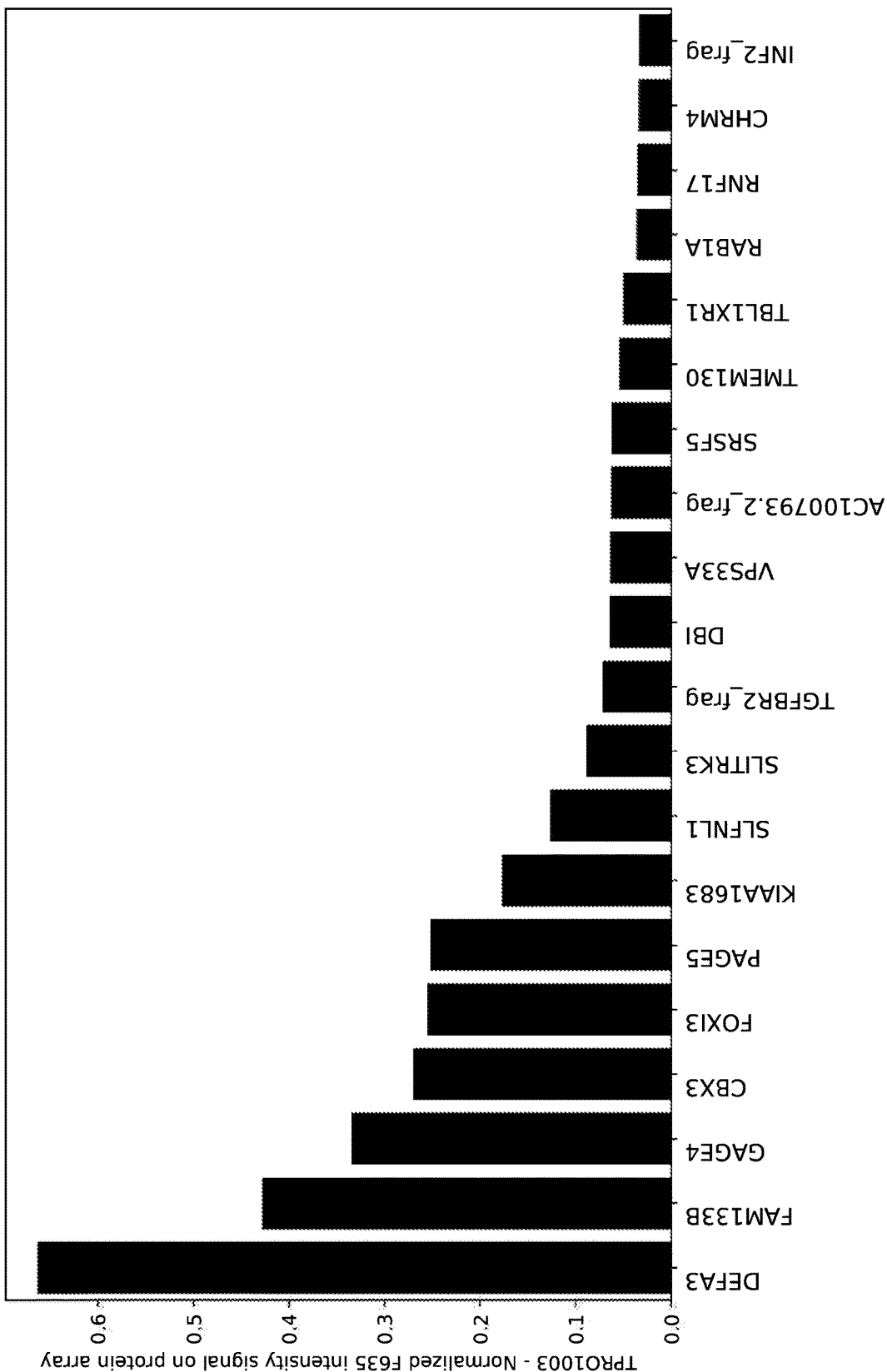

FIG. 134 is protein array data showing specific binding of defensin alpha 3 by TPRO1003 antibody.

Figure 135:
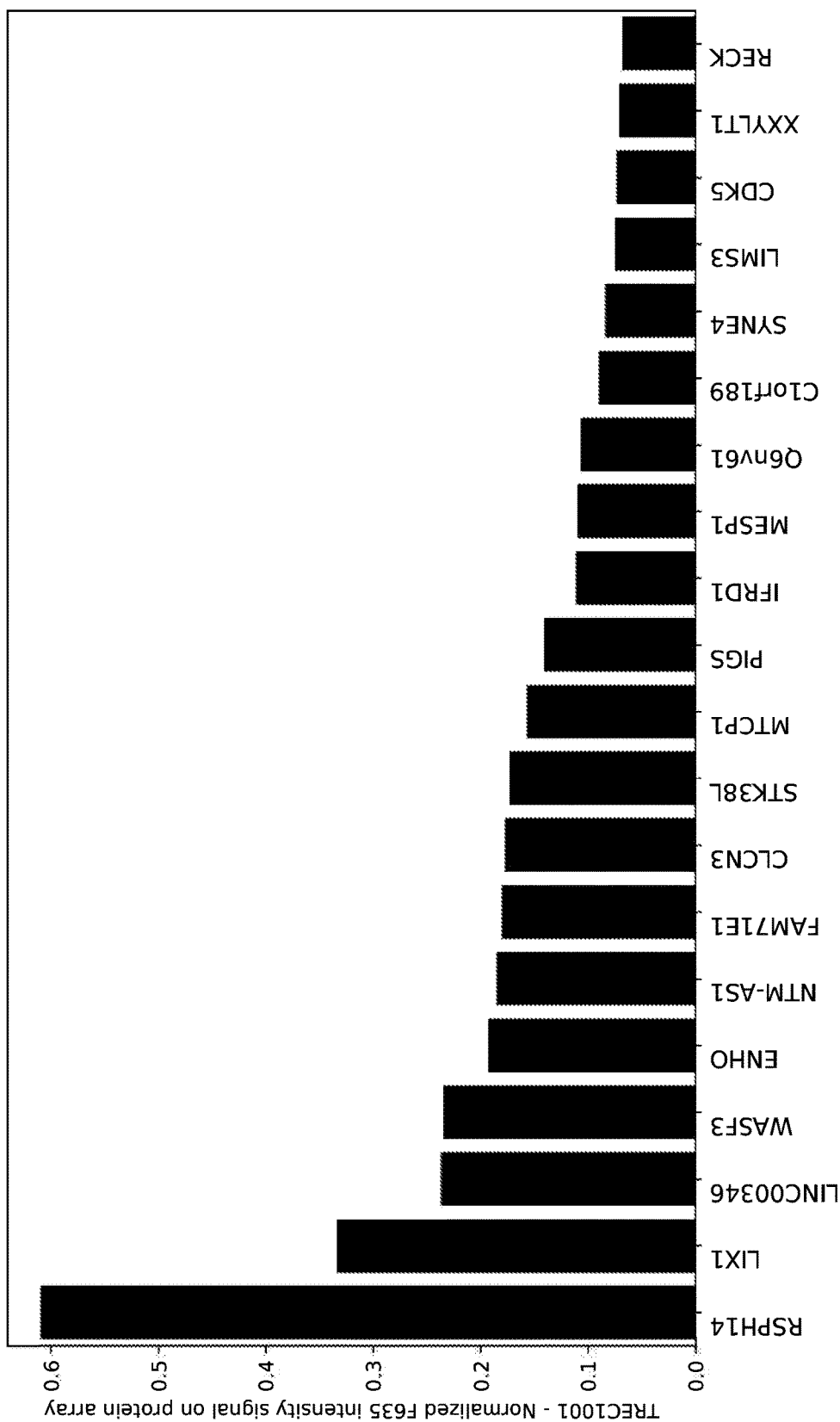

FIG. 135 is protein array data showing specific binding of radial spoke head 14 homolog by TREC1001 antibody.

Figure 136:
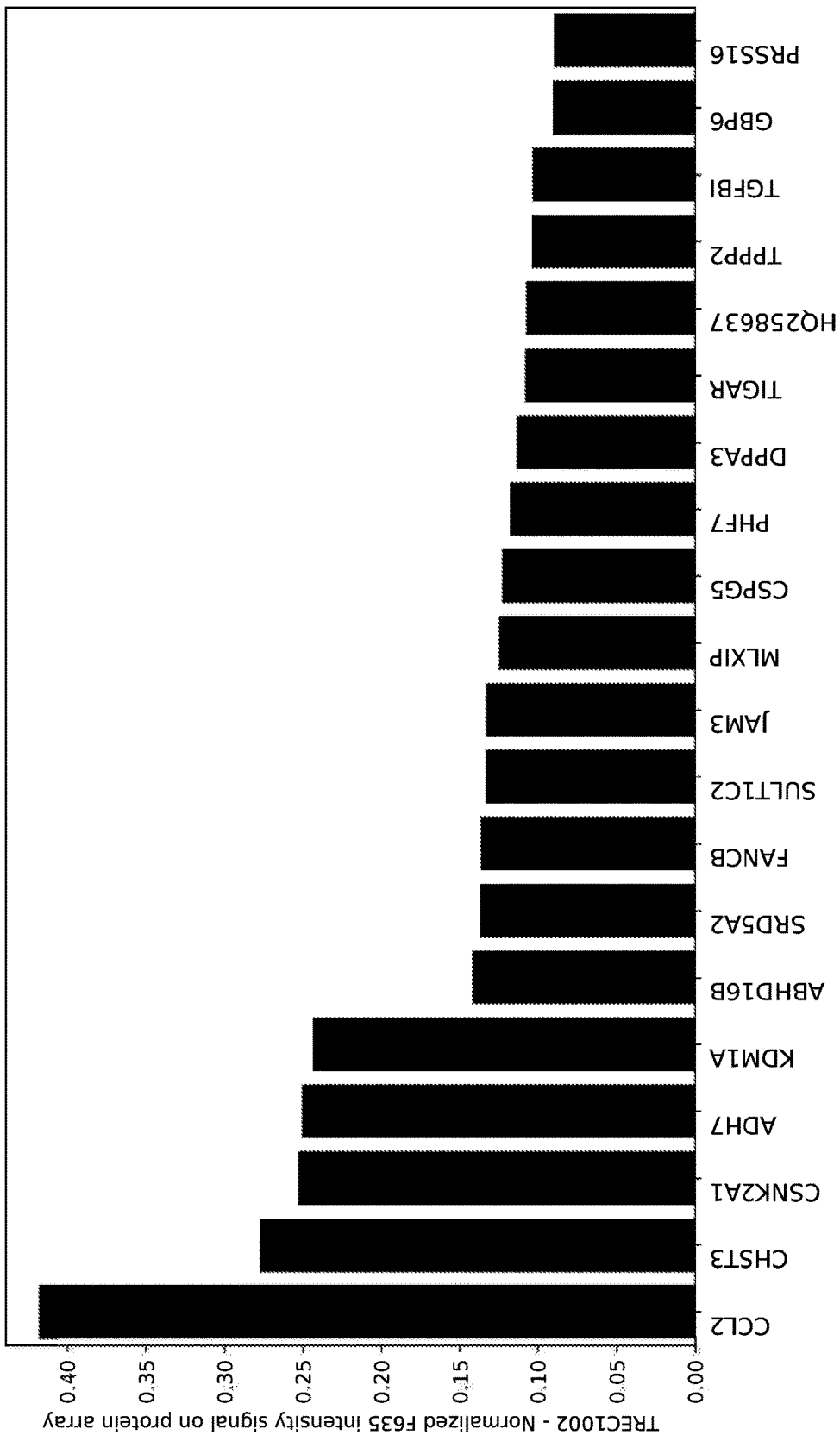

FIG. 136 is protein array data showing specific binding of C-C motif chemokine ligand 2 by TREC1002 antibody.

Figure 137:
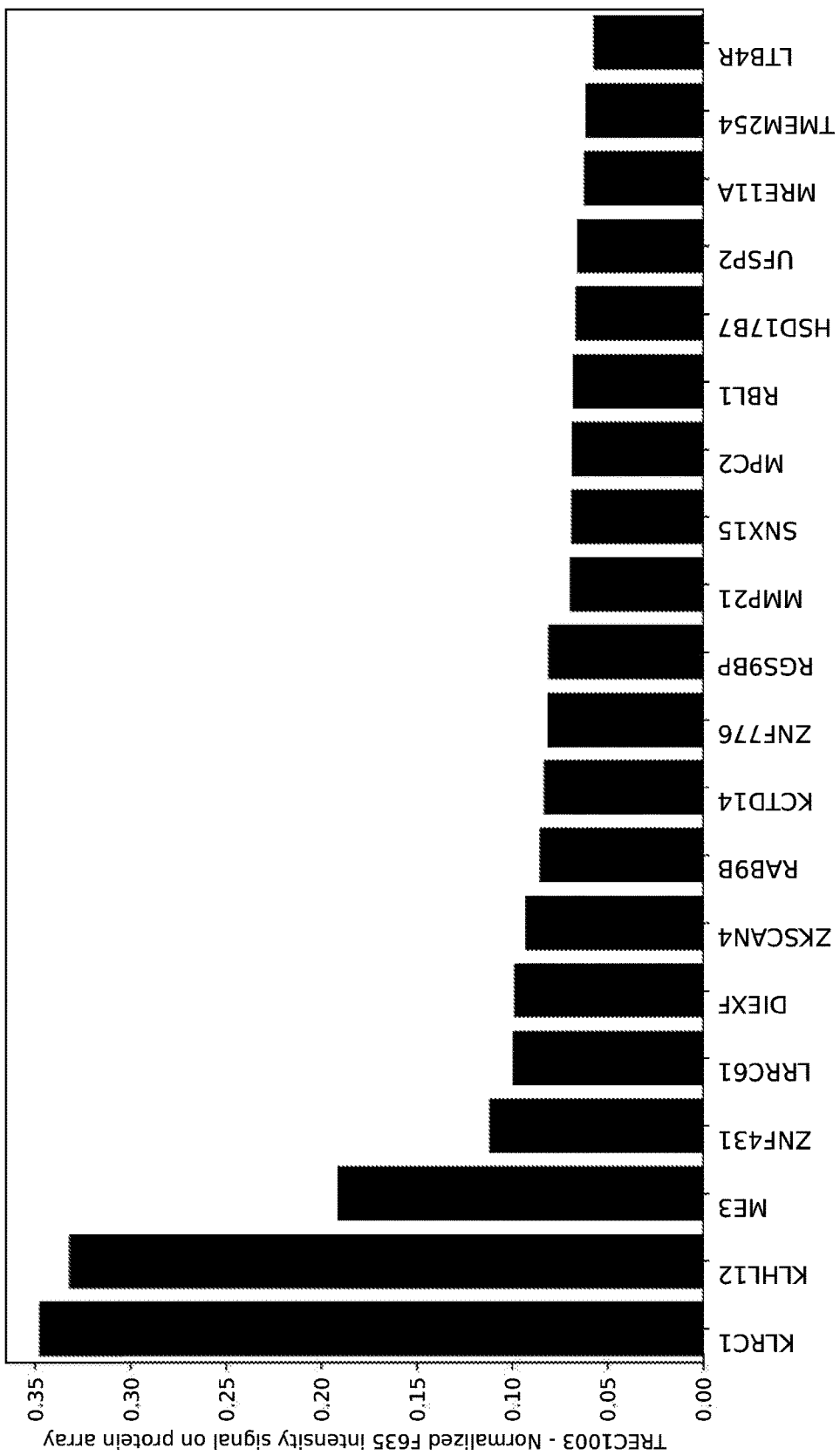

FIG. 137 is protein array data showing specific binding of killer cell lectin like receptor C1, transcript variant 3, and kelch like family member 12, transcript variant 2 by TREC1003 antibody.

Figure 138:
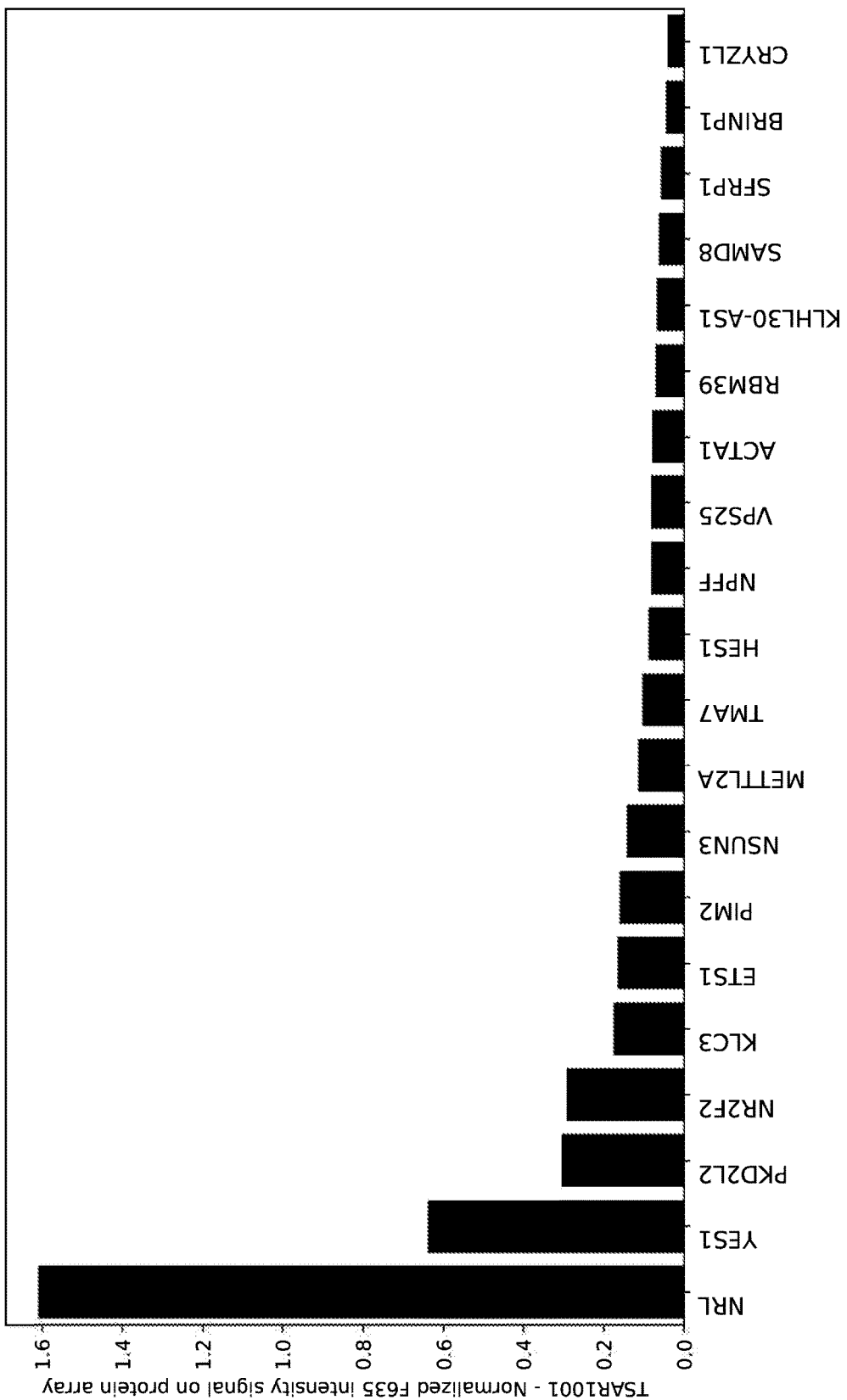

FIG. 138 is protein array data showing specific binding of neural retina leucine zipper, transcript variant X4 by TSAR1001 antibody.

Figure 139:
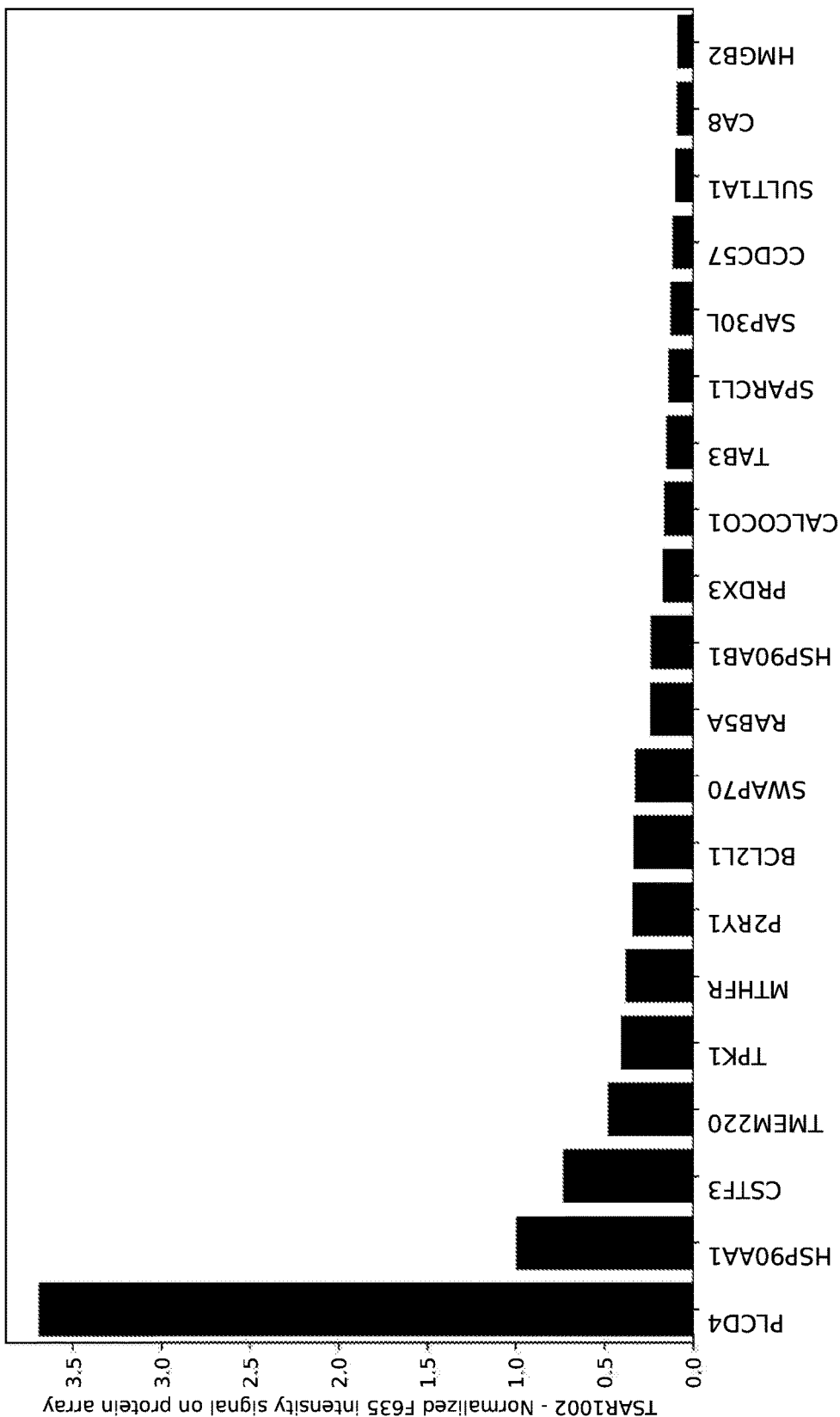

FIG. 139 is protein array data showing specific binding of phospholipase C delta 4 by TSAR1002 antibody.

Figure 140:
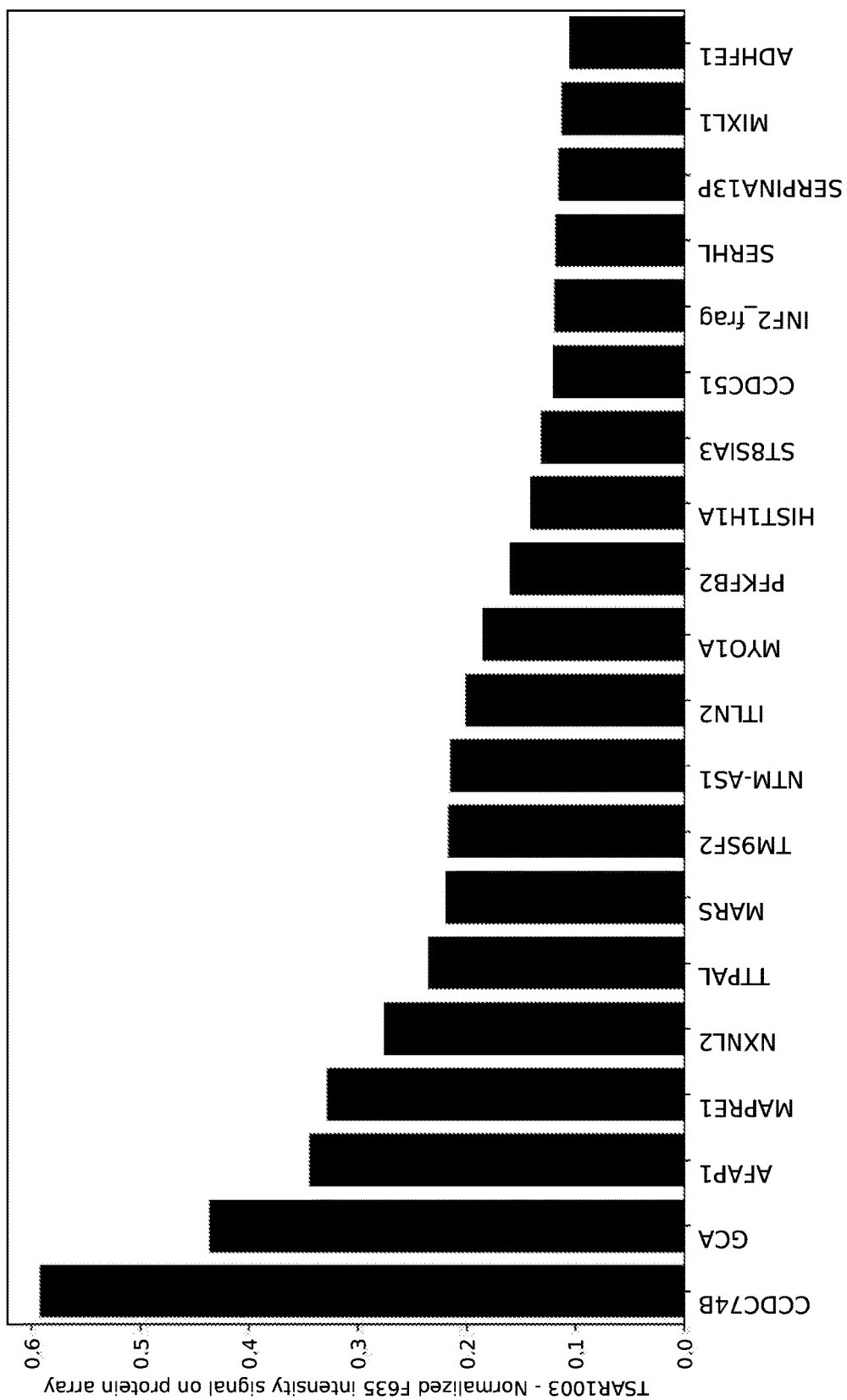

FIG. 140 is protein array data showing specific binding of coiled-coil domain containing 74B, transcript variant 2 by TSAR1003 antibody.

Figure 141:
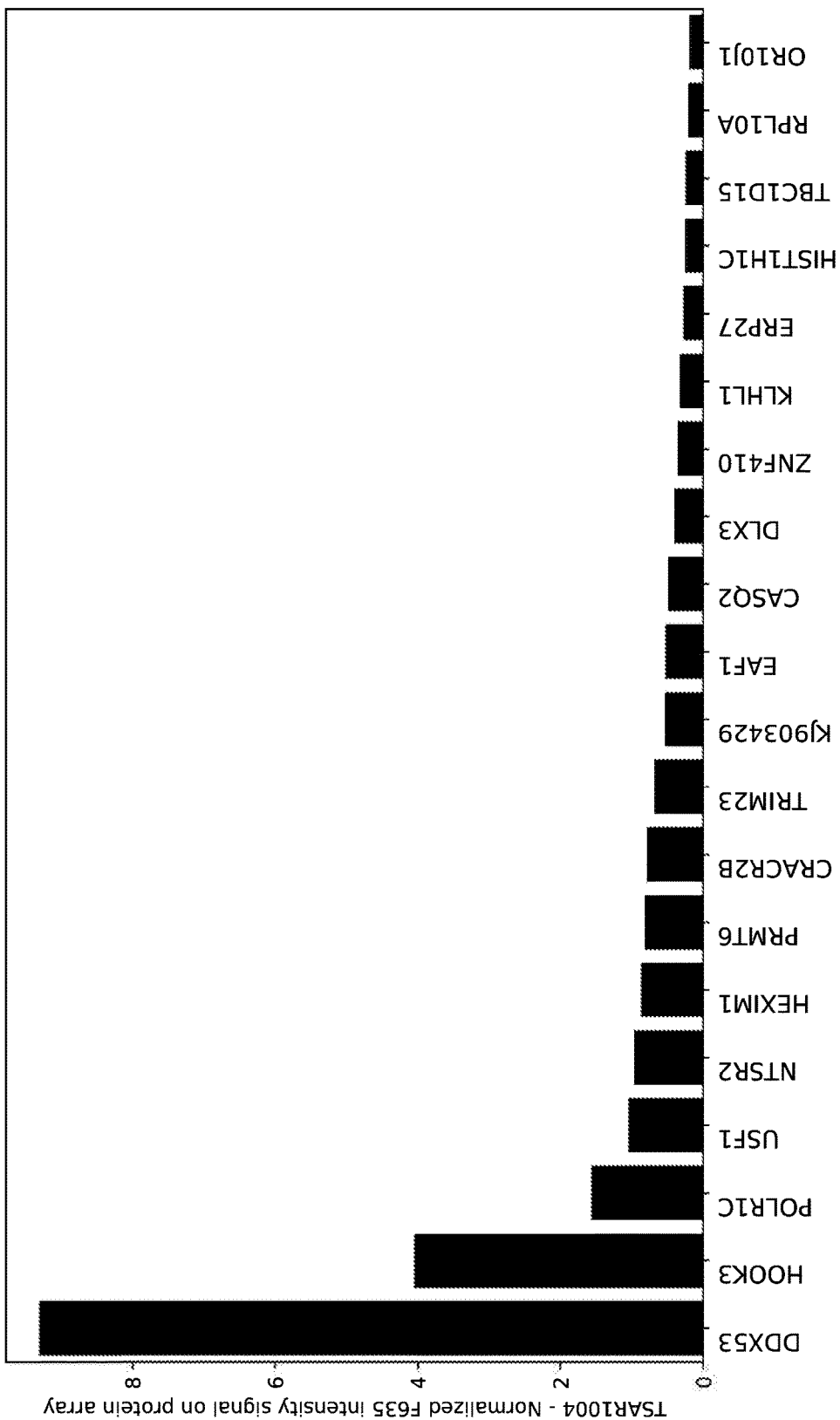

FIG. 141 is protein array data showing specific binding of DEAD-box helicase 53 by TSAR1004 antibody.

Figure 142:
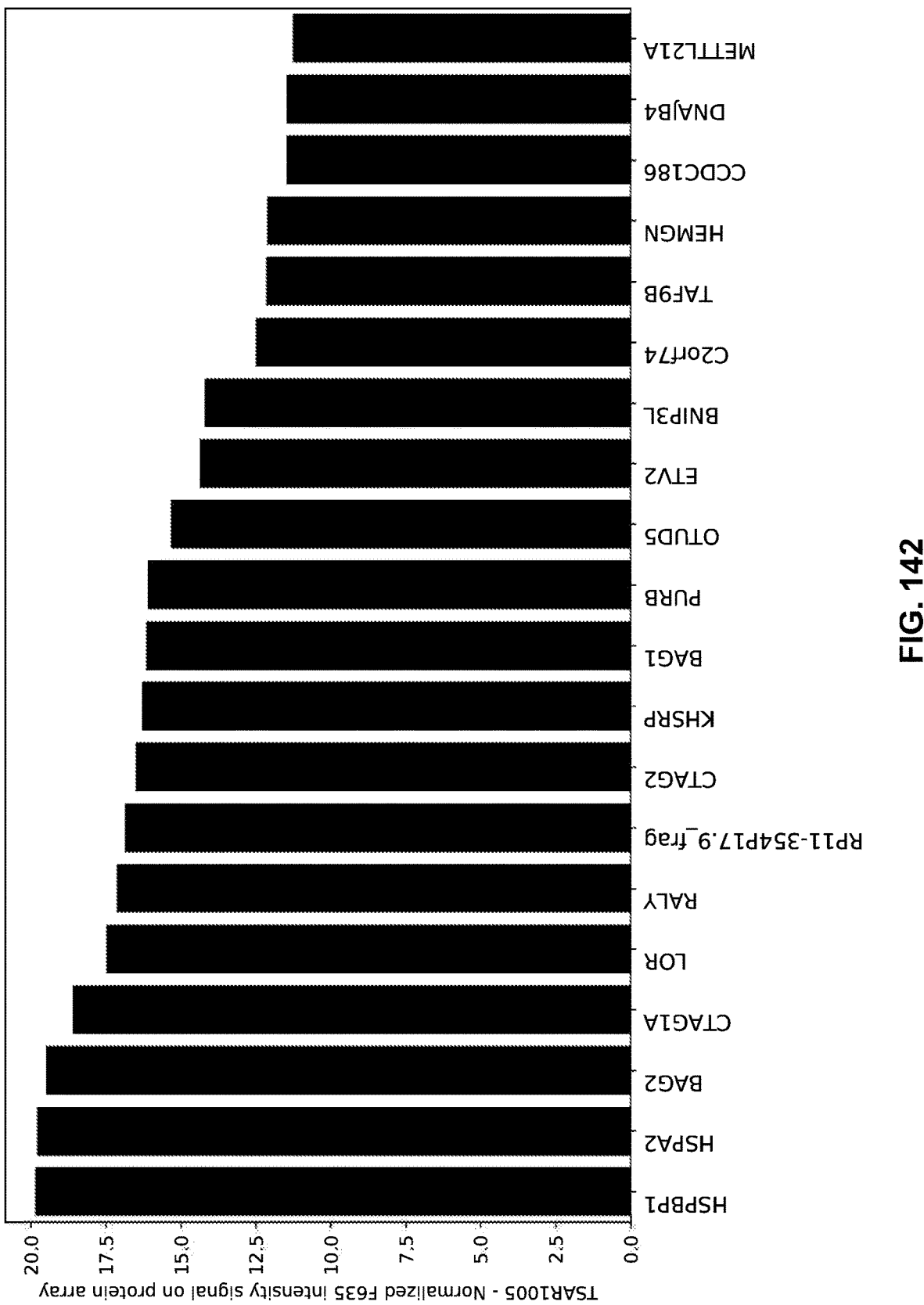

FIG. 142 is protein array data showing specific binding of HSPA (Hsp70) binding protein 1, transcript variant 2, heat shock protein family A (Hsp70) member 2, and BCL2 associated athanogene 2 by TSAR1005 antibody.

Figure 143A:
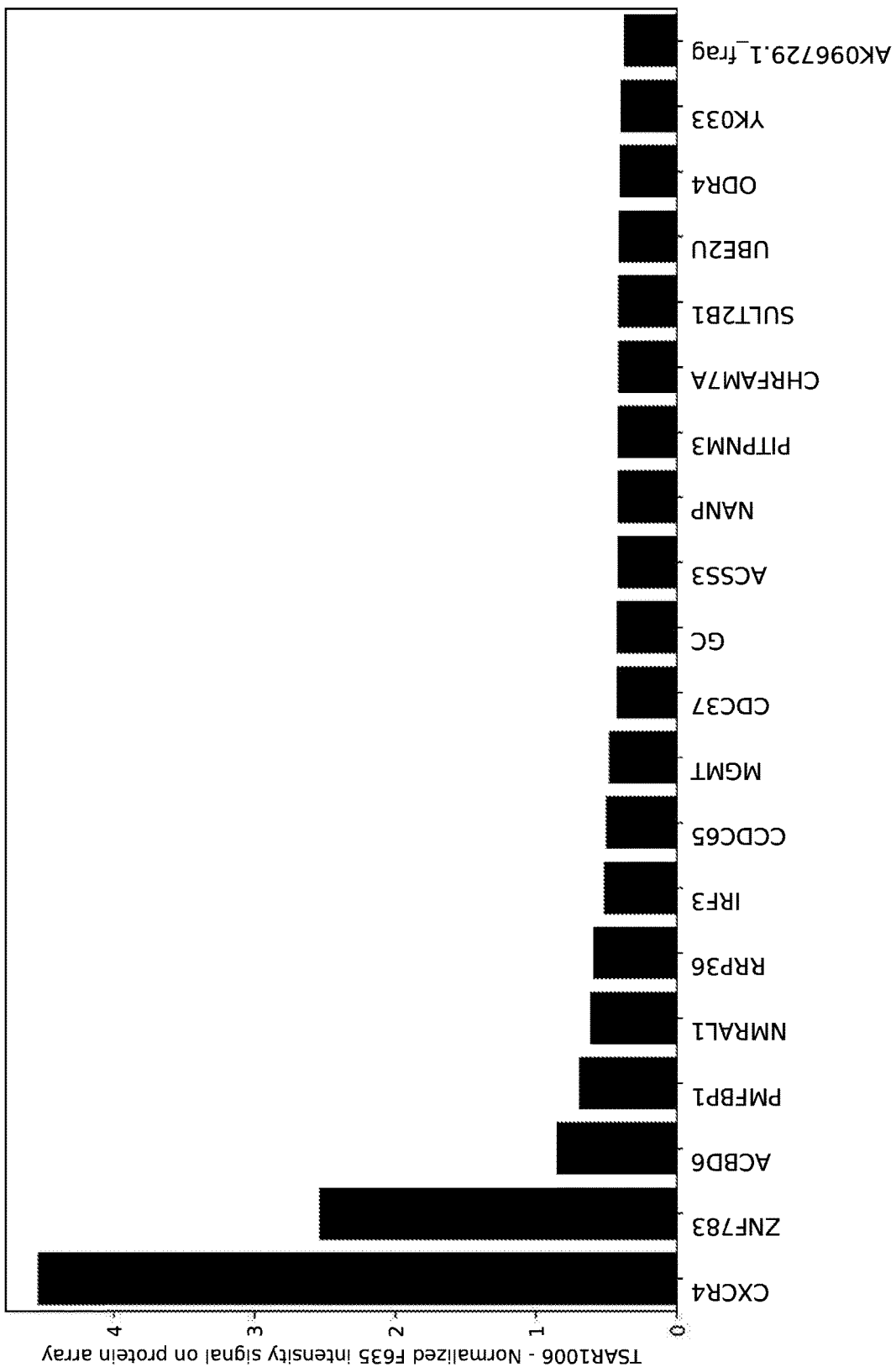
Figure 143B:
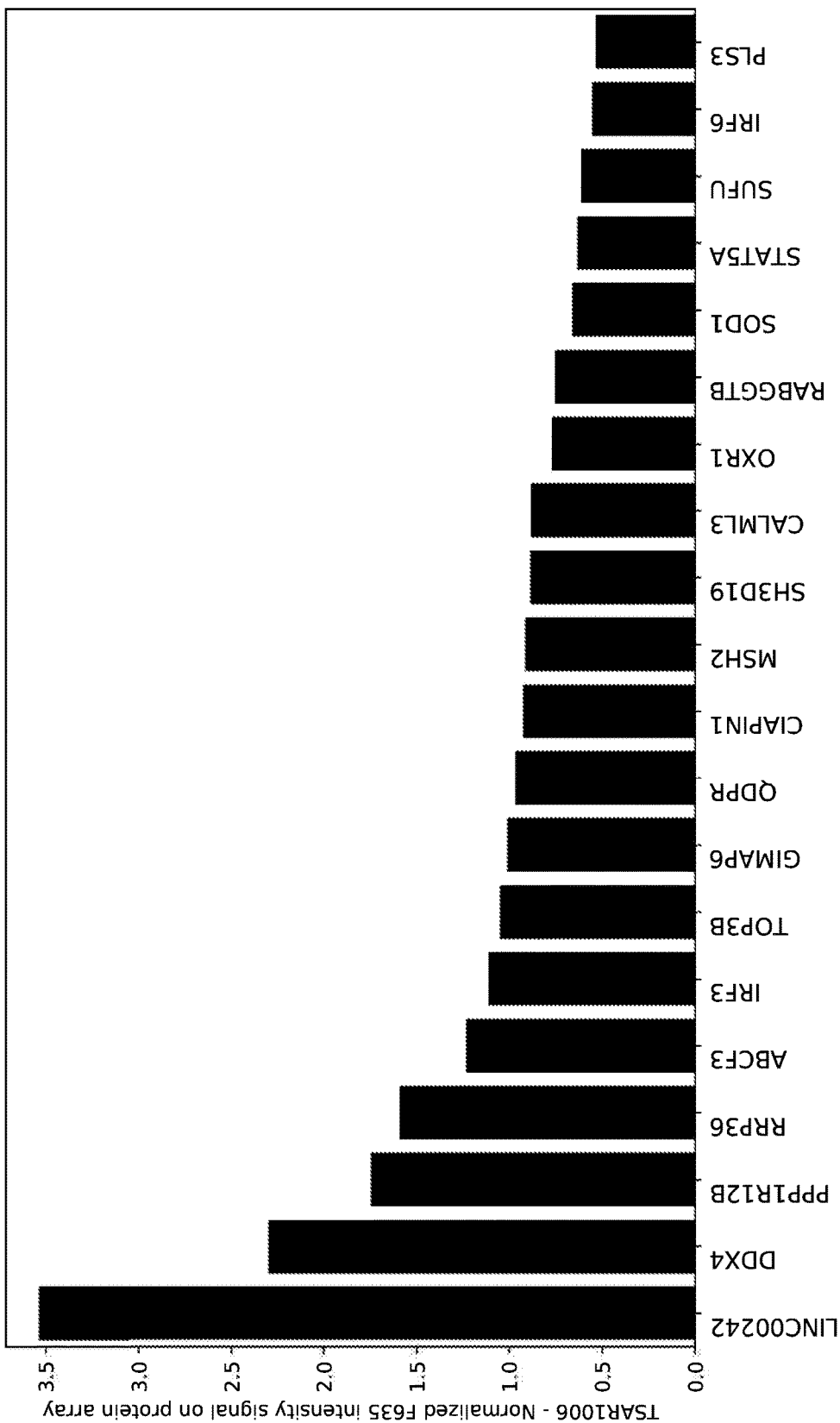

FIG. 143A is protein array data showing specific binding of C-X-C motif chemokine receptor 4, transcript variant 2 by TSAR1006 antibody. FIG. 143B is protein array data showing specific binding of Long intergenic non-protein coding rna 242 by TSAR1006 antibody.

Figure 144:
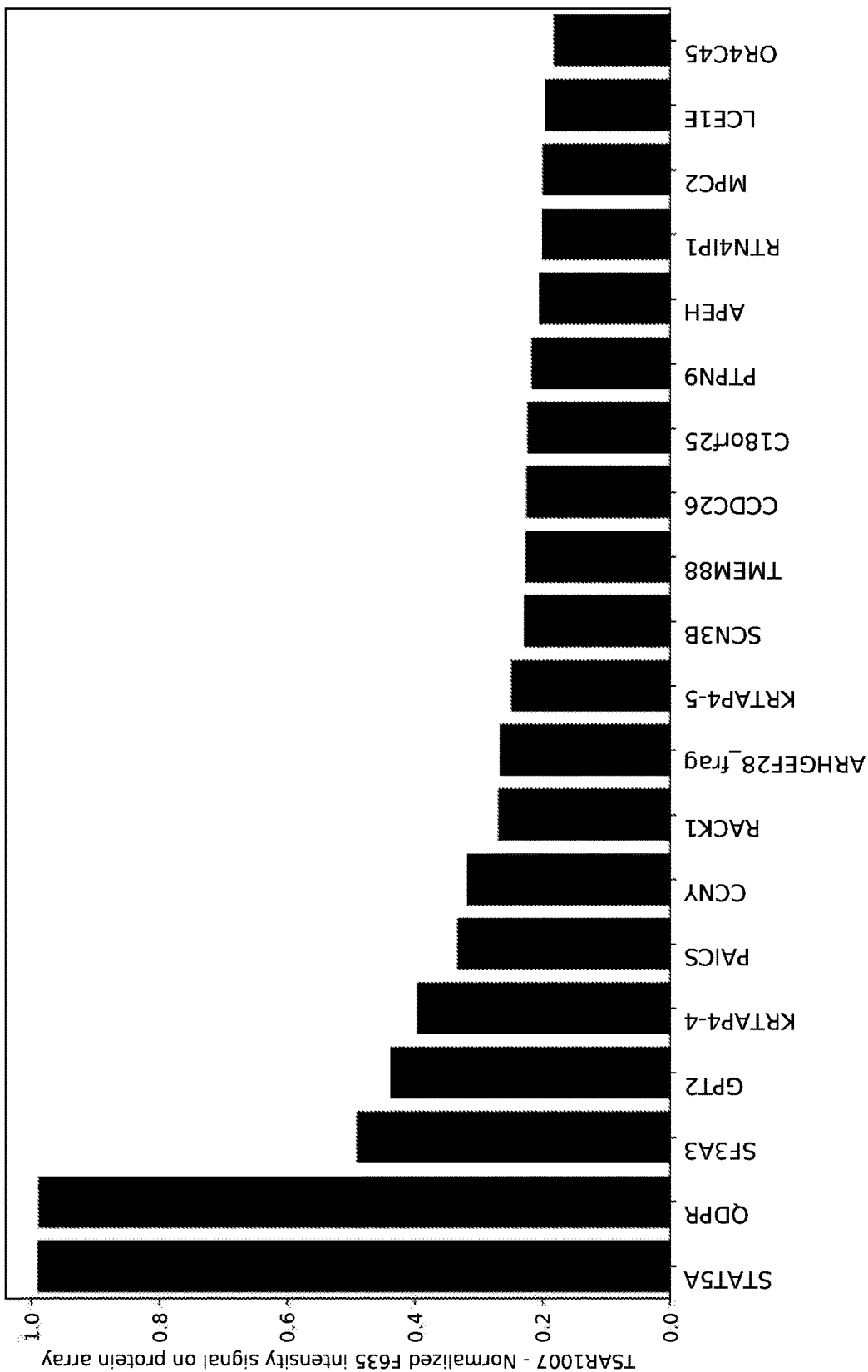

FIG. 144 is protein array data showing specific binding of signal transducer and activator of transcription 5A, transcript variant 2, and quinoid dihydropteridine reductase, transcript variant 1 by TSAR1007 antibody.

Figure 145:
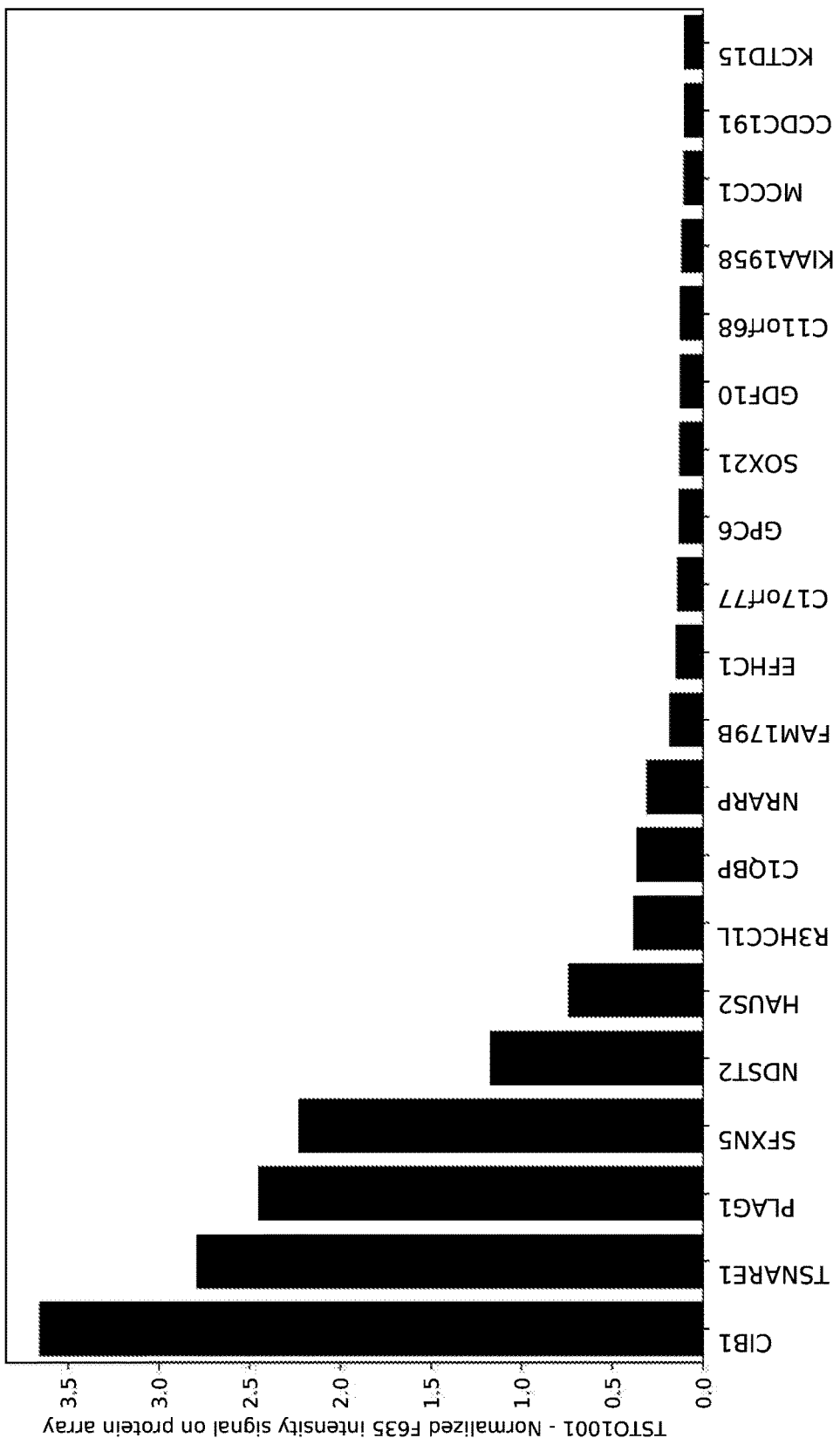

FIG. 145 is protein array data showing specific binding of calcium and integrin binding 1, transcript variant b, and t-SNARE domain containing 1, transcript variant 1 by TSTO1001 antibody.

Figure 146:
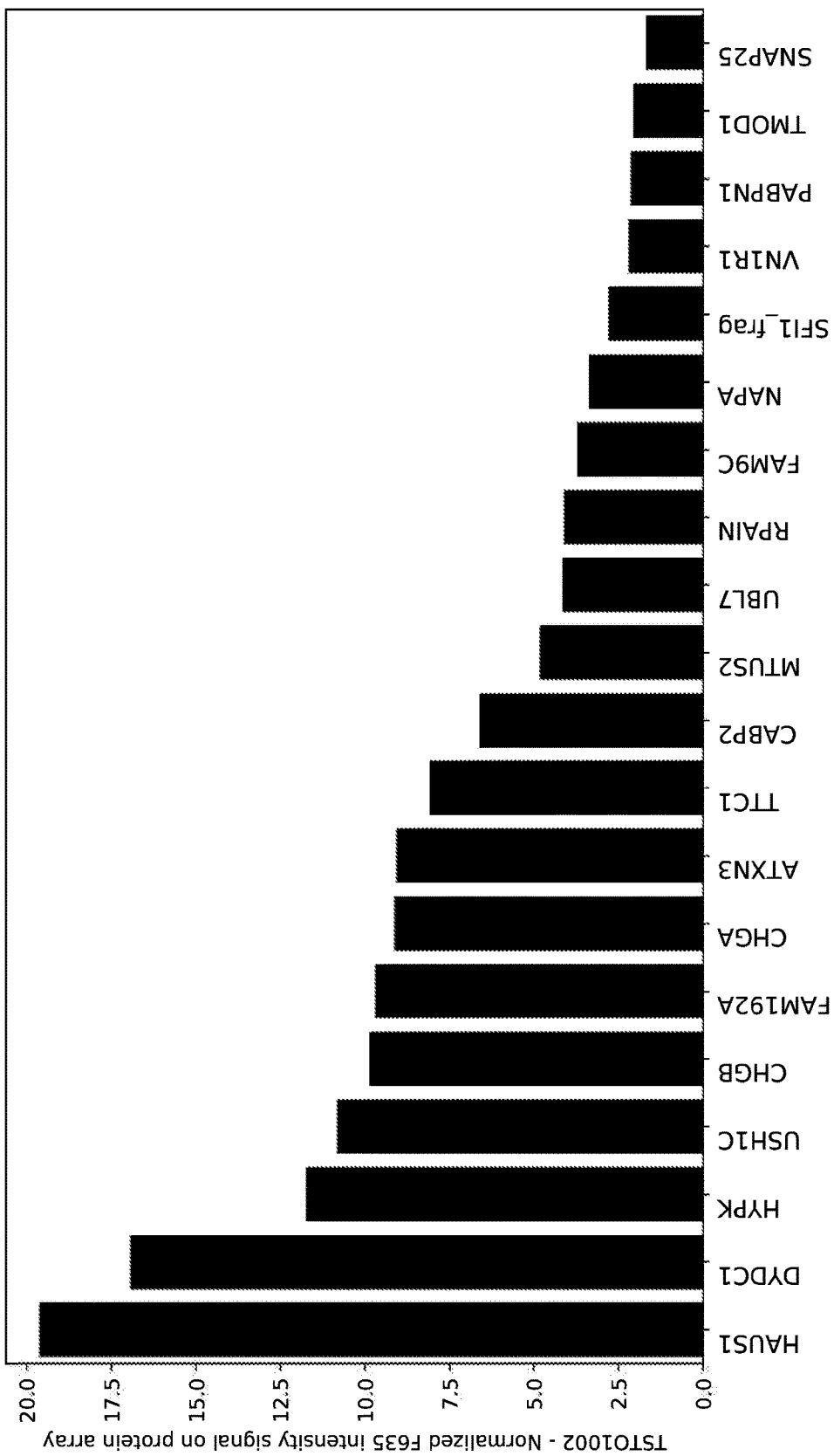

FIG. 146 is protein array data showing specific binding of HAUS augmin like complex subunit 1, transcript variant 1, and DPY30 domain containing 1, transcript variant X4 by TSTO1002 antibody.

Figure 147:
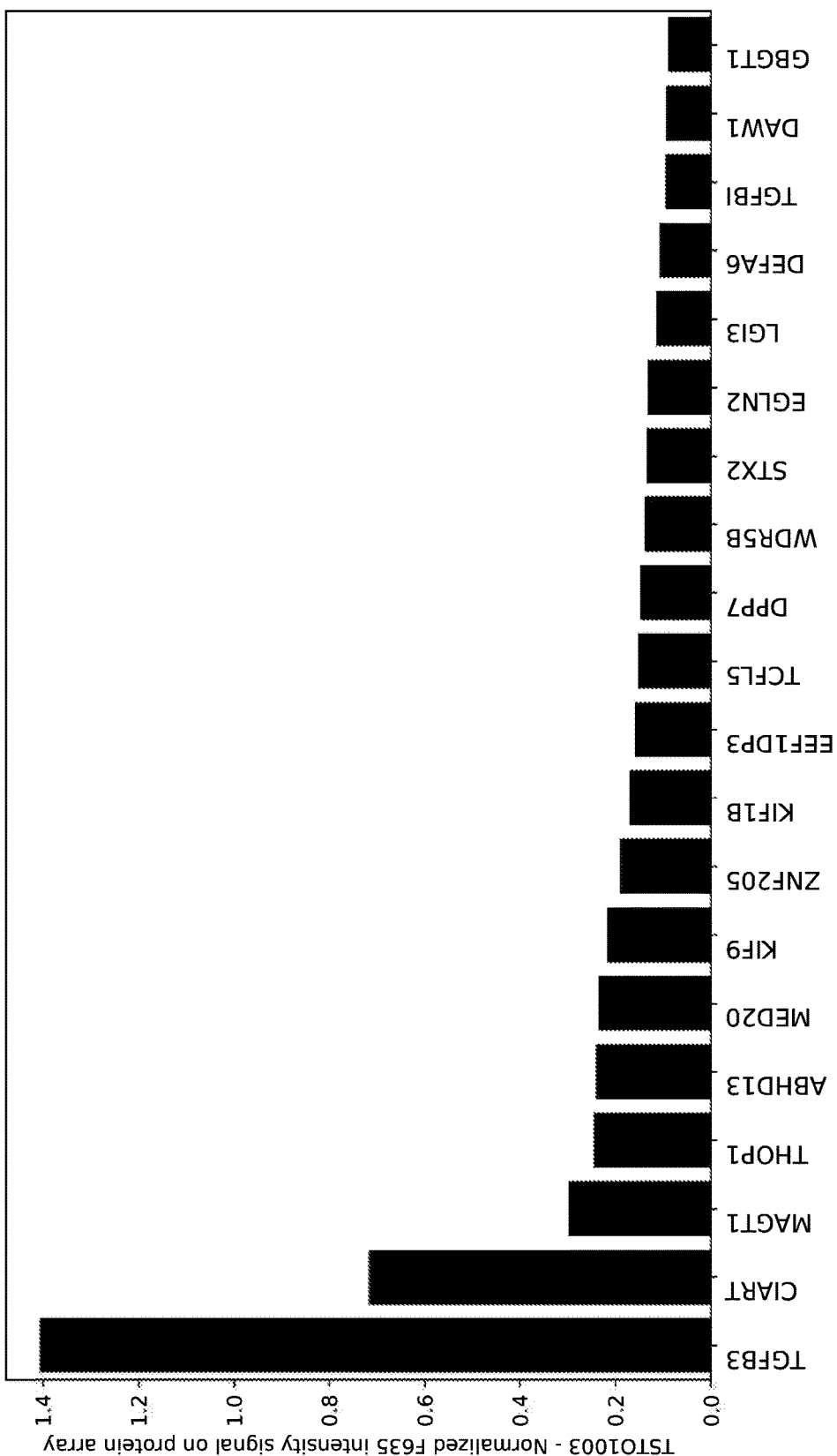

FIG. 147 is protein array data showing specific binding of Transforming growth factor beta 3 by TSTO1003 antibody.

Figure 148:
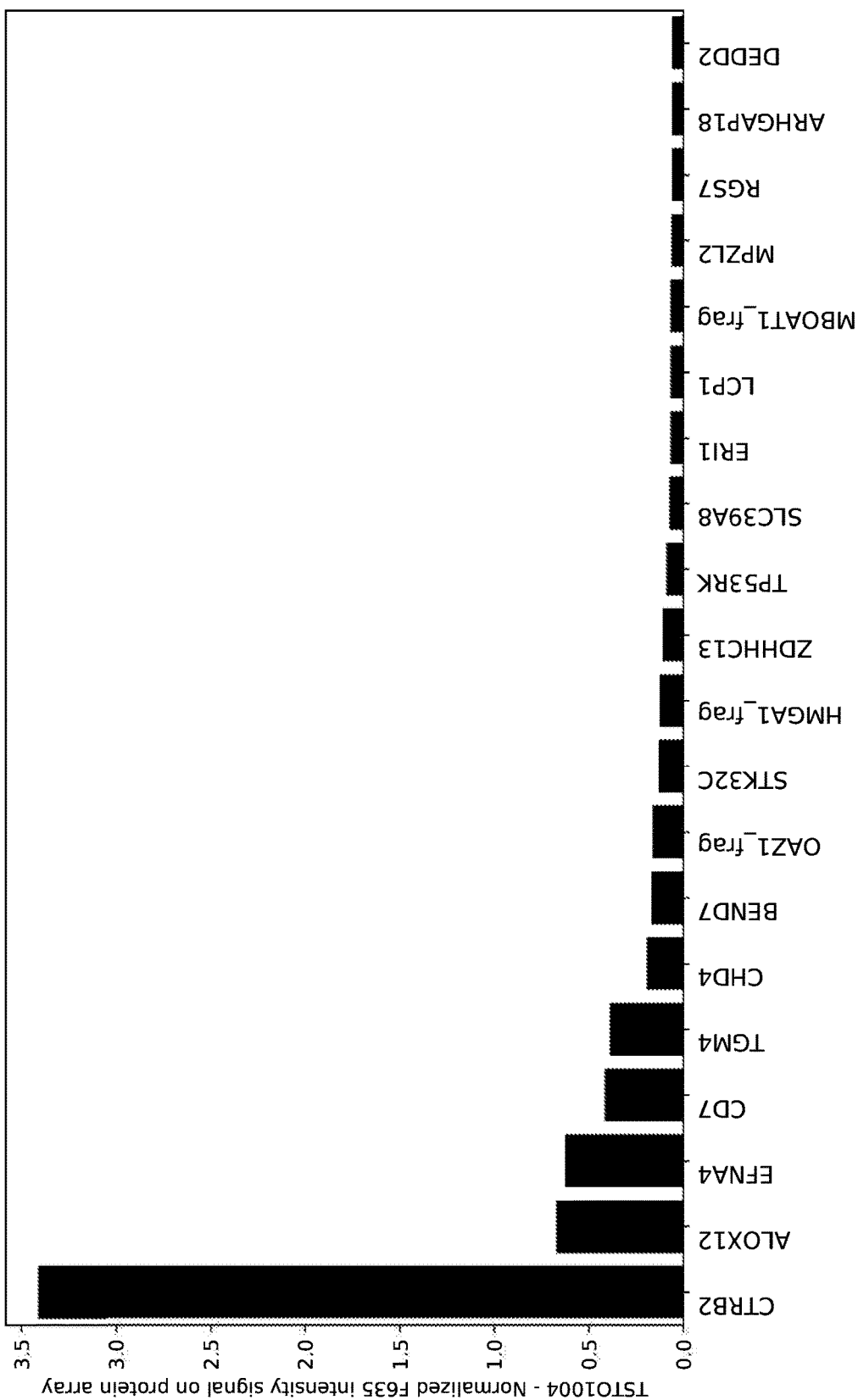

FIG. 148 is protein array data showing specific binding of chymotrypsinogen B2 by TSTO1004 antibody.

Figure 149:
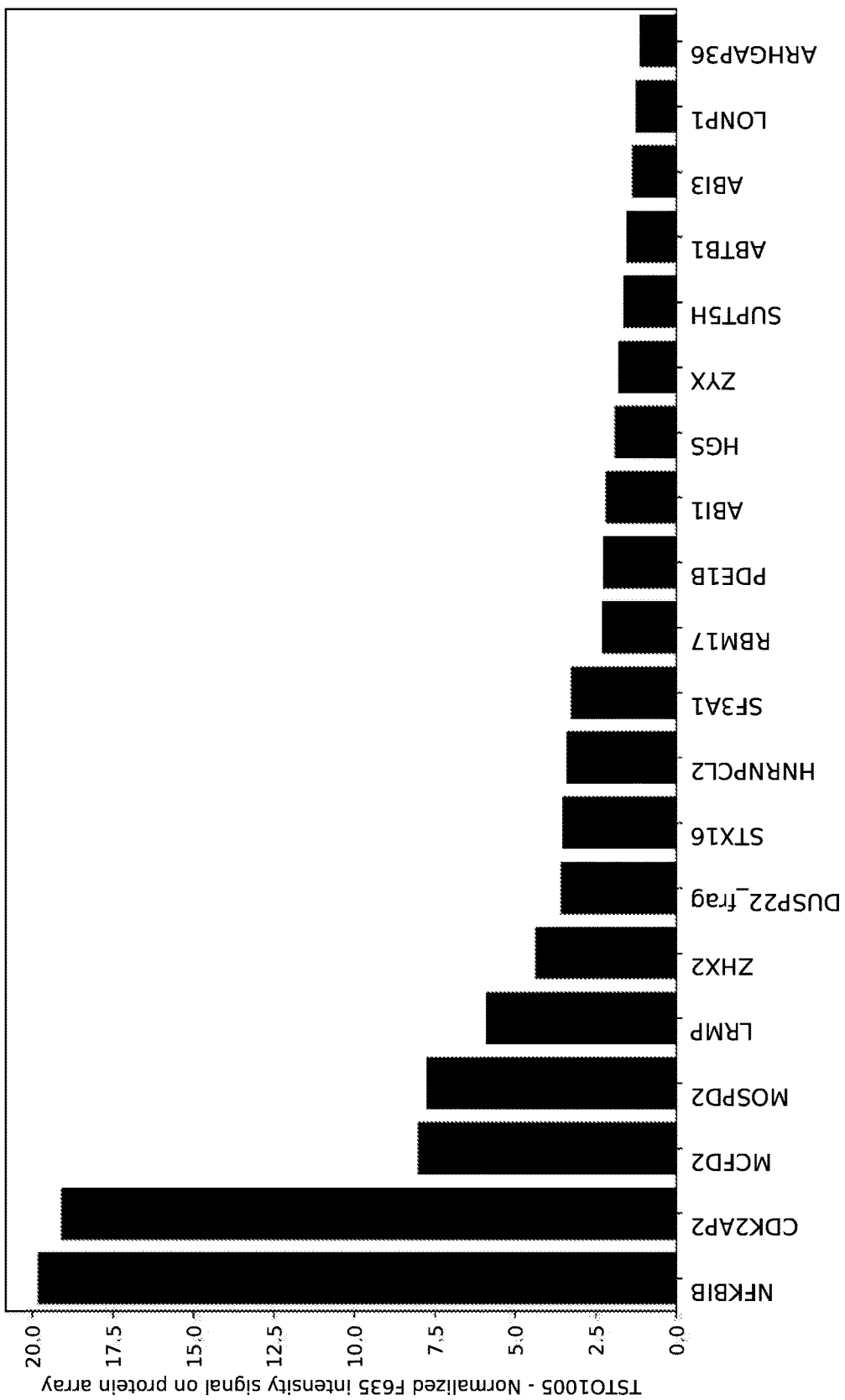

FIG. 149 is protein array data showing specific binding of NFKB inhibitor beta, transcript variant 1, and cyclin dependent kinase 2 associated protein 2, transcript variant 1 by TSTO1005 antibody.

Figure 150:
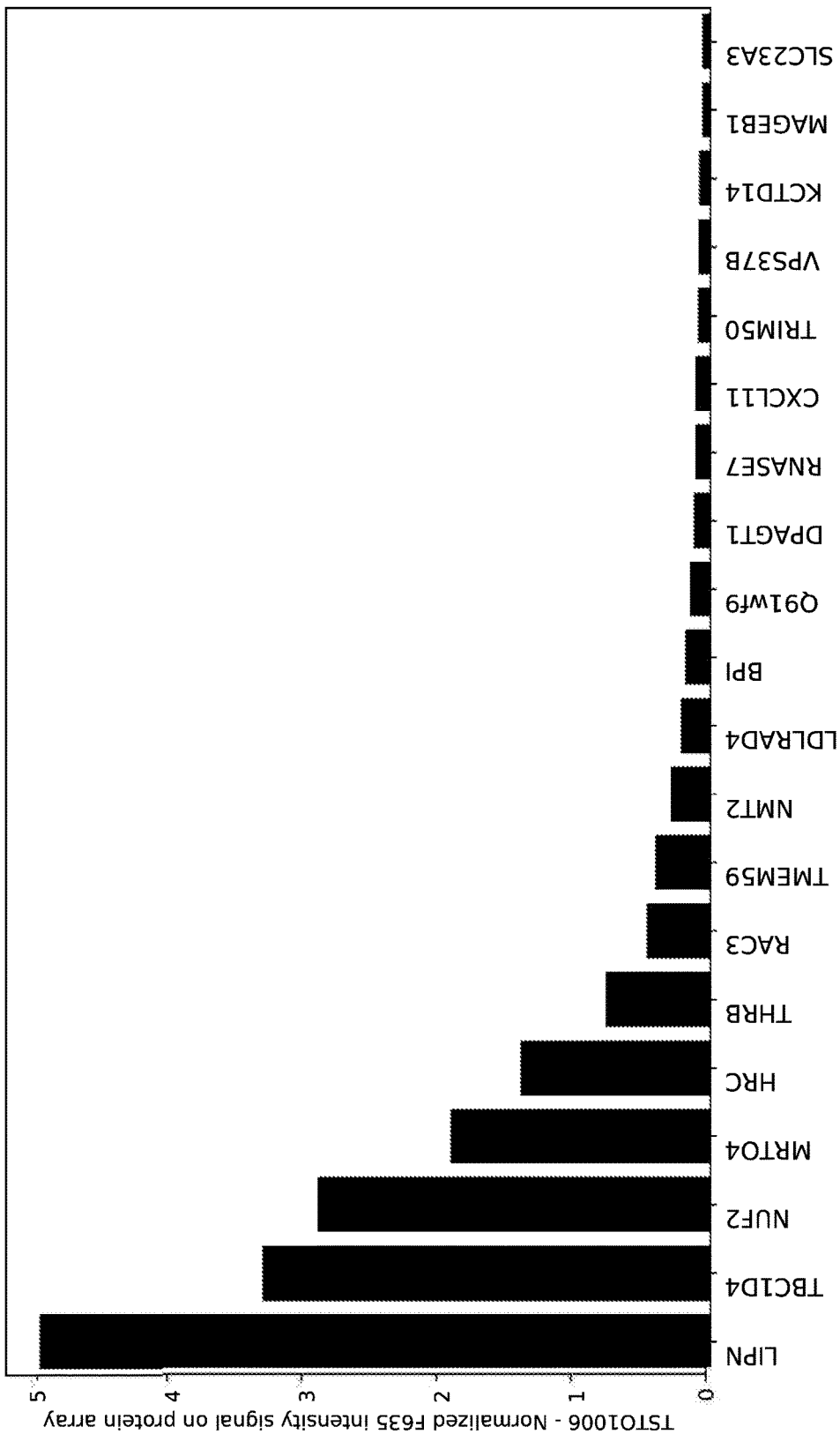

FIG. 150 is protein array data showing specific binding of lipase family member N, transcript variant X1 by TSTO1006 antibody.

Figure 151:
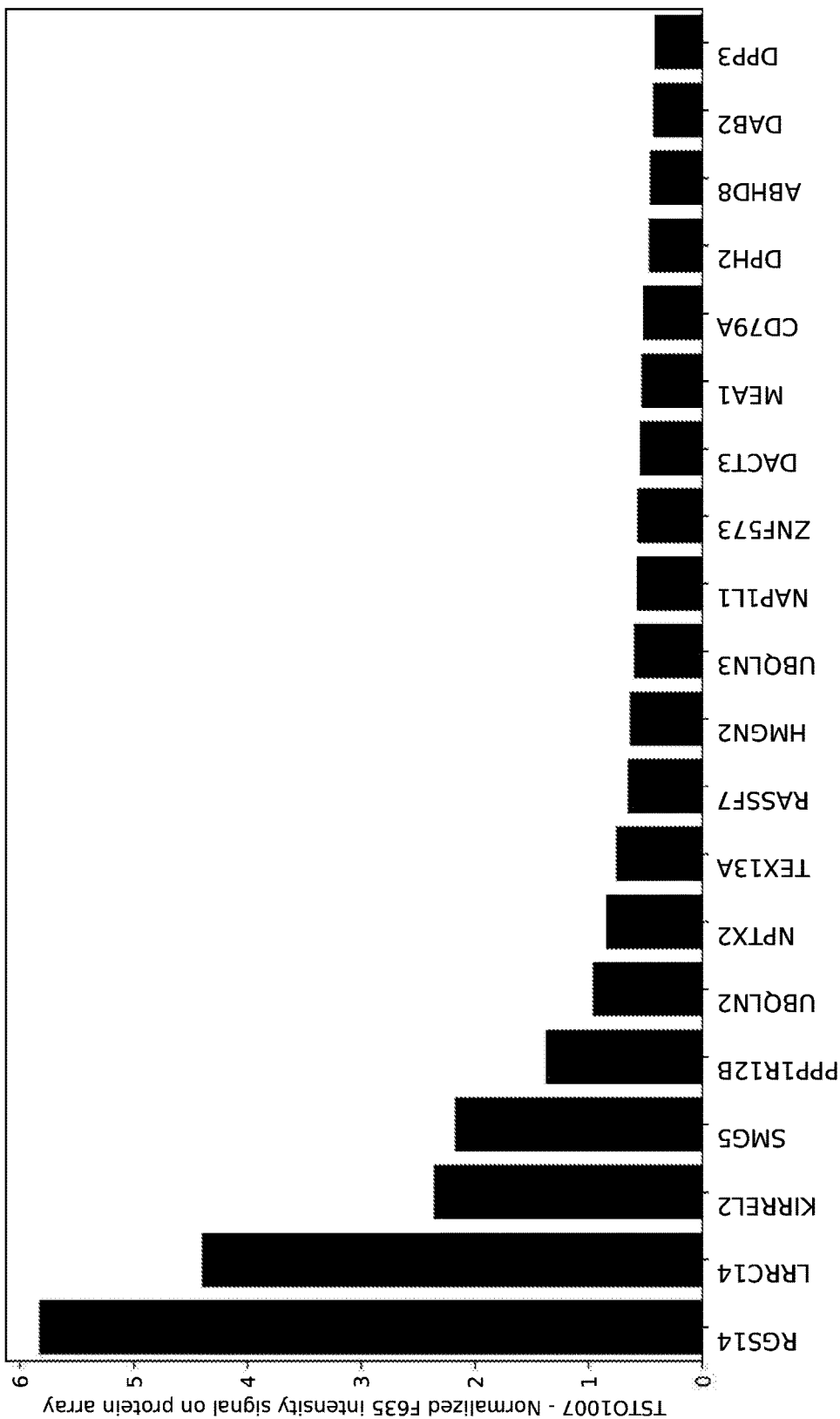

FIG. 151 is protein array data showing specific binding of regulator of G protein signaling 14, transcript variant 1, and leucine rich repeat containing 14, transcript variant 1 by TSTO1007 antibody.

Figure 152:
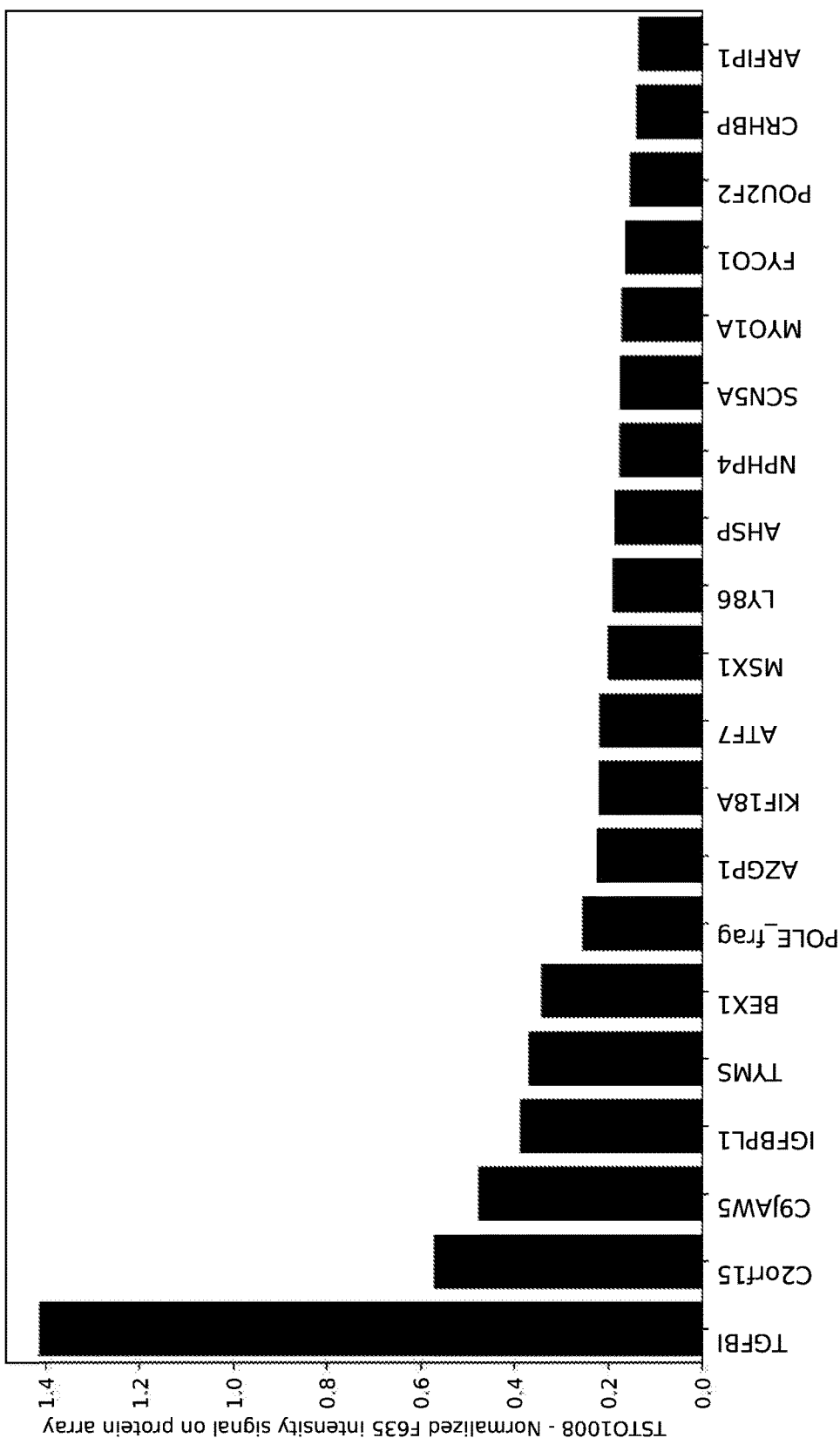

FIG. 152 is protein array data showing specific binding of transforming growth factor beta induced by TSTO1008 antibody.

Figure 153:
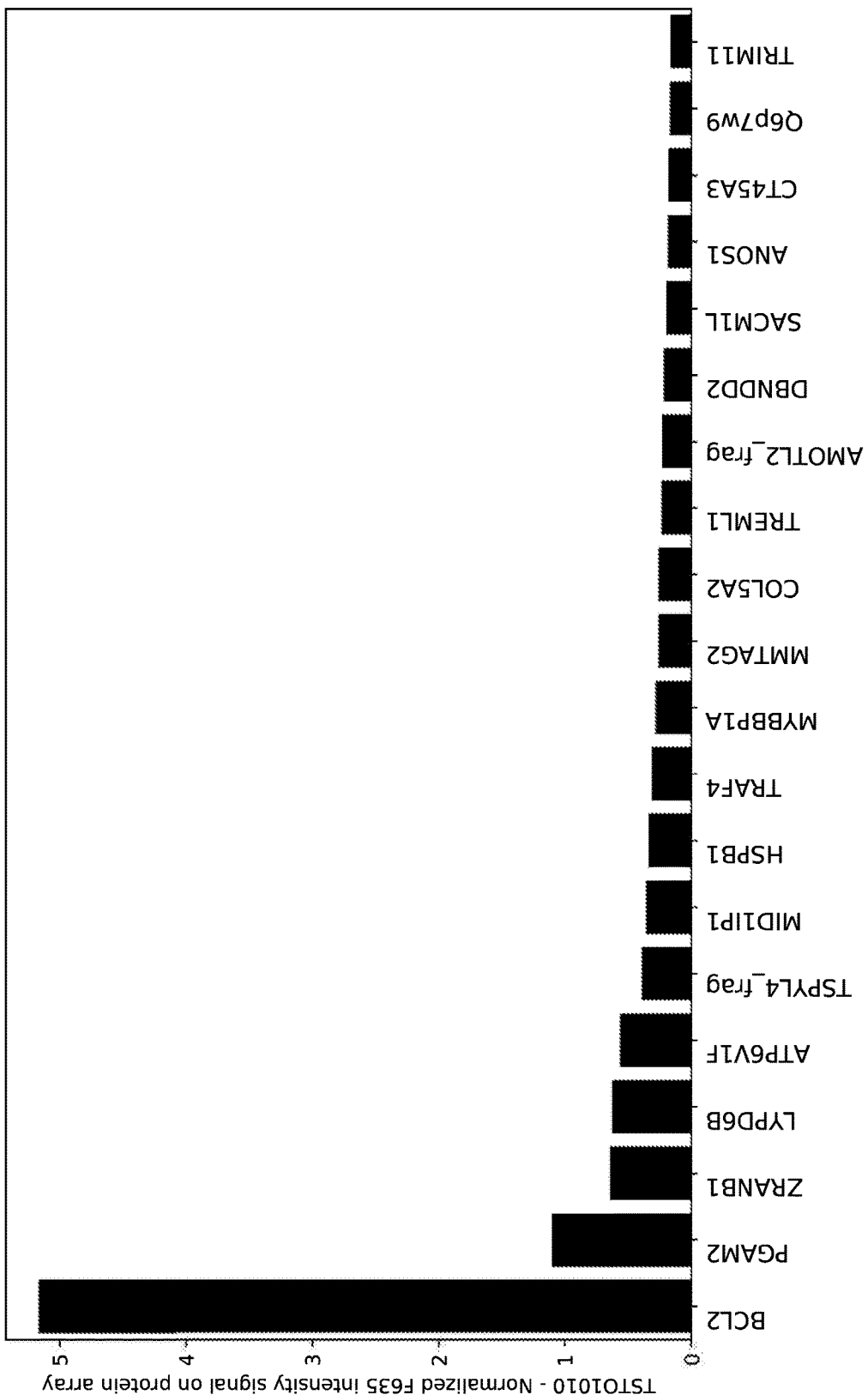

FIG. 153 is protein array data showing specific binding of BCL2 apoptosis regulator, transcript variant alpha by TSTO1010 antibody.

Figure 154:
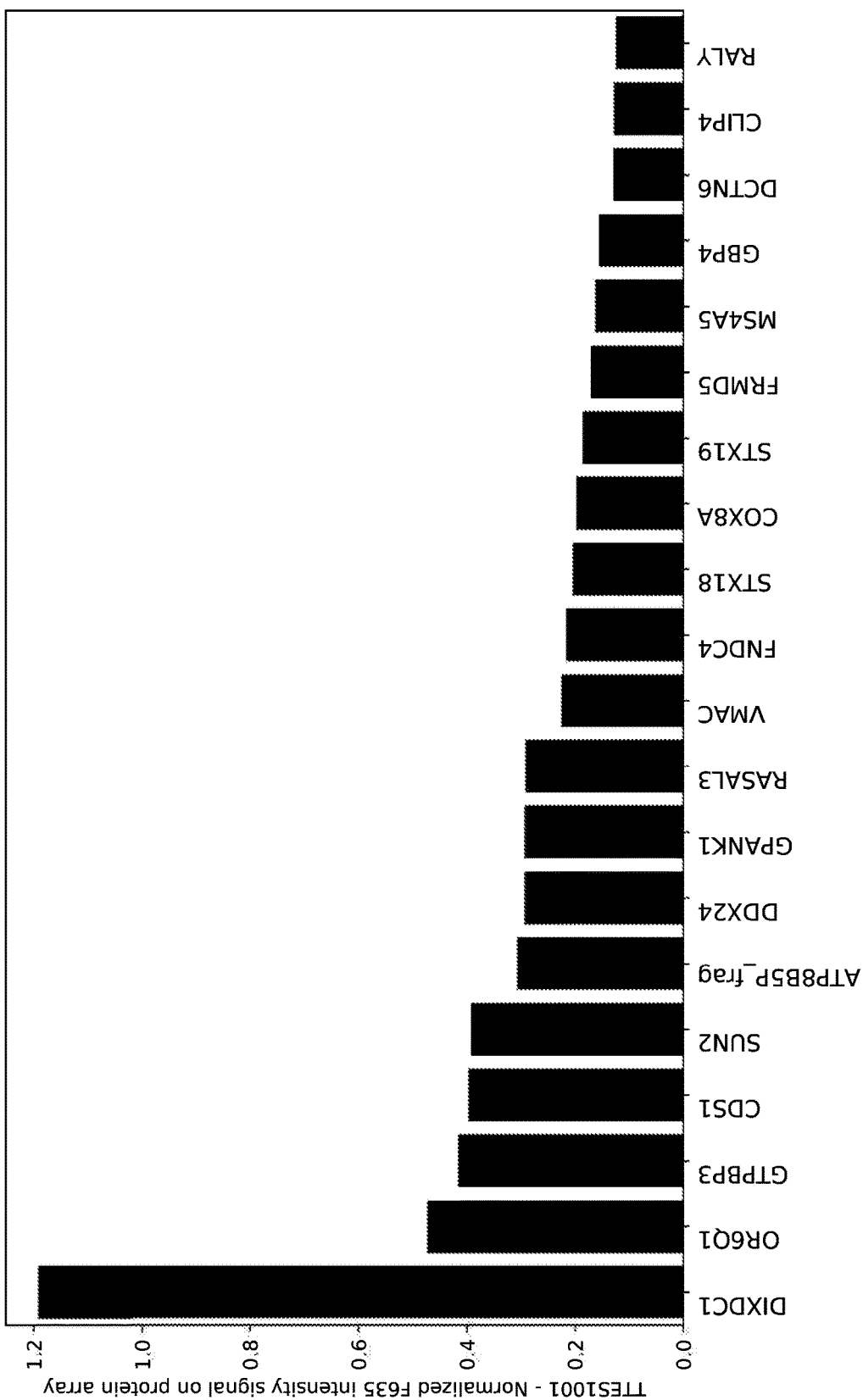

FIG. 154 is protein array data showing specific binding of DIX domain containing 1, transcript variant 2 by TTES1001 antibody.

Figure 155:
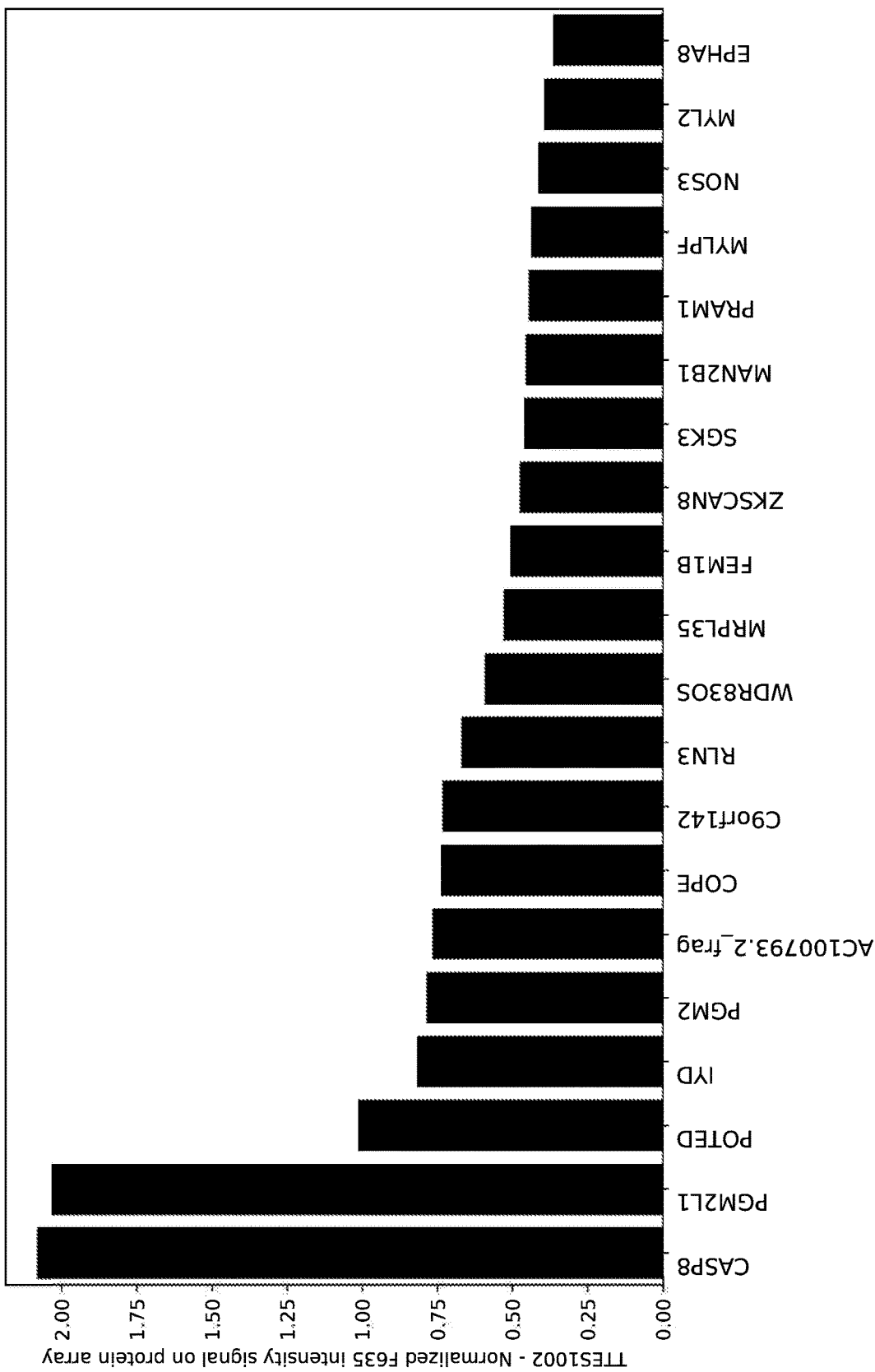

FIG. 155 is protein array data showing specific binding of Caspase 8, and phosphoglucomutase 2 like 1 by TTES1002 antibody.

Figure 156A:
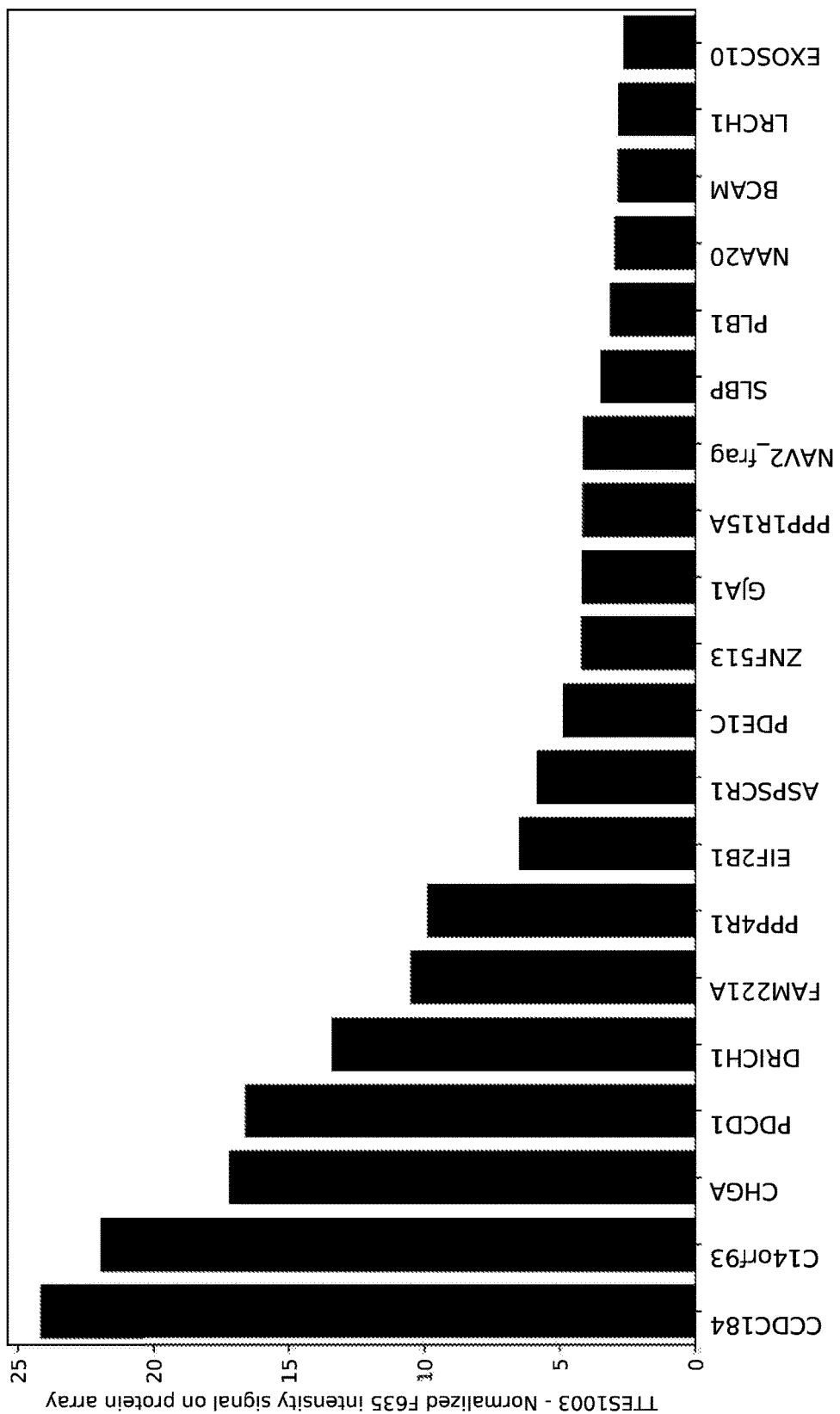
Figure 156B:
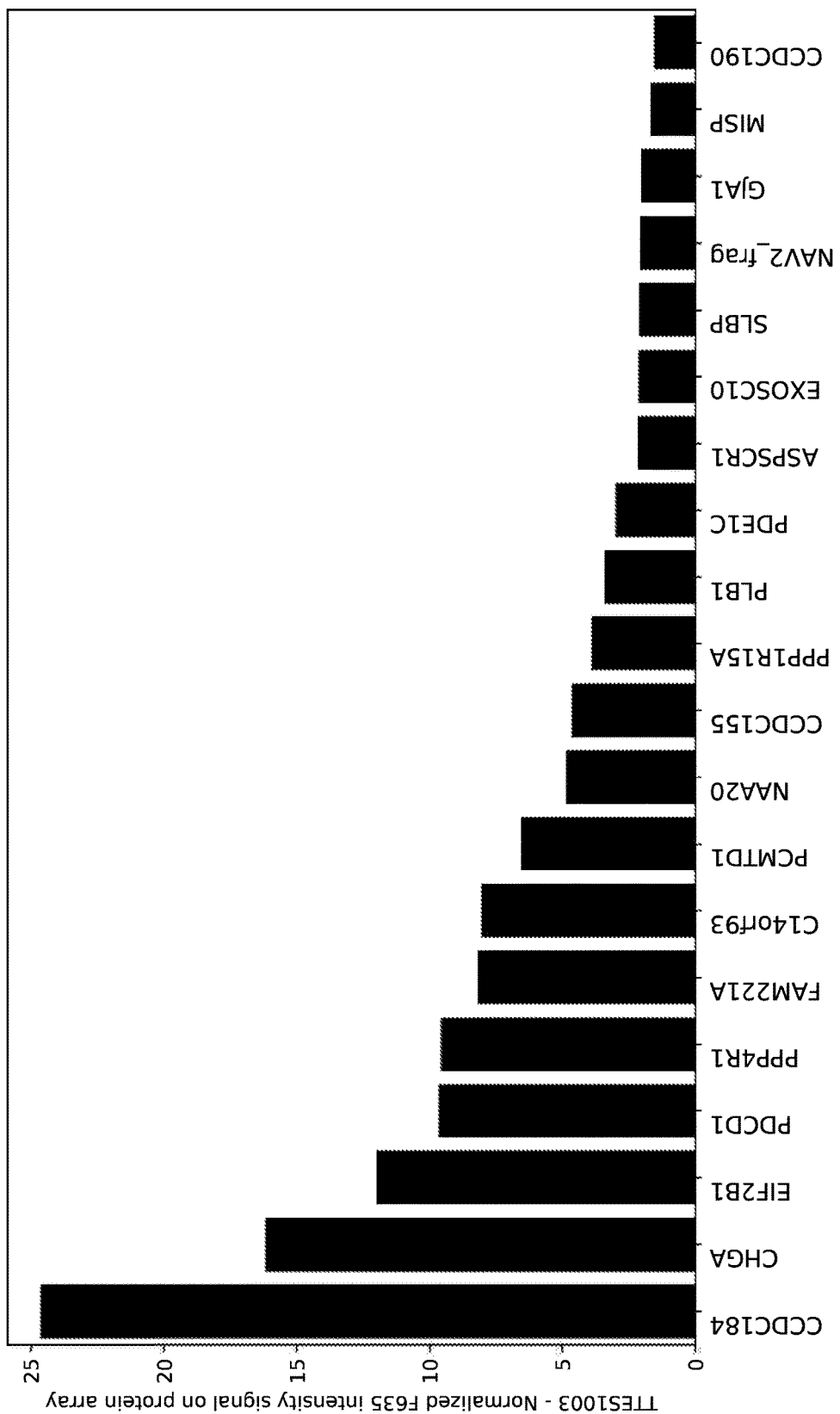

FIG. 156A is protein array data showing specific binding of programmed cell death 1 by TTES1003 antibody. FIG. 156B is an experimental replicate showing specific binding programmed cell death 1 by TTES1003 antibody. FIG. 156B is an experimental replicate.

Figure 157:
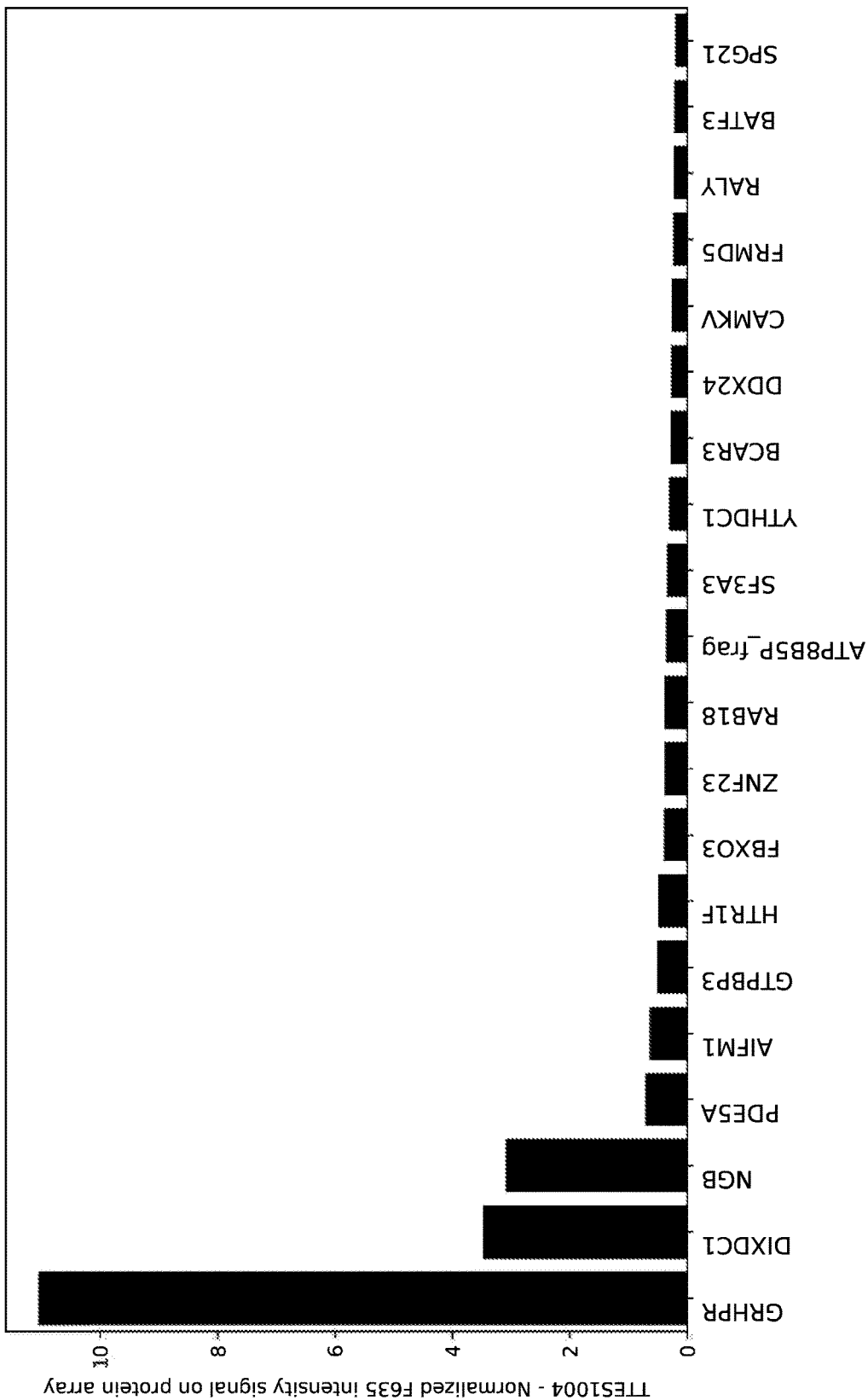

FIG. 157 is protein array data showing specific binding of glyoxylate and hydroxypyruvate reductase by TTES1004 antibody.

Figure 158:
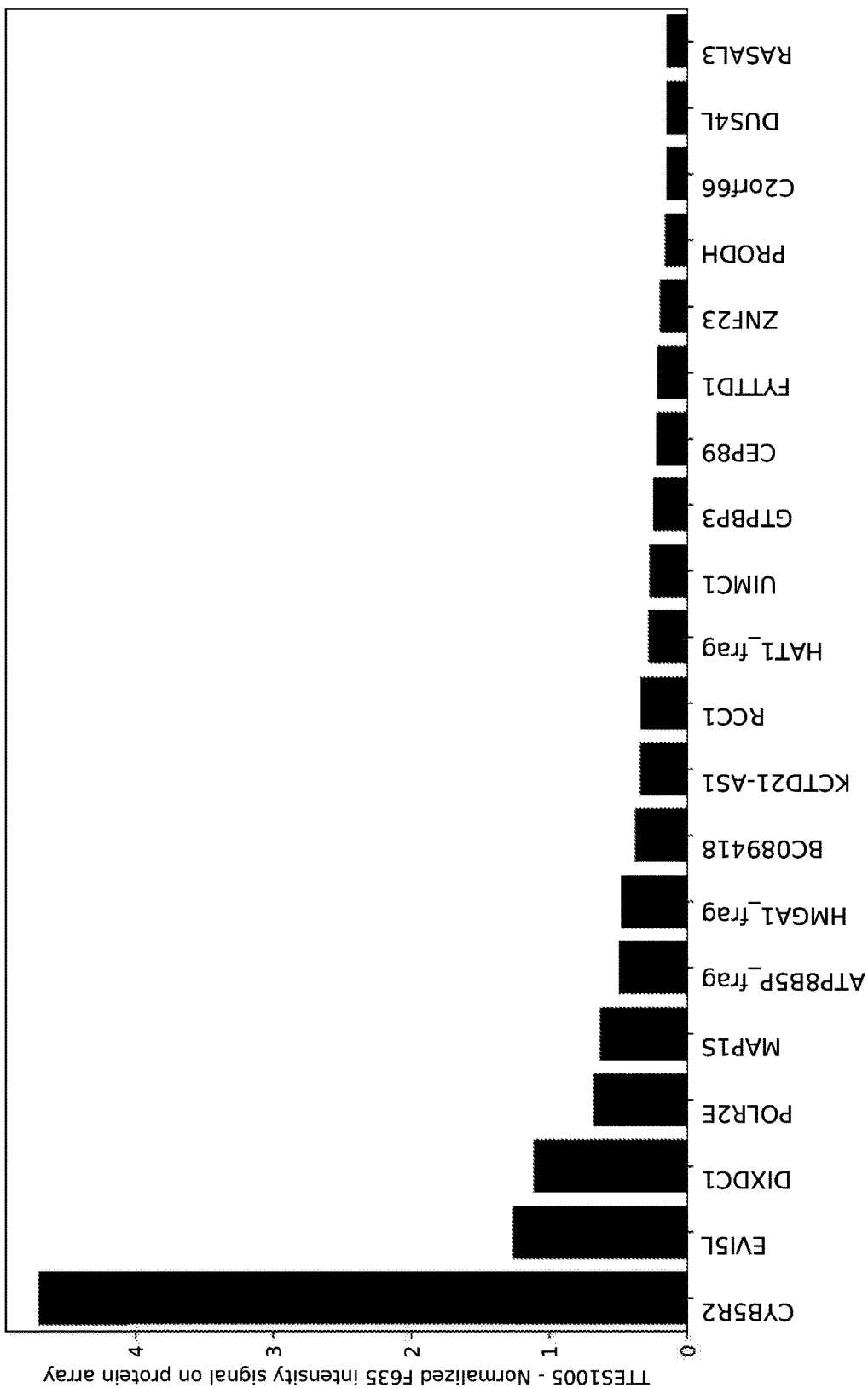

FIG. 158 is protein array data showing specific binding of Cytochrome b5 reductase 2 by TTES1005 antibody.

Figure 159:
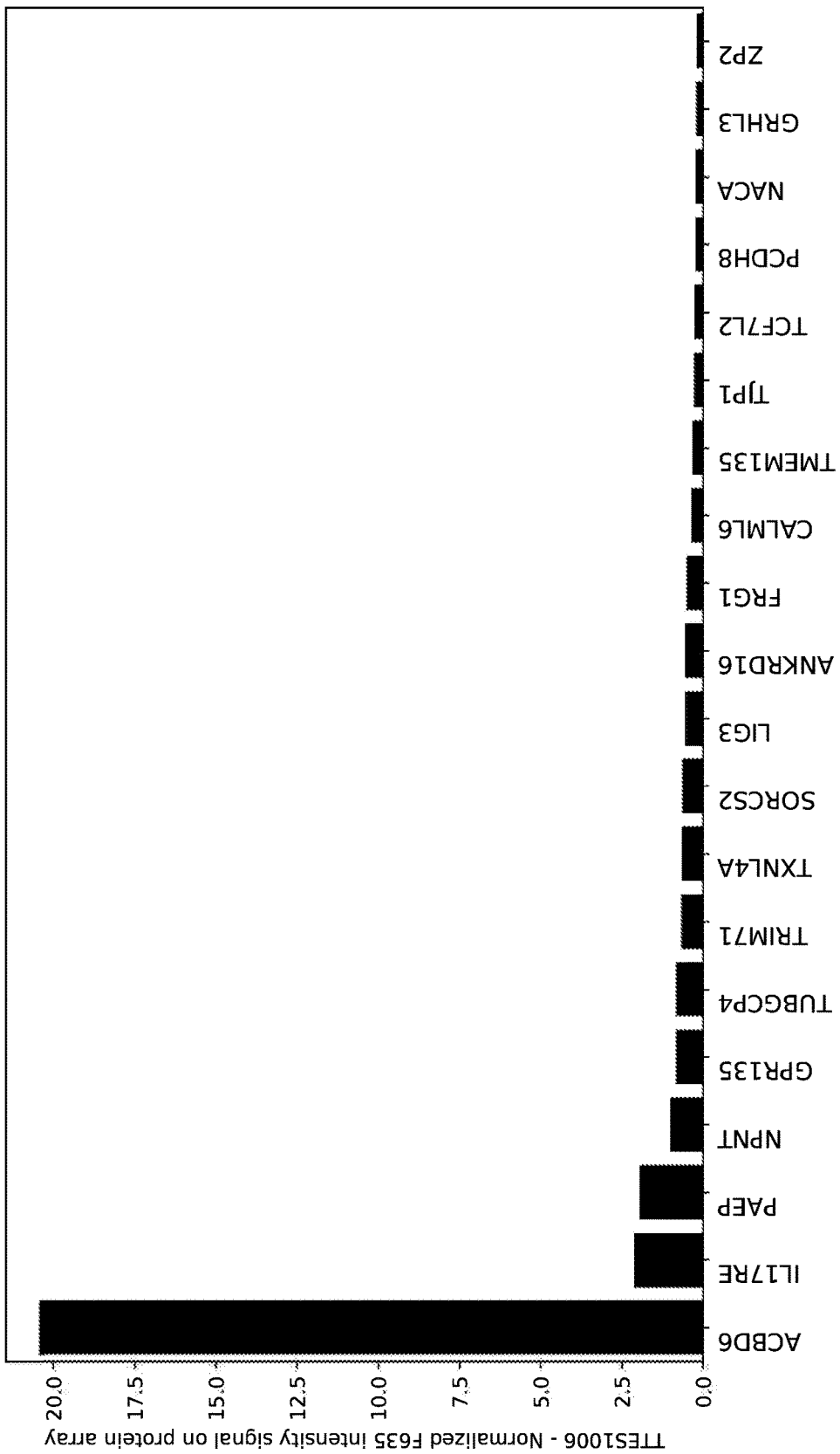

FIG. 159 is protein array data showing specific binding of acyl-CoA binding domain containing 6 by TTES1006 antibody.

Figure 160:
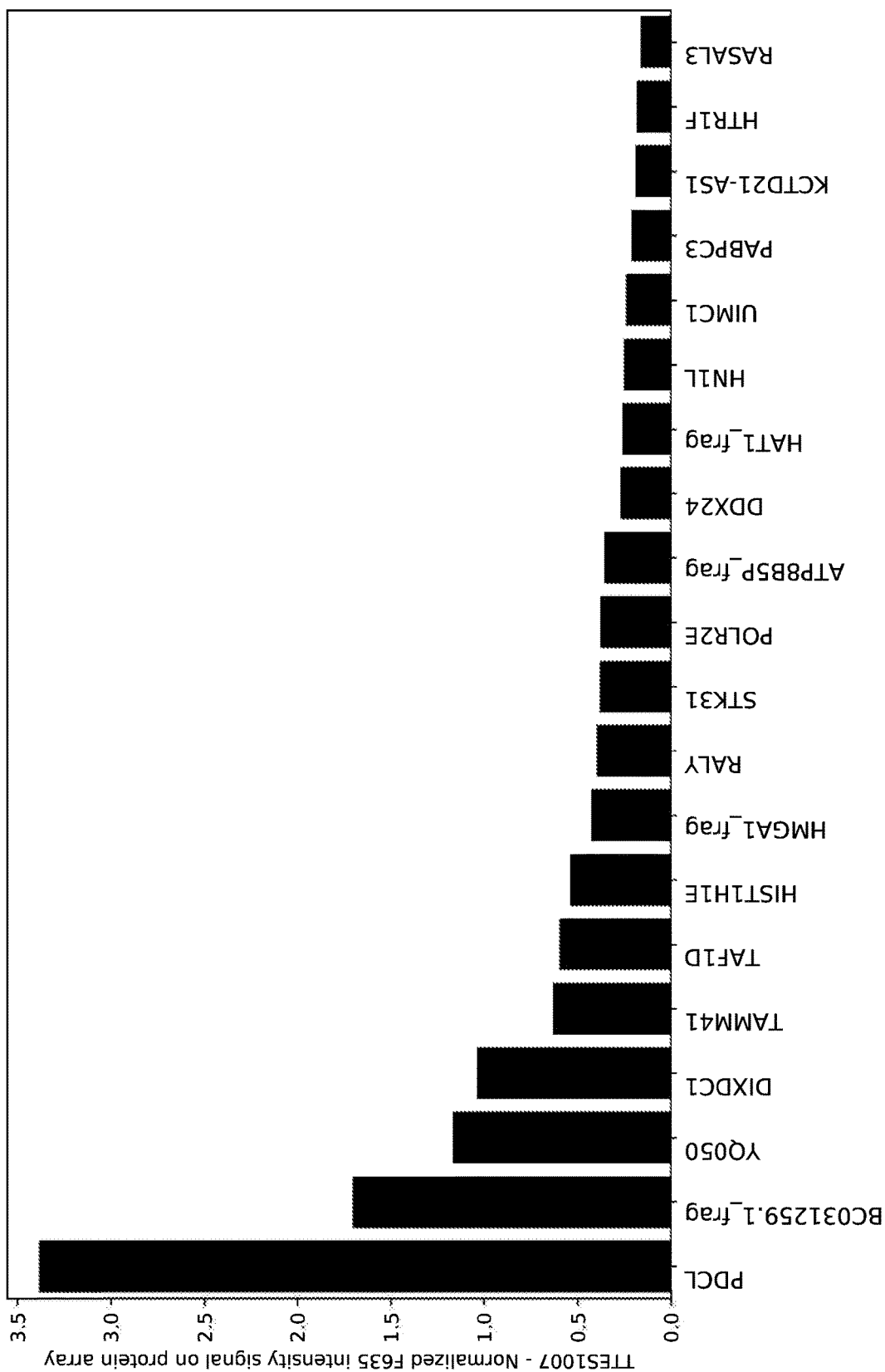

FIG. 160 is protein array data showing specific binding of phosducin like by TTES1007 antibody.

Figure 161:
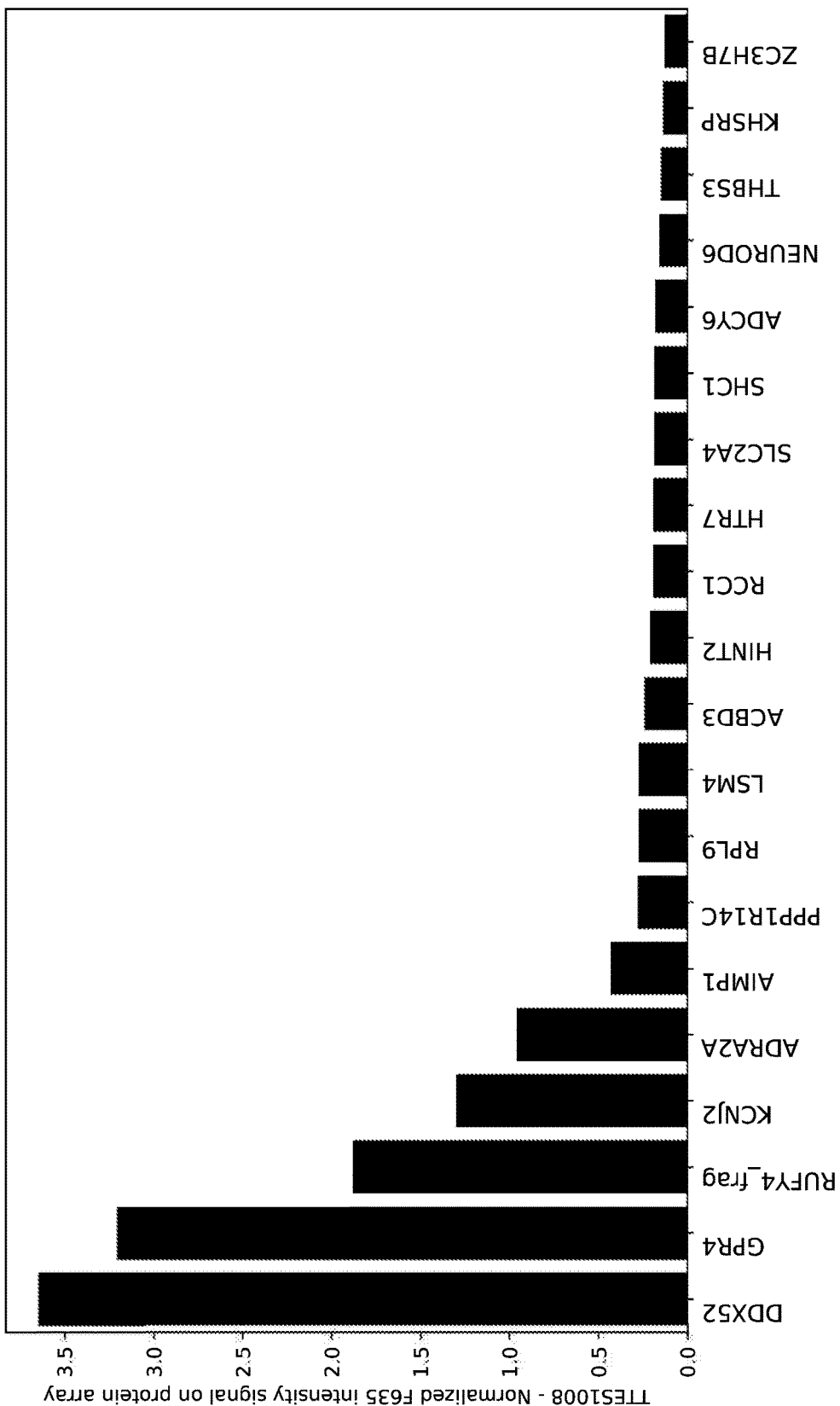

FIG. 161 is protein array data showing specific binding of Dexd-box helicase 52, and G protein-coupled receptor 4 by TTES1008 antibody.

Figure 162:
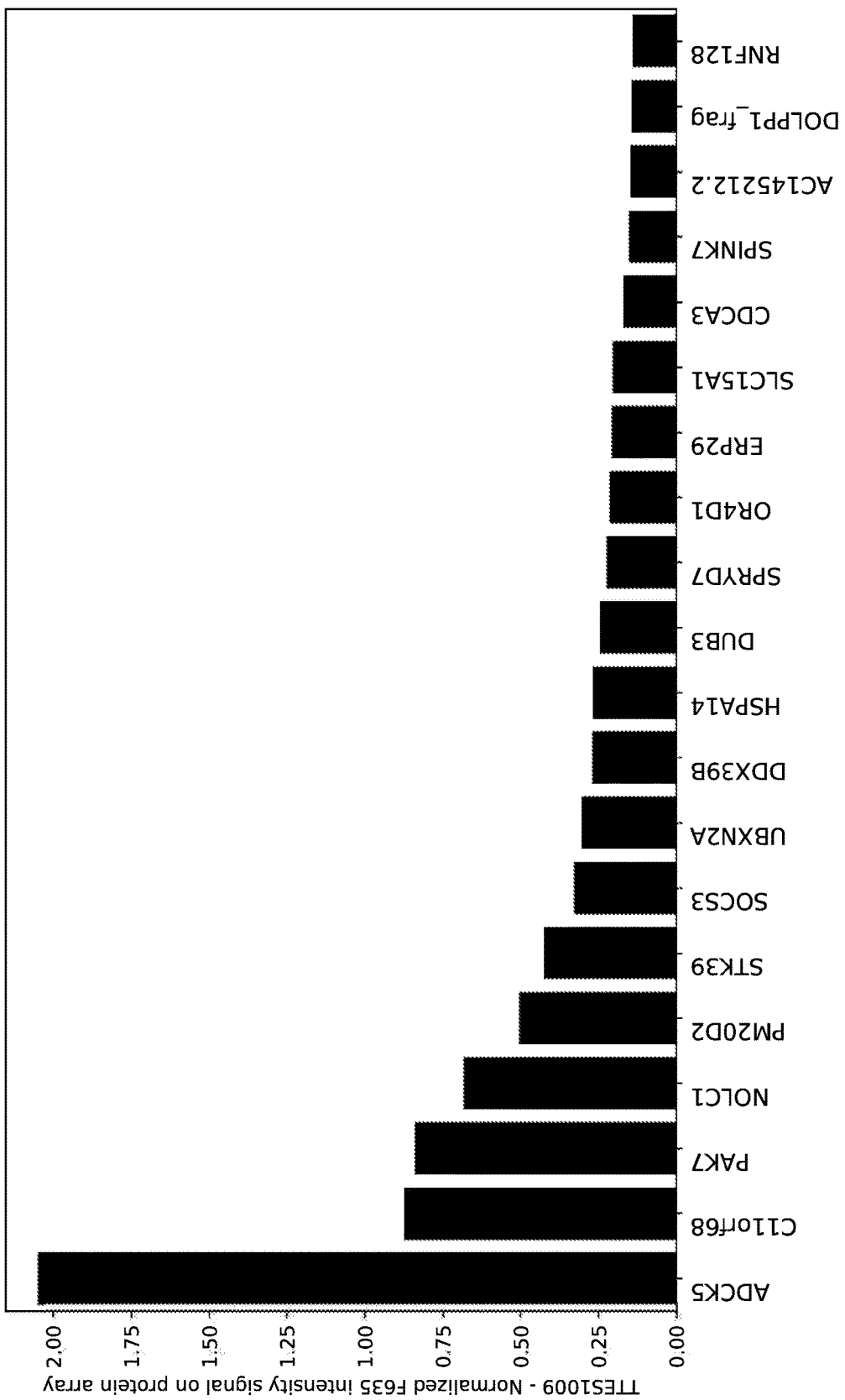

FIG. 162 is protein array data showing specific binding of aarF domain containing kinase 5 by TTES1009 antibody.

Figure 163:
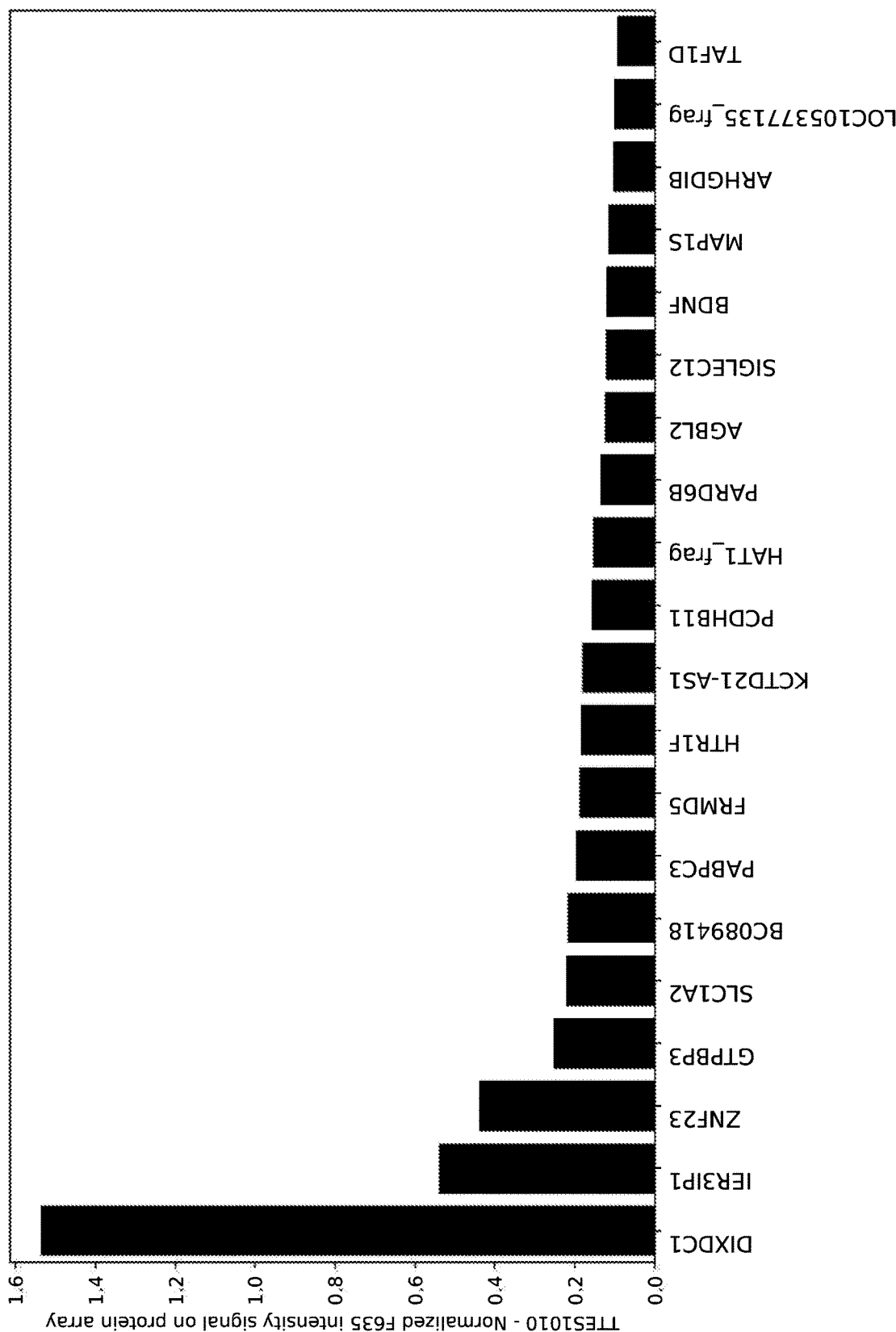

FIG. 163 is protein array data showing specific binding of DIX domain containing 1, transcript variant 2 by TTES1010 antibody.

Figure 164:
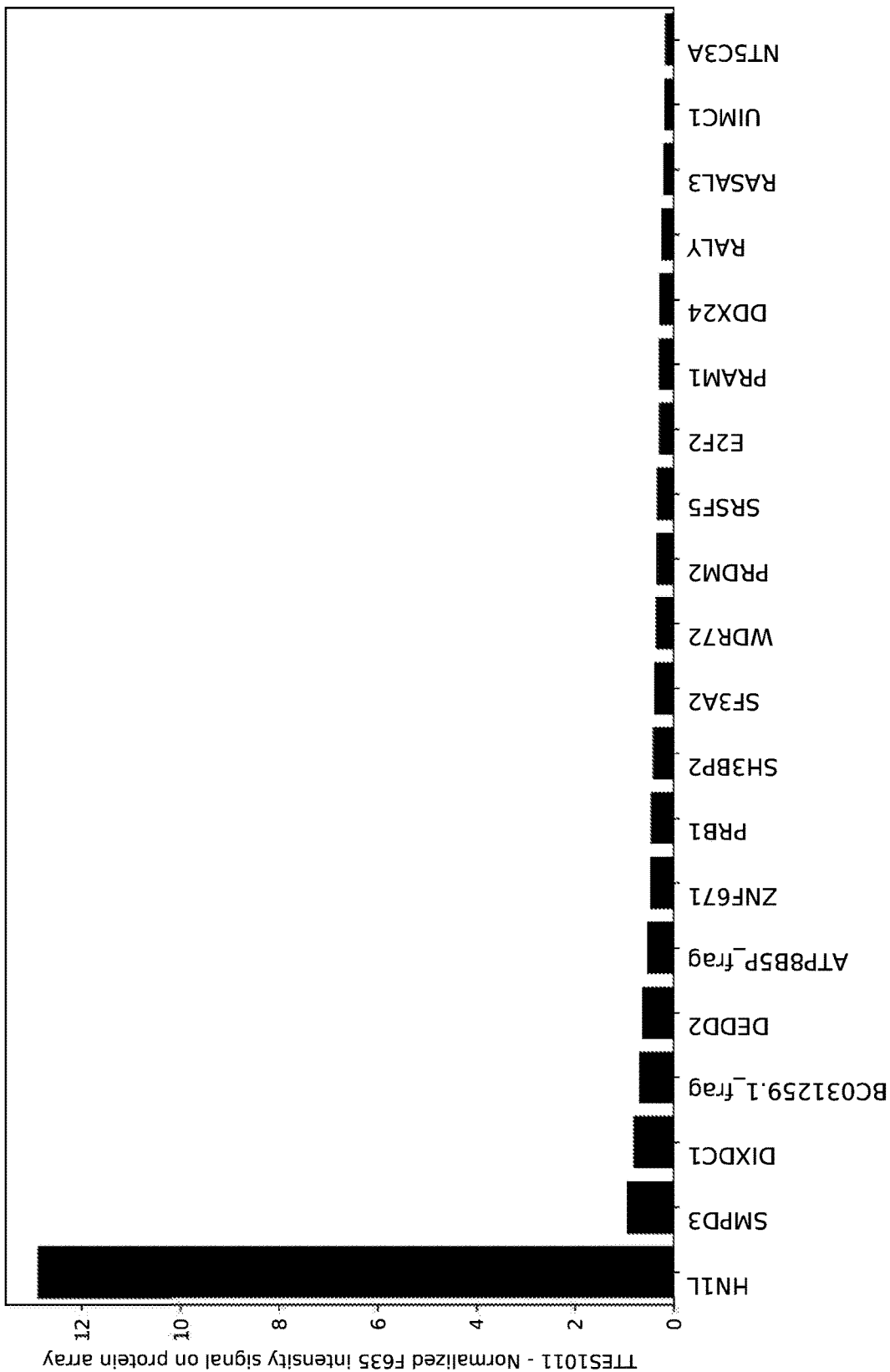

FIG. 164 is protein array data showing specific binding of Jupiter microtubule associated homolog 2 by TTES1011 antibody.

Figure 165:
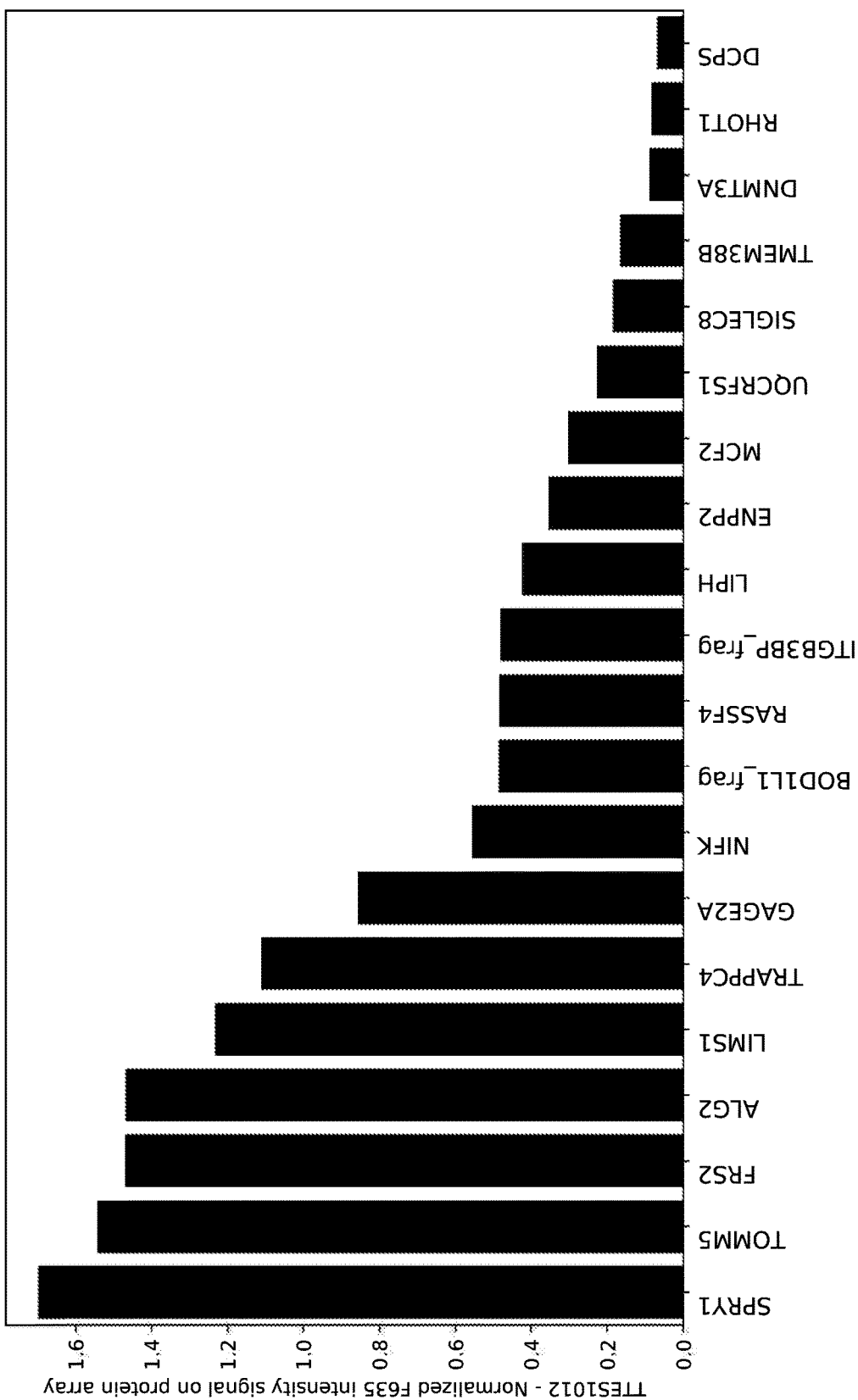

FIG. 165 is protein array data showing specific binding of G antigen 2A by TTES1012 antibody.

Figure 166:
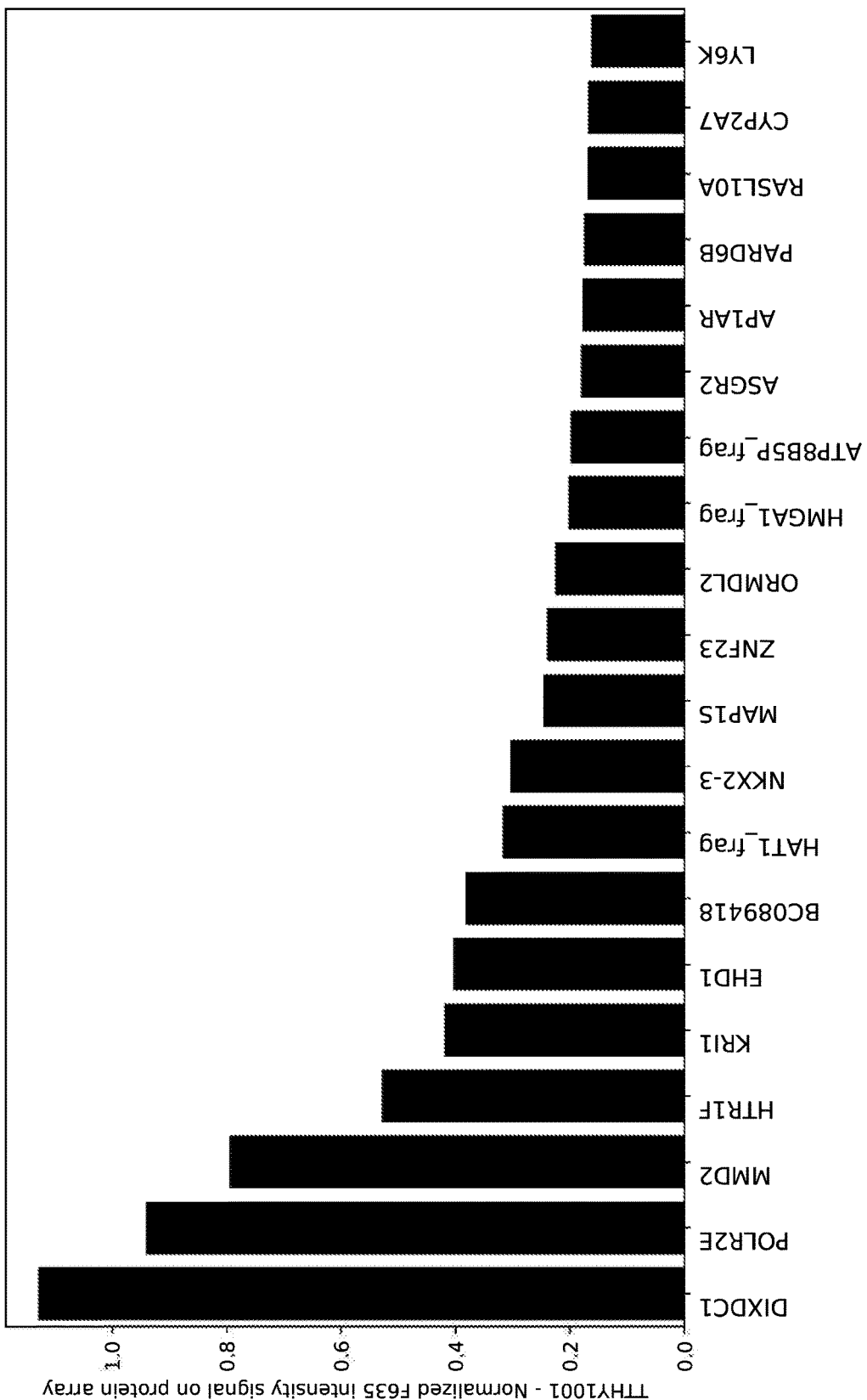

FIG. 166 is protein array data showing specific binding of DIX domain containing 1, transcript variant 2, and RNA polymerase II subunit E, transcript variant 1 by TTHY1001 antibody.

Figure 167:
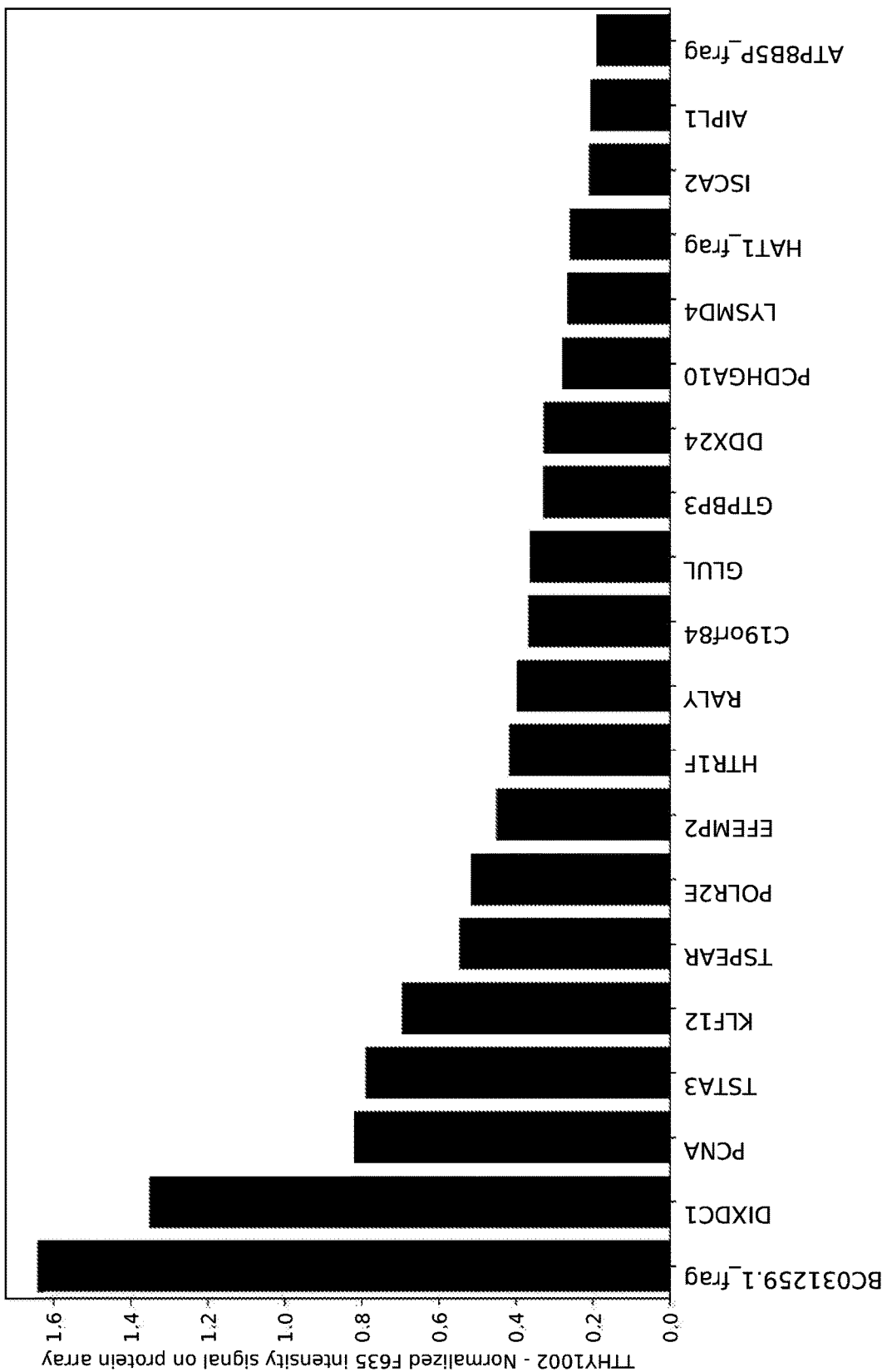

FIG. 167 is protein array data showing specific binding of proliferating cell nuclear antigen, transcript variant 1 by TTHY1002 antibody.

Figure 168:
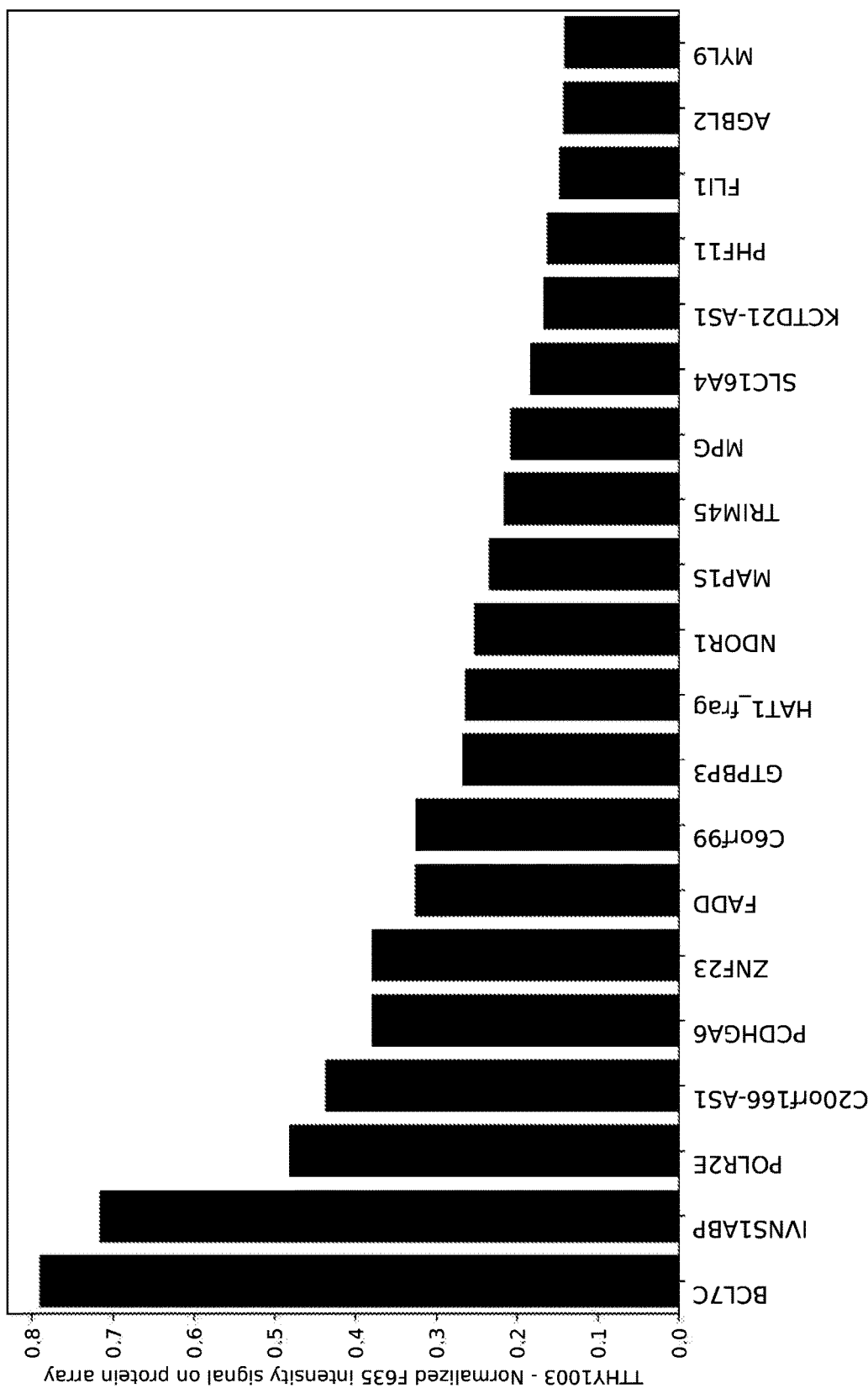

FIG. 168 is protein array data showing specific binding of BAF chromatin remodeling complex subunit BCL7C, transcript variant 2, and influenza virus NS1A binding protein by TTHY1003 antibody.

Figure 169:
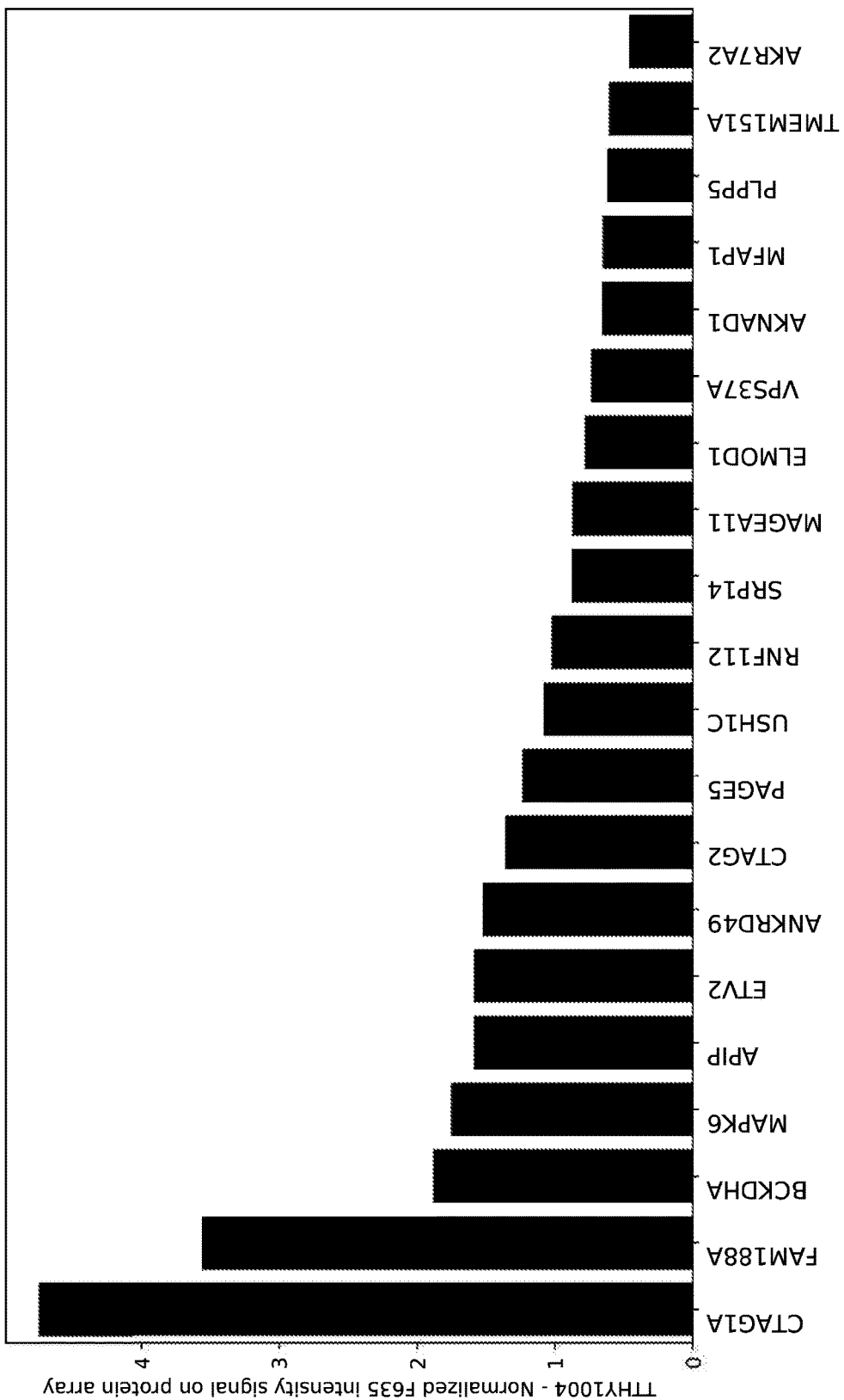

FIG. 169 is protein array data showing specific binding of cancer/testis antigen 1A by TTHY1004 antibody.

Figure 170:
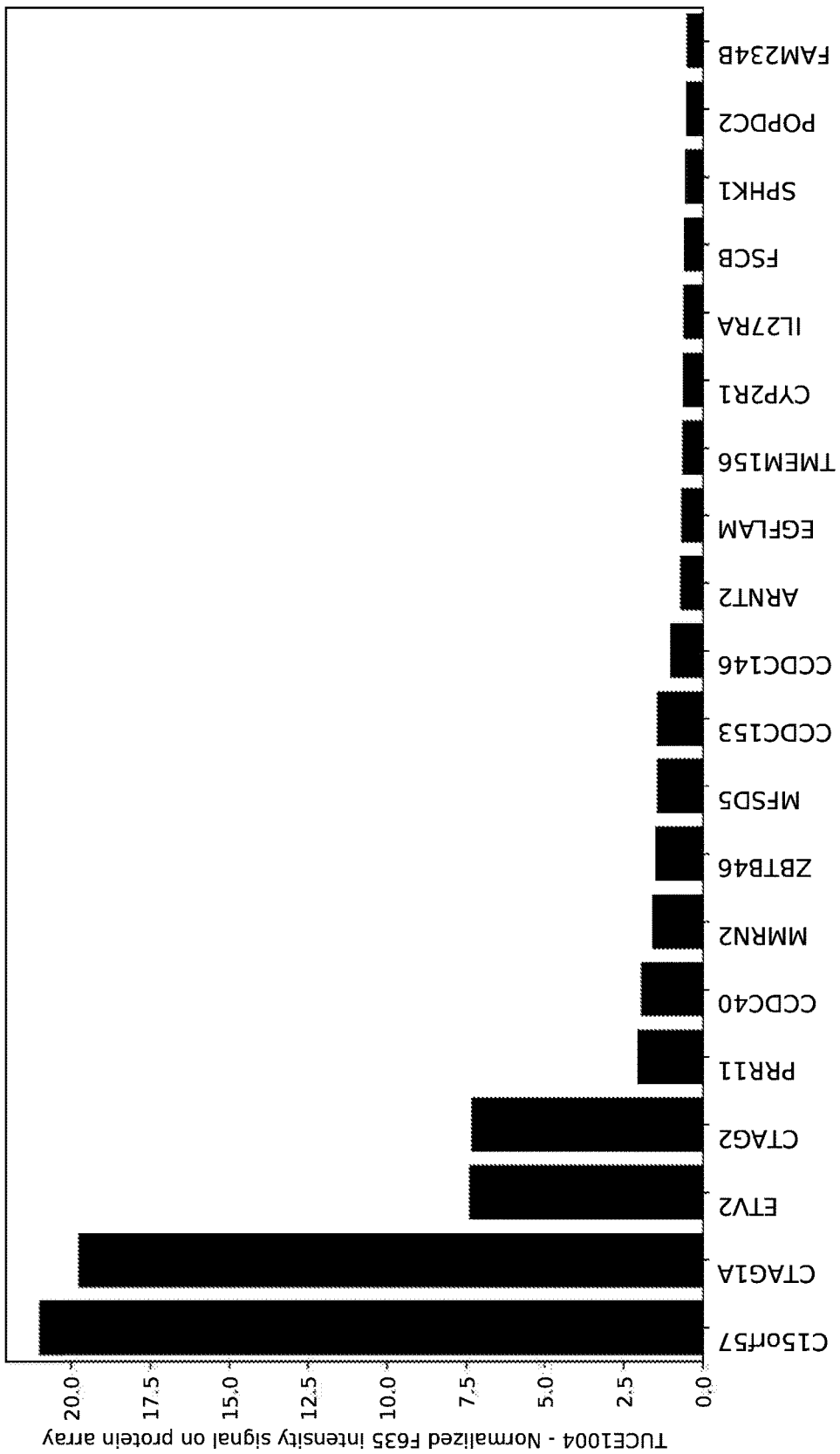

FIG. 170 is protein array data showing specific binding of cancer/testis antigen 1A by TUCE1004 antibody.

Figure 171:
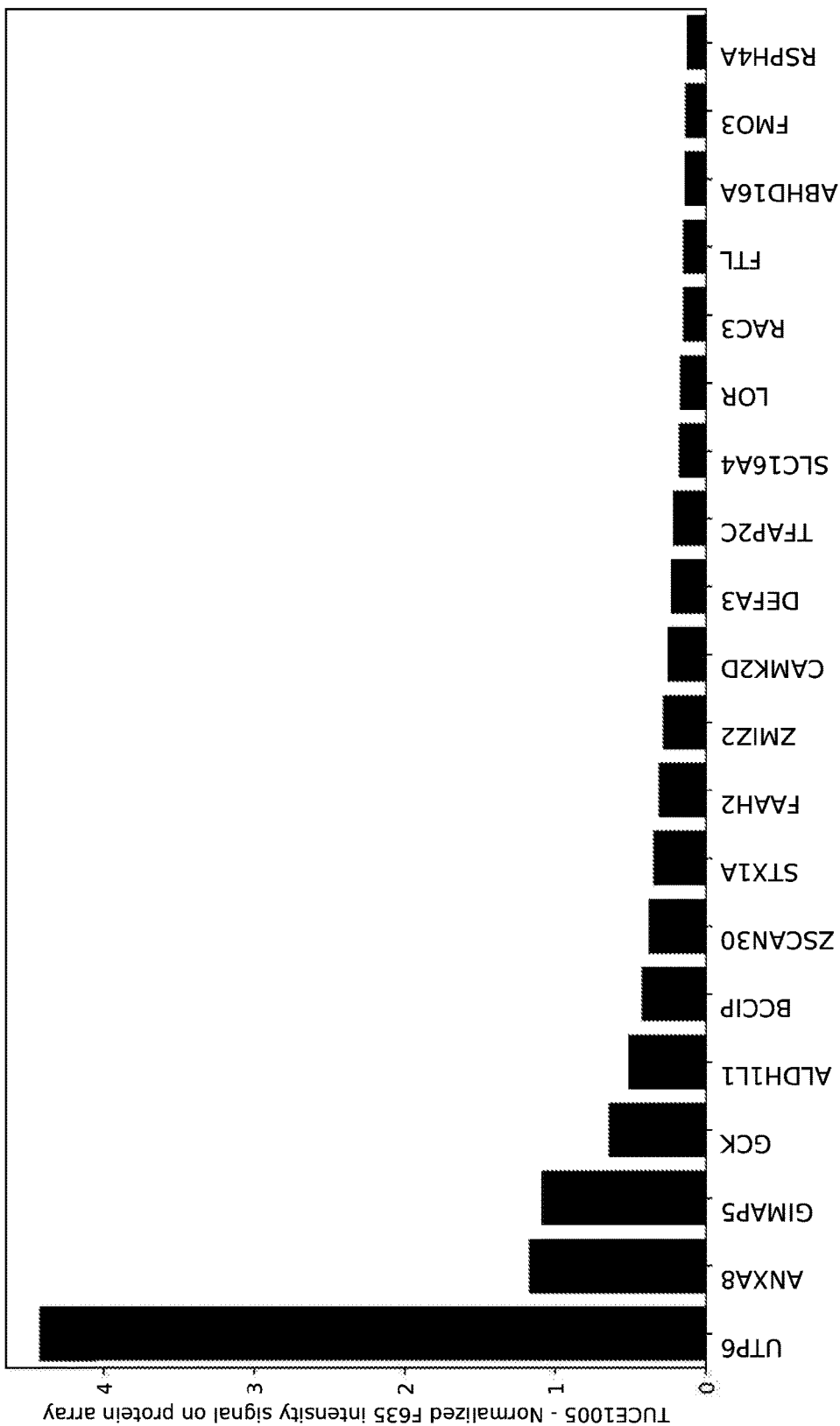

FIG. 171 is protein array data showing specific binding of UTP6 small subunit processome component by TUCE1005 antibody.

Figure 172:
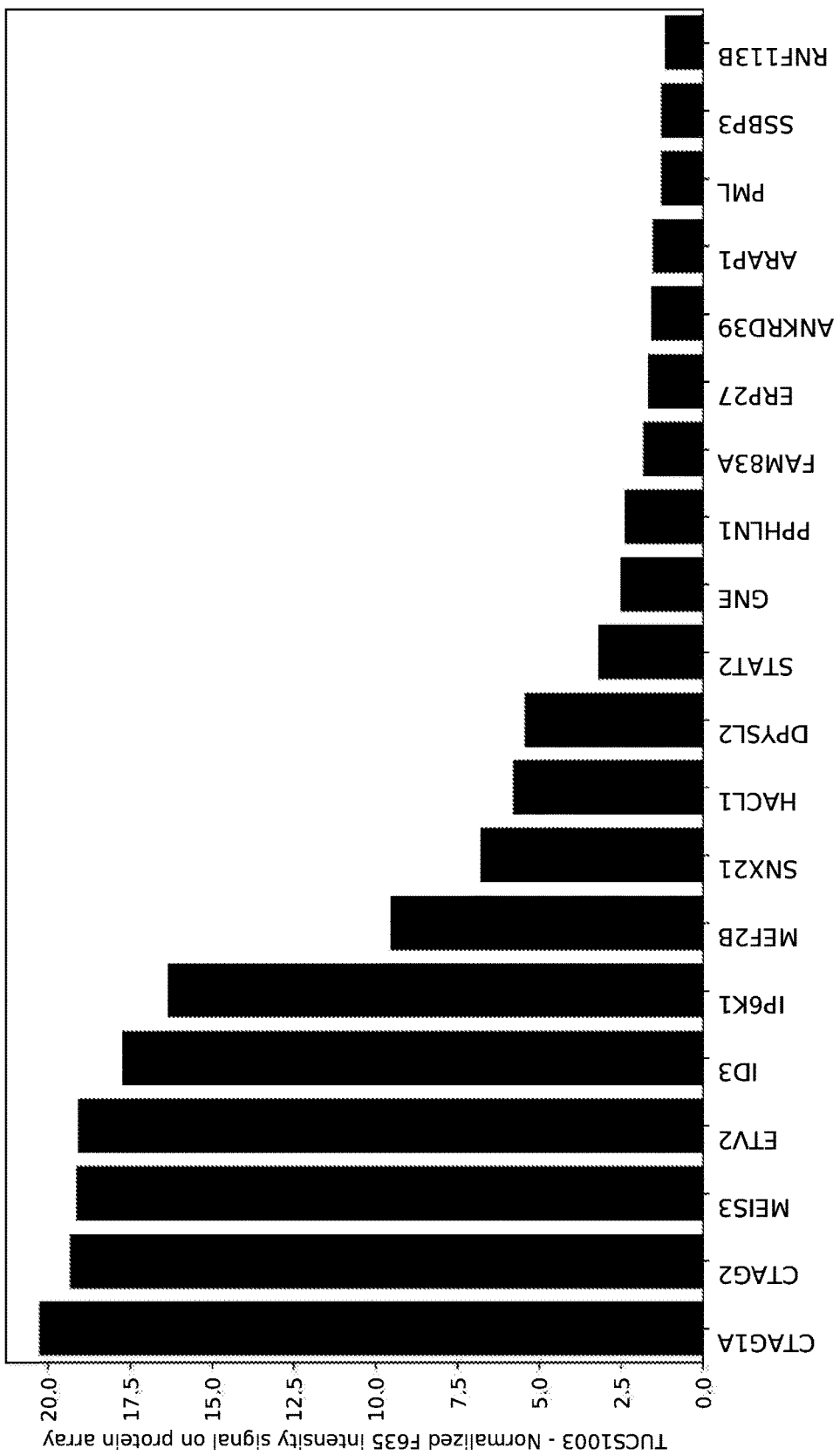

FIG. 172 is protein array data showing specific binding of cancer/testis antigen 1A by TUCS1003 antibody.

Figure 173:
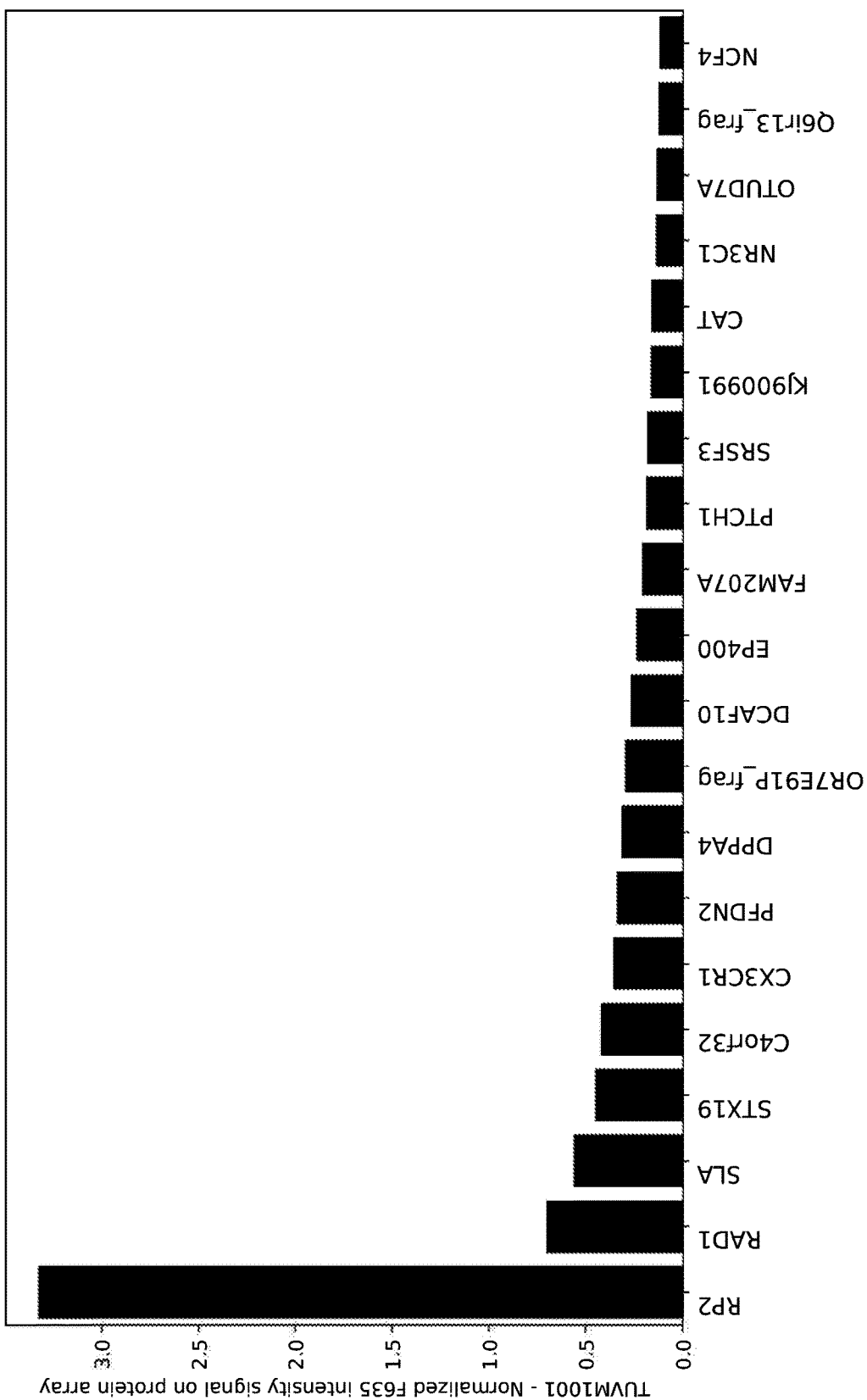

FIG. 173 is protein array data showing specific binding of RP2 activator of ARL3 GTPase by TUVM1001 antibody.

DETAILED DESCRIPTION OF THE INVENTION

It is to be understood that this application is not limited to particular formulations or process parameters, as these may, of course, vary. It is also to be understood that the terminology used herein is for the purpose of describing particular embodiments only, and is not intended to be limiting. Further, it is understood that a number of methods and materials similar or equivalent to those described herein can be used in the practice of the present inventions.

In accordance with the present application, there may be employed conventional molecular biology, microbiology, and recombinant DNA techniques as explained fully in the art.

The following definitions supplement those in the art and are directed to the current application and are not to be imputed to any related or unrelated case, e.g., to any commonly owned patent or application. Accordingly, the terminology used herein is for the purpose of describing particular embodiments only, and is not intended to be limiting.

In this application, the use of the singular includes the plural unless specifically stated otherwise. It must be noted that, as used in the specification, the singular forms "a," "an" and "the" include plural referents unless the context clearly dictates otherwise. Furthermore, use of the term "including" as well as other forms, such as "include", "includes," and "included," is not limiting.

The terms "and/or" and "any combination thereof" and their grammatical equivalents as used herein, can be used interchangeably. These terms can convey that any combination is specifically contemplated. Solely for illustrative purposes, the following phrases "A, B, and/or C" or "A, B, C, or any combination thereof" can mean "A individually; B individually; C individually; A and B; B and C; A and C; and A, B, and C."

The term "or" can be used conjunctively or disjunctively, unless the context specifically refers to a disjunctive use.

The term "about" or "approximately" means within an acceptable error range for the particular value as determined by one of ordinary skill in the art, which will depend in part on how the value is measured or determined, i.e., the limitations of the measurement system. For example, "about" can mean within 1 or more than 1 standard deviation, per the practice in the art. Alternatively, "about" can mean a range of up to 20%, up to 10%, up to 5%, or up to 1% of a given value. Alternatively, particularly with respect to biological systems or processes, the term can mean within an order of magnitude, preferably within 5-fold, and more preferably within 2-fold, of a value. Where particular values are described in the application and claims, unless otherwise stated the term "about" meaning within an acceptable error range for the particular value should be assumed.

As used in this specification and claim(s), the words "comprising" (and any form of comprising, such as "comprise" and "comprises"), "having" (and any form of having, such as "have" and "has"), "including" (and any form of including, such as "includes" and "include") or "containing" (and any form of containing, such as "contains" and "contain") are inclusive or open-ended and do not exclude additional, unrecited elements or method steps. It is contemplated that any embodiment discussed in this specification can be implemented with respect to any method or composition of the invention, and vice versa. Furthermore, compositions of the invention can be used to achieve methods of the invention.

As used herein the term "consisting essentially of" refers to those elements required for a given embodiment. The term permits the presence of elements that do not materially affect the basic and novel or functional characteristic(s) of that embodiment of the invention.

As used herein the term "consisting of" refers to compositions, methods, and respective components thereof as described herein, which are exclusive of any element not recited in that description of the embodiment.

Reference in the specification to "some embodiments," "an embodiment," "one embodiment" or "other embodiments" means that a particular feature, structure, or characteristic described in connection with the embodiments is included in at least some embodiments, but not necessarily all embodiments, of the inventions.

As used herein, the terms "protein", "peptide" and "polypeptide" are used interchangeably to designate a series of amino acid residues connected to each other by peptide bonds between the alpha-amino and carboxy groups of adjacent residues. The terms "protein", "peptide" and "polypeptide" refer to a polymer of amino acids, including modified amino acids (e.g., phosphorylated, glycated, glycosylated, etc.) and amino acid analogs, regardless of its size or function. "Protein" and "polypeptide" are often used in reference to relatively large polypeptides, whereas the term "peptide" is often used in reference to small polypeptides, but usage of these terms in the art overlaps. The terms "protein", "peptide" and "polypeptide" are used interchangeably herein when referring to a gene product and fragments thereof. These terms encompass, e.g., native and artificial proteins, protein fragments and polypeptide analogs (such as muteins, variants, and fusion proteins) of a protein sequence as well as post-translationally, or otherwise covalently or non-covalently, modified proteins. A peptide, polypeptide, or protein may be monomeric or polymeric. A polypeptide can have the amino acid sequence of naturally occurring polypeptide from any mammal. Such native sequence polypeptide can be isolated from nature or can be produced by recombinant or synthetic means. In some embodiments, the polypeptide is a "variant". "Variant" means a biologically active polypeptide having at least about 80% amino acid sequence identity with the native sequence polypeptide after aligning the sequences and introducing gaps, if necessary, to achieve the maximum percent sequence identity, and not considering any conservative substitutions as part of the sequence identity. Such variants include, for instance, polypeptides wherein one or more amino acid residues are added, or deleted, at the N- or C-terminus of the polypeptide. In some embodiments, a variant will have at least about 80% amino acid sequence identity. In some embodiments, a variant will have at least about 90% amino acid sequence identity. In some embodiments, a variant will have at least about 95% amino acid sequence identity with the native sequence polypeptide. A "derivative" of a polypeptide is a polypeptide (e.g., an antibody) that has been chemically modified, e.g., via conjugation to another chemical moiety (such as, for example, polyethylene glycol or albumin, e.g., human serum albumin), phosphorylation, and glycosylation The term "fusion protein" as used herein refers to a polypeptide that comprises an amino acid sequence of an antibody or fragment thereof and an amino acid sequence of a heterologous polypeptide (i.e., an unrelated polypeptide).

The terms "synthetic polynucleotide," "synthetic gene" or "synthetic polypeptide," as used herein, mean that the corresponding polynucleotide sequence or portion thereof, or amino acid sequence or portion thereof, is derived, from a sequence that has been designed, or synthesized de novo, or modified, compared to an equivalent naturally-occurring sequence. Synthetic polynucleotides (antibodies or antigen-binding fragments) or synthetic genes can be prepared by methods known in the art, including but not limited to, the chemical synthesis of nucleic acid or amino acid sequences. Synthetic genes are typically different from naturally-occurring genes, either at the amino acid, or polynucleotide level, (or both) and are typically located within the context of synthetic expression control sequences. Synthetic gene polynucleotide sequences, may not necessarily encode proteins with different amino acids, compared to the natural gene; for example, they can also encompass synthetic polynucleotide sequences that incorporate different codons but which encode the same amino acid (i.e., the nucleotide changes represent silent mutations at the amino acid level).

Percent (%) sequence identity with respect to a reference polypeptide sequence is the percentage of amino acid residues in a candidate sequence that are identical with the amino acid residues in the reference polypeptide sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or Megalign (DNASTAR®) software. Those skilled in the art can determine appropriate parameters for aligning sequences, including any algorithms needed to achieve maximal alignment over the full length of the sequences being compared. For purposes herein, however, % amino acid sequence identity values are generated using the sequence comparison computer program ALIGN-2. The ALIGN-2 sequence comparison computer program was authored by Genentech, Inc., and the source code has been filed with user documentation in the U.S. Copyright Office, Washington D.C., 20559, where it is registered under U.S. Copyright Registration No. TXU510087. The ALIGN-2 program is publicly available from Genentech, Inc., South San Francisco, Calif., or may be compiled from the source code. The ALIGN-2 program should be compiled for use on a UNIX operating system, including digital UNIX V4.0D. All sequence comparison parameters are set by the ALIGN-2 program and do not vary.

In situations where ALIGN-2 is employed for amino acid sequence comparisons, the % amino acid sequence identity of a given amino acid sequence A to, with, or against a given amino acid sequence B (which can alternatively be phrased as a given amino acid sequence A that has or comprises a certain % amino acid sequence identity to, with, or against a given amino acid sequence B) is calculated as follows: 100 times the fraction X/Y, where X is the number of amino acid residues scored as identical matches by the sequence alignment program ALIGN-2 in that program's alignment of A and B, and where Y is the total number of amino acid residues in B. It will be appreciated that where the length of amino acid sequence A is not equal to the length of amino acid sequence B, the % amino acid sequence identity of A to B will not equal the % amino acid sequence identity of B to A. Unless specifically stated otherwise, all % amino acid sequence identity values used herein are obtained as described in the immediately preceding paragraph using the ALIGN-2 computer program.

Antibody Terminology

As used herein, the term "antibody" refers to an immunoglobulin (Ig) whether natural or partly or wholly synthetically produced. The term also covers any polypeptide or protein having a binding domain which is, or is homologous to, an antigen-binding domain. The term further includes "antigen-binding fragments" and other interchangeable terms for similar binding fragments such as described below.

An antibody includes, but is not be limited to, any specific binding member, immunoglobulin class and/or isotype (e.g., IgG1, IgG2, IgG3, IgG4, IgM, IgA, IgD, IgE and IgM); and biologically relevant fragment or specific binding member thereof. Thus, an antibody includes, for example, monoclonal antibodies, chimeric antibodies, humanized antibodies, human antibodies, recombinant antibodies, chemically engineered antibodies, deimmunized antibodies, affinity-matured antibodies, multispecific antibodies (for example, bispecific antibodies and polyreactive antibodies), heteroconjugate antibodies, antibody fragments, and combinations thereof (e.g., a monoclonal antibody that is also deimmunized, a humanized antibody that is also deimmunized, etc.).

The present disclosure provides cancer associated antibodies that find use in treating and/or diagnosing cancer. The term "cancer associated antibody" as used herein refers to an antibody specific for a cancer associated antigen. In some embodiments, the cancer associated antibody comprises at least one antigen-binding region specific for a cancer associated antigen. Disclosed herein are the complete reconstructed nucleic acid consensus sequences and complete reconstructed polypeptide consensus sequences of the variable heavy chain (VH) and variable light chain (VL) of the antibodies. The nucleic acid and polypeptide sequences of the CDR3 of the VH and the VL are also provided.

Native antibodies and native immunoglobulins are usually heterotetrameric glycoproteins of about 150,000 Daltons, composed of two identical light (L) chains and two identical heavy (H) chains. Each light chain is typically linked to a heavy chain by one covalent disulfide bond, while the number of disulfide linkages varies among the heavy chains of different immunoglobulin isotypes. Each heavy and light chain also has regularly spaced intrachain disulfide bridges. Each heavy chain has at one end a variable domain ("VH") followed by a number of constant domains ("CH"). Each light chain has a variable domain at one end ("VL") and a constant domain ("CL") at its other end; the constant domain of the light chain is aligned with the first constant domain of the heavy chain, and the light-chain variable domain is aligned with the variable domain of the heavy chain. Particular amino acid residues are believed to form an interface between the light- and heavy-chain variable domains.

The antibodies or antigen-binding fragment thereof of the present disclosure can comprise a deletion at an end of a light chain. The antibodies or antigen-binding fragment thereof of the invention can comprise a deletion of 3 or more amino acids at an end of the light chain. The antibodies or antigen-binding fragment thereof of the invention can comprise a deletion of 7 or less amino acids at an end of the light chain. The antibodies or antigen-binding fragment thereof of the invention can comprise a deletion of 3, 4, 5, 6, or 7 amino acids at an end of the light chain.

The antibodies or antigen-binding fragment thereof of the present disclosure can comprise an insertion in a light chain. The antibodies or antigen-binding fragment thereof of the invention can comprise an insertion of 1, 2, 3, 4, 5, 6, 7, 8, 9, or 10, or more amino acids in the light chain. The antibodies or antigen-binding fragment thereof of the invention can comprise an insertion of 3 amino acids in the light chain.

As used herein, "monoclonal antibody" refers to an antibody obtained from a population of substantially homogeneous antibodies, i.e., the individual antibodies comprising the population are identical except for possible naturally-occurring mutations that may be present in minor amounts. Monoclonal antibodies are highly specific, being directed against a single antigenic site. Furthermore, in contrast to polyclonal antibody preparations, which typically include different antibodies directed against different determinants (epitopes), each monoclonal antibody is directed against a single determinant on the antigen. The modifier "monoclonal" indicates the character of the antibody as being obtained from a substantially homogeneous population of antibodies and is not to be construed as requiring production of the antibody by any particular method. For example, the monoclonal antibodies to be used in accordance with the present invention may be made by the hybridoma method first described by Kohler and Milstein, 1975, Nature, 256:495, or may be made by recombinant DNA methods. The monoclonal antibodies may also be isolated from phage libraries generated using the techniques described in McCafferty et al., 1990, Nature, 348:552-554, for example.

As used herein, "humanized" antibodies refer to forms of non-human (e.g. murine) antibodies that are specific chimeric immunoglobulins, immunoglobulin chains, or fragments thereof (such as Fv, Fab, Fab', F(ab')2 or other antigen-binding subsequences of antibodies) that contain minimal sequence derived from non-human immunoglobulin. For the most part, humanized antibodies are human immunoglobulins (recipient antibody) in which residues from a complementary determining region (CDR) of the recipient are replaced by residues from a CDR of a non-human species (donor antibody) such as mouse, rat, or rabbit having the desired specificity, affinity, and capacity. In some instances, Fv framework region (FR) residues of the human immunoglobulin are replaced by corresponding non-human residues. Furthermore, the humanized antibody may comprise residues that are found neither in the recipient antibody nor in the imported CDR or framework sequences but are included to further refine and optimize antibody performance. In general, the humanized antibody will comprise substantially all of at least one, and typically two, variable domains, in which all or substantially all of the CDR regions correspond to those of a non-human immunoglobulin and all or substantially all of the FR regions are those of a human immunoglobulin consensus sequence. The humanized antibody optimally also will comprise at least a portion of an immunoglobulin constant region or domain (Fc), typically that of a human immunoglobulin. Other forms of humanized antibodies have one or more CDRs (one, two, three, four, five, six) which are altered with respect to the original antibody, which are also termed one or more CDRs "derived from" one or more CDRs from the original antibody.

As used herein, an "isolated antibody" is one that has been separated and/or recovered from a component of its natural environment. Contaminant components of its natural environment are materials that would interfere with diagnostic or therapeutic uses of the antibody, and may include enzymes, hormones, and other proteinaceous or non-proteinaceous components. In preferred embodiments, the antibody is purified: (1) to greater than 95% by weight of antibody as determined by the Lowry method, and most preferably more than 99% by weight; (2) to a degree sufficient to obtain at least 15 residues of N-terminal or internal amino acid sequence by use of a spinning cup sequenator; or (3) to homogeneity as shown by SDS-PAGE under reducing or non-reducing conditions and using Coomassie blue or, preferably, silver staining. Isolated antibody includes the antibody in situ within recombinant cells since at least one component of the antibody's natural environment will not be present. Ordinarily, however, isolated antibody will be prepared by at least one purification step.

As used herein, the term "Complementarity Determining Regions" (CDRs, i.e., CDR1, CDR2, and CDR3) refers to the amino acid residues of an antibody variable domain the presence of which are necessary for antigen binding. Each variable domain typically has three CDR regions identified as CDR1, CDR2 and CDR3. The CDRs of variable heavy chain can be CDR-H1, CDR-H2 and CDR-H3. The CDRs of variable light chain can be CDR-L1, CDR-L2 and CDR-L3. Exemplary hypervariable loops occur at amino acid residues 26-32 (L1), 50-52 (L2), 91-96 (L3), 26-32 (H1), 53-55 (H2), and 96-101 (H3). (Chothia and Lesk, J. Mol. Biol. 196:901-917 (1987)). Exemplary CDRs (CDR-L1, CDR-L2, CDR-L3, CDR-H1, CDR-H2, and CDR-H3) occur at amino acid residues 24-34 of L1, 50-56 of L2, 89-97 of L3, 31-35B of H1, 50-65 of H2, and 95-102 of H3 (Kabat et al., Sequences of Proteins of Immunological Interest, 5th ed. (1991)). Thus, the HVs may be comprised within the corresponding CDRs and references herein to the "hypervariable loops" of VH and VL domains should be interpreted as also encompassing the corresponding CDRs, and vice versa, unless otherwise indicated. The more highly conserved regions of variable domains are called the framework region (FR), as defined below. The variable domains of native heavy and light chains each comprise four FRs (FR1, FR2, FR3 and FR4, respectively), largely adopting a [beta]-sheet configuration, connected by the three hypervariable loops. The hypervariable loops in each chain are held together in close proximity by the FRs and, with the hypervariable loops from the other chain, contribute to the formation of the antigen-binding site of antibodies. Structural analysis of antibodies revealed the relationship between the sequence and the shape of the binding site formed by the complementarity determining regions (Chothia et al., J. Mol. Biol. 227: 799-817 (1992)); Tramontano et al., J. Mol. Biol, 215: 175-182 (1990)). Despite their high sequence variability, five of the six loops adopt just a small repertoire of main-chain conformations, called "canonical structures". These conformations are first of all determined by the length of the loops and secondly by the presence of key residues at certain positions in the loops and in the framework regions that determine the conformation through their packing, hydrogen bonding or the ability to assume unusual main-chain conformations.

A "variable region" of an antibody refers to the variable region of the antibody light chain or the variable region of the antibody heavy chain, either alone or in combination. The variable regions of the heavy and light chain each consist of four framework regions (FR) connected by three complementarity determining regions (CDRs) also known as hypervariable regions. The CDRs in each chain are held together in close proximity by the FRs and, with the CDRs from the other chain, contribute to the formation of the antigen-binding site of antibodies. There are at least two techniques for determining CDRs: (1) an approach based on cross-species sequence variability (i.e., Kabat et al. Sequences of Proteins of Immunological Interest, (5th ed., 1991, National Institutes of Health, Bethesda Md.)); and (2) an approach based on crystallographic studies of antigen-antibody complexes (Allazikani et al. (1997) J. Molec. Biol. 273:927-948)). A CDR may refer to CDRs defined by either approach or by a combination of both approaches.

A "constant region" of an antibody refers to the constant region of the antibody light chain or the constant region of the antibody heavy chain, either alone or in combination. The constant region does not vary with respect to antigen specificity.

As used herein, the term "heavy chain region" includes amino acid sequences derived from the constant domains of an immunoglobulin heavy chain. A polypeptide comprising a heavy chain region comprises at least one of: a CH1 domain, a hinge (e.g., upper, middle, and/or lower hinge region) domain, a CH2 domain, a CH3 domain, or a variant or fragment thereof. In an embodiment, an antibody or an antigen-binding fragment thereof may comprise the Fc region of an immunoglobulin heavy chain (e.g., a hinge portion, a CH2 domain, and a CH3 domain). In another embodiment, an antibody or an antigen-binding fragment thereof lacks at least a region of a constant domain (e.g., all or part of a CH2 domain). In certain embodiments, at least one, and preferably all, of the constant domains are derived from a human immunoglobulin heavy chain. For example, in one preferred embodiment, the heavy chain region comprises a fully human hinge domain. In other preferred embodiments, the heavy chain region comprising a fully human Fc region (e.g., hinge, CH2 and CH3 domain sequences from a human immunoglobulin). In certain embodiments, the constituent constant domains of the heavy chain region are from different immunoglobulin molecules. For example, a heavy chain region of a polypeptide may comprise a domain derived from an IgG1 molecule and a hinge region derived from an IgG3 or IgG4 molecule. In other embodiments, the constant domains are chimeric domains comprising regions of different immunoglobulin molecules. For example, a hinge may comprise a first region from an IgG1 molecule and a second region from an IgG3 or IgG4 molecule. As set forth above, it will be understood by one of ordinary skill in the art that the constant domains of the heavy chain region may be modified such that they vary in amino acid sequence from the naturally occurring (wild-type) immunoglobulin molecule. That is, the polypeptides of the invention disclosed herein may comprise alterations or modifications to one or more of the heavy chain constant domains (CH1, hinge, CH2 or CH3) and/or to the light chain constant domain (CL). Exemplary modifications include additions, deletions or substitutions of one or more amino acids in one or more domains.

The antibodies or antigen-binding fragment thereof of the present disclosure can comprise a CDR3 region that is a length of at least about 10, 11, 12, 13, 14, 15, 16, 17, 18, 19, 20, 21, 22, 23, 24, 25, 26, 27, 28, 29, or 30 amino acids in length. The antibodies or antigen-binding fragment thereof of the present disclosure can comprise a CDR3 region that is at least about 18 amino acids in length. In some embodiments, the CDR3 region comprises a CDR-H3 region. In some embodiments, the CDR3 region comprises a CDR-L3 region.

As used herein, the term "hinge region" includes the region of a heavy chain molecule that joins the CH1 domain to the CH2 domain. This hinge region comprises approximately 25 residues and is flexible, thus allowing the two N-terminal antigen-binding regions to move independently. Hinge regions can be subdivided into three distinct domains: upper, middle, and lower hinge domains (Roux et al. J. Immunol. 1998 161:4083).

As used herein, the term "Fv" is the minimum antibody fragment that contains a complete antigen-recognition and -binding site. This fragment consists of a dimer of one heavy- and one light-chain variable region domain in tight, non-covalent association.

"Heavy chain variable region" or "VH" with regard to an antibody refers to the fragment of the heavy chain that contains three CDRs interposed between flanking stretches known as framework regions, these framework regions are generally more highly conserved than the CDRs and form a scaffold to support the CDRs.

Six hypervariable loops (three loops each from the H and L chain) contribute the amino acid residues for antigen-binding and confer antigen-binding specificity to the antibody. However, even a single variable domain (or half of an Fv comprising only three CDRs specific for an antigen) has the ability to recognize and bind antigen, although at a lower affinity than the entire binding site.

"Framework" or FR residues are those variable domain residues other than the hypervariable region residues.

It is understood in the art that an antibody is a glycoprotein having at least two heavy (H) chains and two light (L) chains interconnected by disulfide bonds, or an antigen-binding portion thereof. A heavy chain is comprised of a heavy chain variable region (VH) and a heavy chain constant region (CH1, CH2 and CH3). A light chain is comprised of a light chain variable region (VL) and a light chain constant region (CL). The variable regions of both the heavy and light chains comprise framework regions (FRs or FWRs) and hypervariable regions (HVRs). The HVRs are the amino acid residues of an antibody that are responsible for antigen binding. The hypervariable region generally comprises amino acid residues from a complementarity determining region (CDR), which have the highest sequence variability and/or involved in antigen recognition. With the exception of CDR1 in VH, CDRs generally comprise the amino acid residues that form the hypervariable loops. CDRs also comprise "specificity determining residues," or "SDRs," which are residues that contact antigen. SDRs are contained within regions of the CDRs called abbreviated-CDRs, or a-CDRs. Exemplary a-CDRs (a-CDR-L1, a-CDR-L2, a-CDR-L3, a-CDR-H1, a-CDR-H2, and a-CDR-H3) occur at amino acid residues 31-34 of L1, 50-55 of L2, 89-96 of L3, 31-35B of H1, 50-58 of H2, and 95-102 of H3. (See, e.g., Fransson, Front. Biosci. 13:1619-1633 (2008).)

Unless otherwise indicated, HVR residues and other residues in the variable domain (e.g., FR residues) are numbered herein according to Kabat et al., supra. A variable region is a domain of an antibody heavy or light chain that is involved in binding the antibody to antigen. (See, e.g., Kindt et al. Kuby Immunology, 6th ed., W.H. Freeman and Co., p. 91 (2007)). A single VH or VL domain may be sufficient to confer antigen-binding specificity. Furthermore, antibodies that bind a particular antigen may be isolated using a VH or VL domain from an antibody that binds the antigen to screen a library of complementary VL or VH domains, respectively. (See, e.g., Portolano et al., J. Immunol. 150:880-887 (1993); Clarkson et al., Nature 352:624-628 (1991)). The four FWR regions are typically more conserved while CDR regions (CDR1, CDR2 and CDR3) represent hypervariable regions and are arranged from NH2 terminus to the COOH terminus as follows: FWR1, CDR1, FWR2, CDR2, FWR3, CDR3, and FWR4. The variable regions of the heavy and light chains contain a binding domain that interacts with an antigen while, depending of the isotype, the constant region(s) may mediate the binding of the immunoglobulin to host tissues or factors. An antibody also includes chimeric antibodies, humanized antibodies, and recombinant antibodies, human antibodies generated from a transgenic non-human animal, as well as antibodies selected from libraries using enrichment technologies available to the artisan.

The term "antibody heavy chain," refers to the larger of the two types of polypeptide chains present in antibody molecules in their naturally occurring conformations, and which normally determines the class to which the antibody belongs.

The term "antibody light chain," refers to the smaller of the two types of polypeptide chains present in antibody molecules in their naturally occurring conformations. Kappa ("κ") and lambda ("λ") light chains refer to the two major antibody light chain isotypes.

An antibody or antigen-binding fragment thereof "specifically binds" or "preferentially binds" to a target if it binds with greater affinity and/or avidity than it binds to epitopes on unrelated polypeptides. The specificity of an antibody or antigen-binding fragment or portion thereof can be determined based on affinity and/or avidity. Methods to determine such specific binding are also well known in the art. According to certain embodiments of the present disclosure, the antibodies or antigen-binding fragment thereof can bind to a human cancer antigen but not to a cancer antigen from other species. Alternatively, the antibodies or antigen-binding fragment thereof, in certain embodiments, bind to human cancer antigen and to cancer antigen from one or more non-human species. For example, the antibodies or antigen-binding fragment thereof can bind to human cancer antigen and can bind or not bind, as the case may be, to one or more of mouse, rat, guinea pig, hamster, gerbil, pig, cat, dog, rabbit, goat, sheep, cow, horse, camel, cynomologous, marmoset, rhesus or chimpanzee cancer antigen.

The affinity, represented by the equilibrium constant for the dissociation ($K_D$) of an antigen with an antigen-binding protein, is a measure for the binding strength between an antigenic determinant and an antigen-binding site on the antigen-binding protein: the lesser the value of the $K_D$, the stronger the binding strength between an antigenic determinant and the antigen-binding molecule. Alternatively, the affinity can also be expressed as the affinity constant ($K_A$), which is $1/K_D$. Unless indicated otherwise, as used herein, "binding affinity" refers to intrinsic binding affinity which reflects a 1:1 interaction between members of a binding pair (e.g., antibody and antigen). As will be clear to the skilled person, affinity can be determined in a manner known per se, depending on the specific antigen of interest. Accordingly, an antibody or antigen-binding fragment thereof as defined herein is said to be "specific for" a first target or antigen compared to a second target or antigen when it binds to the first antigen with an affinity (as described above, and suitably expressed, for example as a $K_D$ value) that is at least 50 times, such as at least 100 times, and preferably at least 1000 times, and up to 10,000 times or more better than the affinity with which said amino acid sequence or polypeptide binds to another target or polypeptide. Preferably, when an antibody or antigen-binding fragment thereof is "specific for" a target or antigen, compared to another target or antigen, it can bind the target or antigen, but does not bind the other target or antigen. However, as understood by one of ordinary skill in the art, in some embodiments, where a binding site on a target is shared or partially shared by multiple, different ligands, an antibody or antigen-binding fragment thereof can specifically bind to a target, such as cancer associated antigen, and have the functional effect of, for example, inhibiting/preventing tumor progression.

In some embodiments, an antibody provided herein has a dissociation constant ($K_D$) of about 1 μM, 100 nM, 10 nM, 5 nM, 2 nM, 1 nM, 0.5 nM, 0.1 nM, 0.05 nM, 0.01 nM, or 0.001 nM or less (e.g., $10^{-8}$ M or less, e.g., from $10^{-8}$ M to $10^{-13}$ M, e.g., from $10^{-9}$ M to $10^{-13}$ M). Another aspect of the invention provides for an antibody or antigen-binding fragment thereof with an increased affinity for its target, for example, an affinity matured antibody. An affinity matured antibody is an antibody with one or more alterations in one or more hypervariable regions (HVRs), compared to a parent antibody which does not possess such alterations, such alterations resulting in an improvement in the affinity of the antibody for antigen. These antibodies can bind to antigen with a $K_D$ of about $5 \times 10^{-9}$ M, $2 \times 10^{-9}$ M, $1 \times 10^{-9}$ M, $5 \times 10^{-9}$ M, $2 \times 10^{-9}$ M, $1 \times 10^{-10}$ M, $5 \times 10^{-11}$ M, $1 \times 10^{-11}$ M, $5 \times 10^{-12}$ M, $1 \times 10^{-12}$ M, or less. In some embodiments, the present disclosure provides an antibody or antigen-binding fragment thereof which has an increased affinity of at least 1.5 fold, 2 fold, 2.5 fold, 3 fold, 4 fold, 5 fold, 10 fold, 20 fold or greater as compared to a germline antibody containing the heavy chain sequence and light chain sequence, or both. In other embodiments, an antibody is provided that competes for binding to the same epitope as an antibody as described herein. In some embodiments, the antibody or antigen-binding fragment thereof that binds to the same epitope, and/or competes for binding to the same epitope as an antibody exhibits effector function activities, such as, for example, Fc-mediated cellular cytotoxicity, including ADCC activity.

KD can be measured by any suitable assay. For example, KD can be measured by a radiolabeled antigen-binding assay (RIA) (See, e.g., Chen et al., J. Mol. Biol. 293:865-881 (1999); Presta et al., Cancer Res. 57:4593-4599 (1997)). For example, KD can be measured using a surface plasmon resonance assay (e.g., using a BIACORE®-2000 or a BIACORE®-3000). For example, KD can be measured using a competitive ELISA.

Avidity is the measure of the strength of binding between an antigen-binding molecule and the pertinent antigen. Avidity is related to both the affinity between an antigenic determinant and its antigen binding site on the antigen-binding molecule, and the number of pertinent binding sites present on the antigen-binding molecule. Typically, antigen-binding proteins will bind to their cognate or specific antigen with a dissociation constant ($K_D$ of $10^{-5}$ to $10^{12}$ moles/liter or less, and preferably $10^{-7}$ to $10^{-12}$ moles/liter or less and more preferably 10–8 to 10–12 moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles). Any $K_D$ value greater than $10^{-4}$ mol/liter (or any KA value lower than 104 $M^{-1}$) is generally considered to indicate non-specific binding. The $K_D$ for biological interactions which are considered meaningful (e.g., specific) are typically in the range of $10^{-10}$ M (0.1 nM) to $10^{-5}$ M (10000 nM). The stronger an interaction is, the lower is its $K_D$. Preferably, a binding site on an anti-LAP antibody or antigen-binding fragment thereof described herein will bind with an affinity less than 500 nM, preferably less than 200 nM, more preferably less than 10 nM, such as less than 500 pM. Specific binding of an antigen-binding protein to an antigen or antigenic determinant can be determined in any suitable manner known per se, including, for example, Scatchard analysis and/or competitive binding assays, such as radioimmunoassays (RIA), enzyme immunoassays (EIA) and sandwich competition assays, and the different variants thereof known per se in the art; as well as other techniques as mentioned herein.

The term "kon", as used herein, is intended to refer to the rate constant for association of an antibody or antigen-binding fragment thereof to an antigen.

The term "Koff", as used herein, is intended to refer to the rate constant for dissociation of an antibody or antigen-binding fragment thereof from the antibody/antigen complex.

In the context of an antibody or antigen-binding fragment thereof, the term "specificity" or "specific for" refers to the number of different types of antigens or antigenic determinants to which a particular antibody or antigen-binding fragment thereof can bind. The specificity of an antibody or antigen-binding fragment or portion thereof can be determined based on affinity and/or avidity. The affinity, represented by the equilibrium constant for the dissociation (KD) of an antigen with an antigen-binding protein, is a measure for the binding strength between an antigenic determinant and an antigen-binding site on the antigen-binding protein: the lesser the value of the KD, the stronger the binding strength between an antigenic determinant and the antigen-binding molecule. Alternatively, the affinity can also be expressed as the affinity constant (KA), which is 1/KD). As will be clear to the skilled person, affinity can be determined in a manner known per se, depending on the specific antigen of interest. Accordingly, an antibody or antigen-binding fragment thereof as defined herein is said to be "specific for" a first target or antigen compared to a second target or antigen when it binds to the first antigen with an affinity (as described above, and suitably expressed, for example as a KD value) that is at least 50 times, such as at least 100 times, and preferably at least 1000 times, and up to 10,000 times or more better than the affinity with which said amino acid sequence or polypeptide binds to another target or polypeptide. Preferably, when an antibody or antigen-binding fragment thereof is "specific for" a target or antigen, compared to another target or antigen, it can bind the target or antigen, but does not bind the other target or antigen.

However, as understood by one of ordinary skill in the art, in some embodiments, where a binding site on a target is shared or partially shared by multiple, different ligands, an antibody or antigen binding fragment thereof can specifically bind to a target, such as cancer associated antigen, and have the functional effect of, for example, inhibiting/preventing tumor progression.

The term "fusion protein" as used herein refers to a polypeptide that comprises an amino acid sequence of an antibody or fragment thereof and an amino acid sequence of a heterologous polypeptide (i.e., an unrelated polypeptide).

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

In some embodiments, the antibody or antigen binding fragment thereof of the present disclosure is a single domain antibody. The expression "single domain antibody" (sdAbs) or "single variable domain (SVD) antibody" generally refers to a single variable region (VH or ') wherein the antibody-antigen binding can be imparted. In other words, single variable domain does not need to recognize the target antigen by interacting with another variable region. A single domain antibody monomers single arm antigen binding by each antibody variable region (VH*VJ composition. Examples of single domain antibodies include those derived from camelids (camels and llamas) and cartilaginous fish (e.g. nurse sharks) antibodies and those antibodies (Ward et al from human and mouse antibodies by recombinant methods, Nature (1989) 341: 544-546; Dooley and Flajnik, Dev Comp Immunol (2006) 30: 43-56; Muyldermans et, Trend-Biochem Sci (2001) 26: 230-235; Holt et, Trends Biotechnol (2003): 21: 484-490; WO 2005/035572; TO 03/035694; Davies and Riechmann, Febs Lett (1994) 339: 285-290; W000/29 004; W0 02/051870) and a single variable region of an antibody can be other than a single domain antibody variable regions or variable domains are present in an antigen binding arm (e.g., homo- or hetero-multimer together).

Monoclonal Antibodies

A monoclonal antibody is obtained from a population of substantially homogeneous antibodies, i.e., the individual antibodies comprising the population are identical except for possible naturally occurring mutations that may be present in minor amounts.

In some embodiments, the antibodies of the present disclosure are monoclonal. Monoclonal antibodies may be made using the hybridoma method first described by Kohler et al., Nature, 256:495 (1975), or may be made by recombinant DNA methods.

In the hybridoma method, a mouse or other appropriate host animal, such as a hamster or macaque monkey, is immunized as herein described to elicit lymphocytes that produce or are capable of producing antibodies that will specifically bind to the protein used for immunization. Alternatively, lymphocytes may be immunized in vitro. Lymphocytes then are fused with myeloma cells using a suitable fusing agent, such as polyethylene glycol, to form a hybridoma cell (Goding, Monoclonal Antibodies: Principles and Practice, pp. 59-103 (Academic Press, 1986)).

The hybridoma cells thus prepared are seeded and grown in a suitable culture medium that preferably contains one or more substances that inhibit the growth or survival of the unfused, parental myeloma cells. For example, if the parental myeloma cells lack the enzyme hypoxanthine guanine phosphoribosyl transferase (HGPRT or HPRT), the culture medium for the hybridomas typically will include hypoxanthine, aminopterin, and thymidine (HAT medium), which substances prevent the growth of HGPRT-deficient cells. Preferred myeloma cells are those that fuse efficiently, support stable high-level production of antibody by the selected antibody-producing cells, and are sensitive to a medium. Human myeloma and mouse-human heteromyeloma cell lines also have been described for the production of human monoclonal antibodies (Kozbor, J. Immunol., 133: 3001 (1984); Brodeur et al., Monoclonal Antibody Production Techniques and Applications, pp. 51-63 (Marcel Dekker, Inc., New York, 1987)). Exemplary murine myeloma lines include those derived from MOP-21 and M.C.-11 mouse tumors available from the Salk Institute Cell Distribution Center, San Diego, Calif. USA, and SP-2 or X63-Ag8-653 cells available from the American Type Culture Collection, Rockville, Md. USA. Culture medium in which hybridoma cells are growing is assayed for production of monoclonal antibodies directed against the antigen. Accordingly, in one aspect the present disclosure provides a hybridoma producing the antibody or antigen-binding fragment thereof, described herein. Preferably, the binding specificity of monoclonal antibodies produced by hybridoma cells is determined by immunoprecipitation or by an in vitro binding assay, such as radioimmunoassay (RIA) or enzyme-linked immunoabsorbent assay (ELISA). The binding affinity of the monoclonal antibody can, for example, be determined by Scatchard analysis (Munson et al., Anal. Biochem., 107:220 (1980)).

After hybridoma cells are identified that produce antibodies of the desired specificity, affinity, and/or activity, the clones may be subcloned by limiting dilution procedures and grown by standard methods (Goding, Monoclonal Antibodies: Principles and Practice, pp. 59-103 (Academic Press, 1986)). Suitable culture media for this purpose include, for example, D-MEM or RPMI-1640 medium. In addition, the hybridoma cells may be grown in vivo as ascites tumors in an animal. The monoclonal antibodies secreted by the subclones are suitably separated from the culture medium, ascites fluid, or serum by conventional immunoglobulin purification procedures such as, for example, protein A-Sepharose, hydroxylapatite chromatography, gel electrophoresis, dialysis, or affinity chromatography.

Chimeric Antibodies

In some embodiments, an antibody provided herein is a chimeric. A chimeric antibody is an antibody in which a portion of the heavy and/or light chain is derived from a particular source or species, while the remainder of the heavy and/or light chain is derived from a different source or species. In one example, a chimeric antibody comprises a non-human variable region (e.g., a variable region derived from a mouse, rat, hamster, rabbit, or non-human primate, such as a monkey) and a human constant region. In a further example, a chimeric antibody is a "class switched" antibody in which the class or subclass has been changed from that of the parent antibody. Chimeric antibodies include antigen-binding fragments thereof. For details, see, for example, Jones et al., Nature 321: 522-525 (1986); Reichmann et al., Nature 332: 323-329 (1988); Presta, Curr. Op. Struct. Biol., 2: 593-596 (1992); and Morrison et al., Proc. Natl. Acad. Sci. USA, 81:6851-6855 (1984).

Humanized Antibodies

In some embodiments, an antibody provided herein is a humanized antibody. In one embodiment, a humanized antibody is an antibody comprising amino acid residues from non-human HVRs and amino acid residues from human FRs. In certain embodiments, a humanized antibody will comprise substantially all of at least one, and typically two, variable domains, in which all or substantially all of the HVRs (e.g., CDRs) correspond to those of a non-human antibody, and all or substantially all of the FRs correspond to those of a human antibody. A humanized antibody optionally may comprise at least a portion of an antibody constant region derived from a human antibody. See, e.g., Almagro and Fransson, Front. Biosci. 13:1619-1633 (2008); Riechmann et al., Nature 332:323-329 (1988); Queen et al., Proc. Nat'l Acad. Sci. USA 86:10029-10033 (1989); Kashmiri et al., Methods 36:25-34 (2005); Padlan, Mol. Immunol. 28:489-498 (1991); Dall'Acqua et al., Methods 36:43-60 (2005); Osbourn et al., Methods 36:61-68 (2005); and Klimka et al., Br. J. Cancer, 83:252-260 (2000).

A non-human antibody can be humanized to reduce immunogenicity to humans, while retaining the specificity and affinity of the parental non-human antibody. A humanized antibody can comprise one or more variable domains comprising one or more CDRs, or portions thereof, derived from a non-human antibody. A humanized antibody can comprise one or more variable domains comprising one or more FRs, or portions thereof, derived from human antibody sequences. A humanized antibody can optionally comprise at least a portion of a human constant region. In some embodiments, one or more FR residues in a humanized antibody are substituted with corresponding residues from a non-human antibody (e.g., the antibody from which the CDR residues are derived), e.g., to restore or improve antibody specificity or affinity. Human framework regions that may be used for humanization include but are not limited to: framework regions selected using a "best-fit" method; framework regions derived from the consensus sequence of human antibodies of a particular subgroup of light or heavy chain variable regions; human mature (somatically mutated) framework regions or human germline framework regions; and framework regions derived from screening FR libraries (See, e.g., Sims et al., J. Immunol. 151:2296 (1993); Carter et al. Proc. Natl. Acad. Sci. USA, 89:4285 (1992); Presta et al., J. Immunol., 151:2623 (1993); Baca et al., J. Biol. Chem. 272:10678-10684 (1997); and Rosok et al., J. Biol. Chem. 271:22611-22618 (1996)).

Human Antibodies

In some embodiments, an antibody provided herein is a human antibody. Human antibodies can be produced using various techniques known in the art (See, e.g., van Dijk and van de Winkel, Curr. Opin. Pharmacol. 5: 368-74 (2001); and Lonberg, Curr. Opin. Immunol. 20:450-459 (2008)). A human antibody is one which possesses an amino acid sequence which corresponds to that of an antibody produced by a human or a human cell or derived from a non-human source that utilizes human antibody repertoires or other human antibody-encoding sequences. This definition of a human antibody specifically excludes a humanized antibody comprising non-human antigen-binding residues. Human antibodies may be prepared by administering an immunogen (e.g., a cancer cell antigen) to a transgenic animal that has been modified to produce intact human antibodies or intact antibodies with human variable regions in response to antigenic challenge. (See, e.g., Lonberg, Nat. Biotech. 23:1117-1125 (2005)). Human variable regions from intact antibodies generated by such animals may be further modified, e.g., by combining with a different human constant region. Human antibodies can also be made by hybridoma-based methods. For example, human antibodies can be produced from human myeloma and mouse-human heteromyeloma cell lines, using human B-cell hybridoma technology, and other methods (See, e.g., Kozbor J. Immunol., 133: 3001 (1984); Brodeur et al., Monoclonal Antibody Production Techniques and Applications, pp. 51-63 (1987); Boerner et al., J. Immunol., 147: 86 (1991); Li et al., Proc. Natl. Acad. USA, 103:3557-3562 (2006); Ni, Xiandai Mianyixue, 26(4):265-268 (2006); Vollmers and Brandlein, Histology and Histopathology, 20(3):927-937 (2005); and Vollmers and Brandlein, Methods and Findings in Experimental and Clinical Pharmacology, 27(3):185-91 (2005)). Human antibodies may also be generated by isolating Fv clone variable domain sequences selected from human-derived phage display libraries. Such variable domain sequences may then be combined with a desired human constant domain.

Deimmunized Antibodies

An antibody or an antigen-binding fragment thereof described herein can be optionally assessed for immunogenicity and, as needed, be deimmunized (i.e., the antibody is made less immunoreactive by altering one or more T cell epitopes). As used herein, a "deimmunized antibody" means that one or more T cell epitopes in an antibody sequence have been modified such that a T cell response after administration of the antibody to a subject is reduced compared to an antibody that has not been deimmunized, yet the antibody retains its binding activity. Analysis of immunogenicity and T-cell epitopes present in the antibodies and antigen-binding fragments described herein can be carried out via the use of software and specific databases known in the art. Exemplary software and databases include iTope™ developed by Antitope of Cambridge, England. iTope™, is an in silico technology for analysis of peptide binding to human MHC class II alleles. The iTope™ software predicts peptide binding to human MHC class II alleles and thereby provides an initial screen for the location of such "potential T cell epitopes." iTope™ software predicts favorable interactions between amino acid side chains of a peptide and specific binding pockets within the binding grooves of 34 human MHC class II alleles. The location of key binding residues is achieved by the in silico generation of 9mer peptides that overlap by one amino acid spanning the test antibody variable region sequence. Each 9mer peptide can be tested against each of the 34 MHC class II allotypes and scored based on their potential "fit" and interactions with the MHC class II binding groove. Peptides that produce a high mean binding score (>0.55 in the iTope™ scoring function) against >50% of the MHC class II alleles are considered as potential T cell epitopes. In such regions, the core 9 amino acid sequence for peptide binding within the MHC class II groove is analyzed to determine the MHC class II pocket residues (P1, P4, P6, P7 and P9) and the possible T cell receptor (TCR) contact residues (P-1, P2, P3, P5, P8). After identification of any T-cell epitopes, amino acid residue changes, substitutions, additions, and/or deletions can be introduced to remove the identified T-cell epitope. Such changes can be made so as to preserve antibody structure and function while still removing the identified epitope. Exemplary changes can include, but are not limited to, conservative amino acid changes.

Engineered and Modified Antibodies

An antibody according to at least some embodiments of the invention further can be prepared using an antibody having one or more of the VH and/or VL sequences derived from an antibody or antigen-binding fragment thereof, disclosed herein, starting material to engineer a modified antibody, which modified antibody may have altered properties from the starting antibody. Provided herein are complete reconstructed amino acid and nucleic acid consensus sequences of VH and VL chain regions of antibodies disclosed herein. Also provided herein, are the amino acid and nucleic acid sequences of the CDR3 regions of the VH and VL of the antibodies, described herein. An antibody can be engineered by modifying one or more residues within one or both variable regions (i.e., VH and/or VL), for example within one or more CDR regions and/or within one or more framework regions. Additionally or alternatively, an antibody can be engineered by modifying residues within the constant regions, for example to alter the effector functions of the antibody.

One type of variable region engineering that can be performed is CDR grafting. Antibodies interact with target antigens predominantly through amino acid residues that are located in the six heavy and light chain complementarity determining regions (CDRs). For this reason, the amino acid sequences within CDRs are more diverse between individual antibodies than sequences outside of CDRs. Because CDR sequences are responsible for most antibody-antigen interactions, it is possible to express recombinant antibodies that mimic the properties of specific antibodies by constructing expression vectors that include CDR sequences from the specific antibody (e.g., antibodies disclosed herein) grafted onto framework sequences from a different antibody with different properties (see, e.g., Riechmann, L. et al. (1998) Nature 332:323-327; Jones, P. et al. (1986) Nature 321:522-525; Queen, C. et al. (1989) Proc. Natl. Acad. See. U.S.A. 86:10029-10033; U.S. Pat. No. 5,225,539 to Winter, and U.S. Pat. Nos. 5,530,101; 5,585,089; 5,693,762 and 6,180,370 to Queen et al.)

Suitable framework sequences can be obtained from public DNA databases or published references that include germline antibody gene sequences. For example, germline DNA sequences for human heavy and light chain variable region genes can be found in the "VBase" human germline sequence database (available on the Internet), as well as in Kabat, E. A., et al. (1991) Sequences of Proteins of Immunological Interest, Fifth Edition, U.S. Department of Health and Human Services, NIH Publication No. 91-3242; Tomlinson, I. M., et al. (1992) "The Repertoire of Human Germline VH Sequences Reveals about Fifty Groups of VH Segments with Different Hypervariable Loops" J. Mol. Biol. 227:776-798; and Cox, J. P. L. et al. (1994) "A Directory of Human Germ-line VH Segments Reveals a Strong Bias in their Usage" Eur. J. Immunol. 24:827-836; the contents of each of which are expressly incorporated herein by reference. Another type of variable region modification is to mutate amino acid residues within the VH and/or VL CDR 1, CDR2 and/or CDR3 regions to thereby improve one or more binding properties (e.g., affinity) of the antibody of interest. Site-directed mutagenesis or PCR-mediated mutagenesis can be performed to introduce the mutations and the effect on antibody binding, or other functional property of interest, can be evaluated in appropriate in vitro or in vivo assays. Preferably conservative modifications (as discussed above) are introduced. The mutations may be amino acid substitutions, additions or deletions, but are preferably substitutions. Moreover, typically no more than one, two, three, four or five residues within a CDR region are altered.

Engineered antibodies according to at least some embodiments of the invention include those in which modifications have been made to framework residues within VH and/or VL, e.g. to improve the properties of the antibody. Typically such framework modifications are made to decrease the immunogenicity of the antibody. For example, one approach is to "backmutate" one or more framework residues to the corresponding germline sequence. More specifically, an antibody that has undergone somatic mutation may contain framework residues that differ from the germline sequence from which the antibody is derived. Such residues can be identified by comparing the antibody framework sequences to the germline sequences from which the antibody is derived.

In addition or alternative to modifications made within the framework or CDR regions, antibodies according to at least some embodiments of the disclosure may be engineered to include modifications within the Fc region, typically to alter one or more functional properties of the antibody, such as serum half-life, complement fixation, Fc receptor binding, and/or antigen-dependent cellular cytotoxicity. Furthermore, an antibody according to at least some embodiments of the invention may be chemically modified (e.g., one or more chemical moieties can be attached to the antibody) or be modified to alter its glycosylation, again to alter one or more functional properties of the antibody. Such embodiments are described above. The numbering of residues in the Fc region is that of the EU index of Kabat.

In one embodiment, the hinge region of CH1 is modified such that the number of cysteine residues in the hinge region is altered, e.g., increased or decreased. This approach is described further in U.S. Pat. No. 5,677,425 by Bodmer et al. The number of cysteine residues in the hinge region of CH1 is altered to, for example, facilitate assembly of the light and heavy chains or to increase or decrease the stability of the antibody. In another embodiment, the Fc hinge region of an antibody is mutated to decrease the biological half-life of the antibody. More specifically, one or more amino acid mutations are introduced into the CH2-CH3 domain interface region of the Fc-hinge fragment such that the antibody has impaired Staphylococcyl protein A (SpA) binding relative to native Fc-hinge domain SpA binding. This approach is described in further detail in U.S. Pat. No. 6,165,745 by Ward et al.

In another embodiment, the antibody is modified to increase its biological half-life. Various approaches are possible. For example, to increase the biological half-life, the antibody can be altered within the CH1 or CL region to contain a salvage receptor binding epitope taken from two loops of a CH2 domain of an Fc region of an IgG, as described in U.S. Pat. Nos. 5,869,046 and 6,121,022 by Presta et al.

Recombinant Human Antibodies

The term "recombinant human antibody", as used herein, includes all human antibodies that are prepared, expressed, created or isolated by recombinant means, such as (a) antibodies isolated from an animal (e.g., a mouse) that is transgenic or transchromosomal for human immunoglobulin genes or a hybridoma prepared therefrom (described further below), (b) antibodies isolated from a host cell transformed to express the human antibody, e.g., from a transfectoma, (c) antibodies isolated from a recombinant, combinatorial human antibody library, and (d) antibodies prepared, expressed, created or isolated by any other means that involve splicing of human immunoglobulin gene sequences to other DNA sequences. Such recombinant human antibodies have variable regions in which the framework and CDR regions are derived from reconstructed immunoglobulin consensus sequences, disclosed herein. In certain embodiments, however, such recombinant human antibodies can be subjected to in vitro mutagenesis (or, when an animal transgenic for human Ig sequences is used, in vivo somatic mutagenesis) and thus the amino acid sequences of the VH and VL regions of the recombinant antibodies are sequences that, while derived from and related to human immunoglobulin VH and VL sequences, may not naturally exist within the human antibody germline repertoire in vivo.

Antigen-Binding Fragments

The terms "antibody fragment," "antigen-binding fragment," or "antibody binding domain" refer to at least one portion of an antibody, or recombinant variants thereof, that contains the antigen-binding domain, i.e., an antigenic determining variable region of an intact antibody, that is sufficient to confer recognition and specific binding of the antibody fragment to a target, such as an antigen and its defined epitope. Examples of antigen-binding fragments include, but are not limited to, Fab, Fab', F(ab')2, and Fv fragments, single-chain (sc)Fv ("scFv") antibody fragments, linear antibodies, single domain antibodies such as sdAb (either VL or VH), camelid VHH domains, and multi-specific antibodies formed from antibody fragments. Antibody fragments can be made by various techniques, including but not limited to proteolytic digestion of an intact antibody as well as production by recombinant host cells (e.g., E. coli or phage), as described herein.

An Fv is the minimum antibody fragment that contains a complete antigen-recognition and antigen-binding site. This fragment contains a dimer of one heavy- and one light-chain variable region domain in tight, non-covalent association. From the folding of these two domains emanate six hypervariable loops (three loops each from the H and L chain) that contribute the amino acid residues for antigen-binding and confer antigen-binding specificity to the antibody. However, even a single variable region (or half of an Fv comprising only three CDRs specific for an antigen) has the ability to recognize and bind antigen, although at a lower affinity than the entire binding site.

The term "scFv" refers to a fusion protein comprising at least one antibody fragment comprising a variable region of a light chain and at least one antibody fragment comprising a variable region of a heavy chain, wherein the light and heavy chain variable regions are contiguously linked via a short flexible polypeptide linker, and capable of being expressed as a single polypeptide chain, and wherein the scFv retains the specificity of the intact antibody from which it is derived. Unless specified, as used herein a scFv may have the VL and VH variable regions in either order, e.g., with respect to the N-terminal and C-terminal ends of the polypeptide, the scFv may comprise VL-linker-VH or may comprise VH-linker-VL.

A diabody is a small antibody fragment prepared by constructing a sFv fragment with a short linker (about 5-10 residues) between the VH and VL domains such that interchain but not intra-chain pairing of the V domains is achieved, resulting in a bivalent fragment. Bispecific diabodies are heterodimers of two crossover sFv fragments in which the VH and VL domains of the two antibodies are present on different polypeptide chains. (See, e.g., Hollinger et al., Proc. Natl. Acad. Sci. USA, 90:6444-6448 (1993)).

Domain antibodies (dAbs), which can be produced in fully human form, are the smallest known antigen-binding fragments of antibodies, ranging from about 11 kDa to about 15 kDa. DAbs are the robust variable regions of the heavy and light chains of immunoglobulins (VH and VL, respectively). They are highly expressed in microbial cell culture, show favorable biophysical properties including, for example, but not limited to, solubility and temperature stability, and are well suited to selection and affinity maturation by in vitro selection systems such as, for example, phage display. DAbs are bioactive as monomers and, owing to their small size and inherent stability can be formatted into larger molecules to create drugs with prolonged serum half-lives or other pharmacological activities.

Fv and sFv are the only species with intact combining sites that are devoid of constant regions. Thus, they are suitable for reduced nonspecific binding during in vivo use. sFv fusion proteins can be constructed to yield fusion of an effector protein at either the amino or the carboxy terminus of an sFv. The antibody fragment also can be a "linear antibody. Such linear antibody fragments can be monospecific or bispecific.

Multispecific Antibodies and Antigen-Binding Fragments

In some embodiments, an antibody provided herein is a multispecific antibody, e.g., a bispecific antibody. Multispecific antibodies are monoclonal antibodies that have binding specificities for at least two different sites. In some embodiments, one of the binding specificities is for cancer associated antigen and the other is for any other antigen. In some embodiments, bispecific antibodies may bind to two different epitopes of antigen. Bispecific antibodies may also be used to localize cytotoxic agents to cancer cells. Bispecific antibodies can be prepared as full length antibodies or antibody fragments.

In some embodiments, it may be desirable to generate multispecific (e.g. bispecific) monoclonal antibody including monoclonal, human, humanized, or variant antibodies having binding specificities for at least two different epitopes. In some embodiments, the antibodies disclosed herein are multispecific. Exemplary bispecific antibodies may bind to two different epitopes of an antigen (e.g., cancer associated antigen). Alternatively, an antigen-binding region may be combined with a region which binds to a triggering molecule on a leukocyte such as a T-cell receptor molecule (e.g., CD2 or CD3), or Fc receptors for IgG (FcγR), such as FcγRI (CD64), FcγRII (CD32) and FcγRIII (CD16) so as to focus cellular defense mechanisms to the antigen-expressing cell. Bispecific antibodies may also be used to localize cytotoxic agents to cells which express desired antigen. These antibodies possess an antigen-binding arm and an arm which binds the cytotoxic agent (e.g., saporin, anti-interferon-60, vinca alkaloid, ricin A chain, methotrexate or radioactive isotope hapten). Bispecific antibodies can be prepared as full length antibodies or antibody fragments (e.g., F(ab')2 bispecific antibodies).

According to another approach for making bispecific antibodies, the interface between a pair of antibody molecules can be engineered to maximize the percentage of heterodimers which are recovered from recombinant cell culture. The preferred interface comprises at least a part of the CH3 domain of an antibody constant domain. In this method, one or more small amino acid side chains from the interface of the first antibody molecule are replaced with larger side chains (e.g., tyrosine or tryptophan). Compensatory "cavities" of identical or similar size to the large side chain(s) are created on the interface of the second antibody molecule by replacing large amino acid side chains with smaller ones (e.g., alanine or threonine). This provides a mechanism for increasing the yield of the heterodimer over other unwanted end-products such as homodimers.

Bispecific antibodies include cross-linked or "heteroconjugate" antibodies. For example, one of the antibodies in the heteroconjugate can be coupled to avidin, the other to biotin. Heteroconjugate antibodies may be made using any convenient cross-linking methods. Suitable cross-linking agents are contemplated, along with a number of cross-linking techniques.

Techniques for generating bispecific antibodies from antibody fragments have also been described in the literature. For example, bispecific antibodies can be prepared using chemical linkage. Brennan et al., Science 229: 81 (1985) describe a procedure wherein intact antibodies are proteolytically cleaved to generate F(ab')2 fragments. These fragments are reduced in the presence of the dithiol complexing agent sodium arsenite to stabilize vicinal dithiols and prevent intermolecular disulfide formation. The Fab' fragments generated are then converted to thionitrobenzoate (TNB) derivatives. One of the Fab'-TNB derivatives is then reconverted to the Fab'-thiol by reduction with mercaptoethylamine and is mixed with an equimolar amount of the other Fab'-TNB derivative to form the bispecific antibody. The bispecific antibodies produced can be used as agents for the selective immobilization of enzymes. In yet a further embodiment, Fab'-SH fragments directly recovered from *E. coli* can be chemically coupled in vitro to form bispecific antibodies. (Shalaby et al., J. Exp. Med. 175:217-225 (1992))

Exemplary techniques for making multispecific antibodies include recombinant co-expression of two immunoglobulin heavy chain-light chain pairs having different specificities, engineering electrostatic steering effects for making antibody Fc-heterodimeric molecules, cross-linking two or more antibodies or fragments, using leucine zippers to produce bi-specific antibodies, using "diabody" technology for making bispecific antibody fragments, using single-chain Fv (sFv) dimers, preparing trispecific antibodies, and "knob-in-hole" engineering (See, e.g., Milstein and Cuello, Nature 305: 537 (1983); Traunecker et al., EMBO J., 10: 3655 (1991); U.S. Pat. Nos. 4,676,980 and 5,731,168; Brennan et al., Science, 229: 81 (1985); Kostelny et al., J. Immunol., 148(5):1547-1553 (1992); Hollinger et al., Proc. Natl. Acad. Sci. USA, 90:6444-6448 (1993); Gruber et al., J. Immunol., 152:5368 (1994)); and Tutt et al. J. Immunol. 147: 60 (1991)). Engineered antibodies with three or more functional antigen-binding sites are also contemplated.

Variants and Modifications

In another aspect, provided herein are variants of antibodies or antigen-binding fragments thereof.

Substitution, Insertion, and Deletion Variants

In some embodiments, amino acid sequence variants of the antibodies provided herein are contemplated. A variant typically differs from a polypeptide specifically disclosed herein in one or more substitutions, deletions, additions and/or insertions. Such variants can be naturally-occurring or can be synthetically generated, for example, by modifying one or more of the above polypeptide sequences of the invention and evaluating one or more biological activities of the polypeptide as described herein and/or using any of a number of techniques well known in the art. For example, it may be desirable to improve the binding affinity and/or other biological properties of the antibody amino acid sequence variants of an antibody may be prepared by introducing appropriate modifications into the nucleotide sequence encoding the antibody, or by peptide synthesis. Such modifications include, for example, deletions from, and/or insertions into and/or substitutions of residues within the amino acid sequences of the antibody. Any combination of deletion, insertion, and substitution can be made to arrive at the final construct, provided that the final construct possesses the desired characteristics, e.g., antigen-binding.

In some embodiments, antibody variants or antigen-binding fragment thereof having one or more amino acid substitutions are provided. Sites of interest for mutagenesis by substitution include the CDRs and FRs. Amino acid substitutions may be introduced into an antibody of interest and the products screened for a desired activity, e.g., retained/improved antigen binding, decreased immunogenicity, or improved ADCC or CDC function.

| Original Residue | Exemplary Conserved Substitutions |
|---|---|
| Ala (A) | Val; Leu; Ile |
| Arg (R) | Lys; Gln; Asn |
| Asn (N) | Gln; His; Asp, Lys; Arg |
| Asp (D) | Glu; Asn |
| Cys (C) | Ser; Ala |
| Gln (Q) | Asn; Glu |
| Glu (E) | Asp; Gln |
| Gly (G) | Ala |
| His (H) | Asn; Gln; Lys; Arg |
| Ile (I) | Leu; Val; Met; Ala; Phe; Norleucine |
| Leu (L) | Norleucine; Ile; Val; Met; Ala; Phe |
| Lys (K) | Arg; Gln; Asn |
| Met (M) | Leu; Phe; Ile |
| Phe (F) | Trp; Leu; Val; Ile; Ala; Tyr |

| Original Residue | Exemplary Conserved Substitutions |
| --- | --- |
| Pro (P) | Ala |
| Ser (S) | Thr |
| Thr (T) | Val; Ser |
| Trp (W) | Tyr; Phe |
| Tyr (Y) | Trp; Phe; Thr; Ser |
| Val (V) | Ile; Leu; Met; Phe; Ala; Norleucine |

Hydrophobic amino acids include: Norleucine, Met, Ala, Val, Leu, and Ile. Neutral hydrophilic amino acids include: Cys, Ser, Thr, Asn, and Gln. Acidic amino acids include: Asp and Glu. Basic amino acids include: His, Lys, and Arg. Amino acids with residues that influence chain orientation include: Gly and Pro. Aromatic amino acids include: Trp, Tyr, and Phe.

In some embodiments, substitutions, insertions, or deletions may occur within one or more CDRs, wherein the substitutions, insertions, or deletions do not substantially reduce antibody binding to antigen. For example, conservative substitutions that do not substantially reduce binding affinity may be made in CDRs. Such alterations may be outside of CDR "hotspots" or SDRs. In some embodiments of the variant VH and VL sequences, each CDR either is unaltered, or contains no more than one, two or three amino acid substitutions.

Alterations (e.g., substitutions) may be made in CDRs, e.g., to improve antibody affinity. Such alterations may be made in CDR encoding codons with a high mutation rate during somatic maturation (See, e.g., Chowdhury, Methods Mol. Biol. 207:179-196 (2008)), and the resulting variant can be tested for binding affinity. Affinity maturation (e.g., using error-prone PCR, chain shuffling, randomization of CDRs, or oligonucleotide-directed mutagenesis) can be used to improve antibody affinity (See, e.g., Hoogenboom et al. in Methods in Molecular Biology 178:1-37 (2001)). CDR residues involved in antigen-binding may be specifically identified, e.g., using alanine scanning mutagenesis or modeling (See, e.g., Cunningham and Wells, Science, 244:1081-1085 (1989)). CDR-H3 and CDR-L3 in particular are often targeted. Alternatively, or additionally, a crystal structure of an antigen-antibody complex to identify contact points between the antibody and antigen. Such contact residues and neighboring residues may be targeted or eliminated as candidates for substitution. Variants may be screened to determine whether they contain the desired properties.

Amino acid sequence insertions and deletions include amino- and/or carboxyl-terminal fusions ranging in length from one residue to polypeptides containing a hundred or more residues, as well as intrasequence insertions and deletions of single or multiple amino acid residues. Examples of terminal insertions include an antibody with an N-terminal methionyl residue. Other insertional variants of the antibody molecule include the fusion to a polypeptide which increases serum half-life of the antibody, for example, at the N-terminus or C-terminus. The term "epitope tagged" refers to the antibody fused to an epitope tag. The epitope tag polypeptide has enough residues to provide an epitope against which an antibody there against can be made, yet is short enough such that it does not interfere with activity of the antibody. The epitope tag preferably is sufficiently unique so that the antibody there against does not substantially cross-react with other epitopes. Suitable tag polypeptides generally have at least 6 amino acid residues and usually between about 8-50 amino acid residues (preferably between about 9-30 residues). Examples include the flu HA tag polypeptide and its antibody 12CA5 [Field et al., Mal. Cell. Biol. 8: 2159-2165 (1988)]; the c-myc tag and the 8F9, 3C7, 6E10, G4, B7 and 9E10 antibodies thereto [Evan et al., Mal. Cell. Biol. 5(12): 3610-3616 (1985)]; and the Herpes Simplex virus glycoprotein D (gD) tag and its antibody [Paborsky et al., Protein Engineering 3(6): 547-553 (1990)]. Other exemplary tags are a poly-histidine sequence, generally around six histidine residues, that permits isolation of a compound so labeled using nickel chelation. Other labels and tags, such as the FLAG® tag (Eastman Kodak, Rochester, N.Y.), well known and routinely used in the art, are embraced by the invention.

Other insertional variants of the antibody molecule include the fusion to the N- or C-terminus of the antibody to an enzyme (e.g., for ADEPT) or a polypeptide which increases the serum half-life of the antibody. Examples of intrasequence insertion variants of the antibody molecules include an insertion of 3 amino acids in the light chain. Examples of terminal deletions include an antibody with a deletion of 7 or less amino acids at an end of the light chain.

Glycosylation Variants

In some embodiments, the antibodies are altered to increase or decrease their glycosylation (e.g., by altering the amino acid sequence such that one or more glycosylation sites are created or removed). A carbohydrate attached to an Fc region of an antibody may be altered. Native antibodies from mammalian cells typically comprise a branched, biantennary oligosaccharide attached by an N-linkage to Asn297 of the CH2 domain of the Fc region (See, e.g., Wright et al. TIBTECH 15:26-32 (1997)). The oligosaccharide can be various carbohydrates, e.g., mannose, N-acetyl glucosamine (GlcNAc), galactose, sialic acid, fucose attached to a GlcNAc in the stem of the biantennary oligosaccharide structure. Modifications of the oligosaccharide in an antibody can be made, for example, to create antibody variants with certain improved properties. Antibody glycosylation variants can have improved ADCC and/or CDC function.

In some embodiments, antibody variants are provided having a carbohydrate structure that lacks fucose attached (directly or indirectly) to an Fc region. For example, the amount of fucose in such antibody may be from 1% to 80%, from 1% to 65%, from 5% to 65% or from 20% to 40%. The amount of fucose is determined by calculating the average amount of fucose within the sugar chain at Asn297, relative to the sum of all glycostructures attached to Asn297 (See, e.g., WO 08/077546). Asn297 refers to the asparagine residue located at about position 297 in the Fc region (Eu numbering of Fc region residues); however, Asn297 may also be located about ±3 amino acids upstream or downstream of position 297, i.e., between positions 294 and 300, due to minor sequence variations in antibodies. Such fucosylation variants can have improved ADCC function (See, e.g. Okazaki et al. J. Mol. Biol. 336:1239-1249 (2004); and Yamane-Ohnuki et al. Biotech. Bioeng. 87: 614 (2004)). Cell lines, e.g., knockout cell lines and methods of their use can be used to produce defucosylated antibodies, e.g., Lec13 CHO cells deficient in protein fucosylation and alpha-1,6-fucosyltransferase gene (FUT8) knockout CHO cells (See, e.g., Ripka et al. Arch. Biochem. Biophys. 249:533-545 (1986); Yamane-Ohnuki et al. Biotech. Bioeng. 87: 614 (2004); Kanda, Y. et al., Biotechnol. Bioeng., 94(4):680-688 (2006). Other antibody glycosylation variants are also contemplated.

In still another embodiment, the glycosylation of an antibody is modified. For example, an aglycosylated antibody can be made (i.e., the antibody lacks glycosylation). Glycosylation can be altered to, for example, increase the affinity of the antibody for antigen. Such carbohydrate modifications can be accomplished by, for example, altering one or more sites of glycosylation within the antibody sequence. For example, one or more amino acid substitutions can be made that result in elimination of one or more variable region framework glycosylation sites to thereby eliminate glycosylation at that site. Such aglycosylation may increase the affinity of the antibody for antigen. Such an approach is described in further detail in U.S. Pat. Nos. 5,714,350 and 6,350,861 by Co et al. Conservative substitutions involve replacing an amino acid with another member of its class. Non-conservative substitutions involve replacing a member of one of these classes with a member of another class.

Accordingly, the antibodies or antigen-binding fragment thereof of the present disclosure can be produced by a host cell with one or more of exogenous and/or high endogenous glycosyltransferase activities. Genes with glycosyltransferase activity include β(1,4)—N-acetylglucosaminyltransferase III (GnTIII), α-mannosidase II (ManII), β(1,4)-galactosyltransferase (GalT), β(1,2)—N-acetylglucosaminyltransferase I (GnTI), and β(1,2)—N-acetylglucosaminyltransferase II (GnTII). The glycotranferases can comprise a fusion comprising a Golgi localization domain (See, e.g., Lifely et al., Glycobiology 318:813-22 (1995); Schachter, Biochem. Cell Biol. 64:163-81 (1986)). In some embodiments, an antibody can be expressed in a host cell comprising a disrupted or deactivated glycosyltransferase gene. Accordingly, in some embodiments, the present disclosure is directed to a host cell comprising (a) an isolated nucleic acid comprising a sequence encoding a polypeptide having a glycosyltransferase activity; and (b) an isolated polynucleotide encoding an antibody or antigen-binding fragment thereof of the present disclosure. In a particular embodiment, the modified antibody produced by the host cell has an IgG constant region or a fragment thereof comprising the Fc region. In another particular embodiment the antibody is a humanized antibody or a fragment thereof comprising an Fc region. An isolated nucleic acid is a nucleic acid molecule that has been separated from a component of its natural environment. An isolated nucleic acid includes a nucleic acid molecule contained in cells that ordinarily contain the nucleic acid molecule, but the nucleic acid molecule is present extrachromosomally or at a chromosomal location that is different from its natural chromosomal location.

Antibodies with altered glycosylation produced by the host cells of the invention can exhibit increased Fc receptor binding affinity (e.g., increased binding to a Fcγ activating receptor, such as the FcγRIIIa receptor) and/or increased effector function. The increased effector function can be an increase in one or more of the following: increased antibody-dependent cellular cytotoxicity, increased antibody-dependent cellular phagocytosis (ADCP), increased cytokine secretion, increased immune-complex-mediated antigen uptake by antigen-presenting cells, increased Fc-mediated cellular cytotoxicity, increased binding to NK cells, increased binding to macrophages, increased binding to polymorphonuclear cells (PMNs), increased binding to monocytes, increased crosslinking of target-bound antibodies, increased direct signaling inducing apoptosis, increased dendritic cell maturation, and increased T cell priming. Accordingly, in one aspect, the present invention provides glycoforms of an antibody having increased effector function as compared to the antibody that has not been glyco-engineered. (See, e.g., Tang et al., J. Immunol. 179: 2815-2823 (2007)).

The present disclosure is also directed to a method for producing an antibody or antigen-binding fragment thereof, described herein having modified oligosaccharides, comprising (a) culturing a host cell engineered to express at least one nucleic acid encoding a polypeptide having glycosyltransferase activity under conditions which permit the production of an antibody according to the present disclosure, wherein said polypeptide having glycosyltransferase activity is expressed in an amount sufficient to modify the oligosaccharides in the Fc region of said antibody produced by said host cell; and (b) isolating said antibody. In another embodiment, there are two polypeptides having glycosyltransferase activity. The antibodies or antigen-binding fragment thereof produced by the methods of the present invention can have increased Fc receptor binding affinity and/or increased effector function. In some embodiments, the percentage of bisected N-linked oligosaccharides in the Fc region of the antibody is at least about 10% to about 100%, specifically at least about 50%, more specifically, at least about 60%, at least about 70%, at least about 80%, or at least about 90-95% of the total oligosaccharides. In yet another embodiment, the antibody produced by the methods of the invention has an increased proportion of nonfucosylated oligosaccharides in the Fc region as a result of the modification of its oligosaccharides by the methods of the present invention. In some embodiments, the percentage of nonfucosylated oligosaccharides is at least about 20% to about 100%, specifically at least about 50%, at least about 60% to about 70%, and more specifically, at least about 75%. The nonfucosylated oligosaccharides may be of the hybrid or complex type. In yet another embodiment, the antibody or antigen-binding fragment thereof produced by the methods of the invention has an increased proportion of bisected oligosaccharides in the Fc region as a result of the modification of its oligosaccharides by the methods of the present invention. In some embodiments, the percentage of bisected oligosaccharides is at least about 20% to about 100%, specifically at least about 50%, at least about 60% to about 70%, and more specifically, at least about 75%.

In another embodiment, the present invention is directed to an antibody or antigen-binding fragment thereof engineered to have increased effector function and/or increased Fc receptor binding affinity, produced by the methods of the disclosure. In some embodiments, the antibody is an intact antibody. In some embodiments, the antibody is an antibody fragment containing the Fc region, or a fusion protein that includes a region equivalent to the Fc region of an immunoglobulin.

In one aspect, the present disclosure provides host cell expression systems for the generation of the antibodies or antigen-binding fragment thereof of the present disclosure having modified glycosylation patterns. In particular, the present disclosure provides host cell systems for the generation of glycoforms of the antibodies or antigen-binding fragment thereof, disclosed herein, having an improved therapeutic value. Therefore, the present disclosure provides host cell expression systems selected or engineered to express a polypeptide having a glycosyltransferase activity. Generally, any type of cultured cell line, including the cell lines discussed above, can be used as a background to engineer the host cell lines of the present invention. In some embodiments, CHO cells, BHK cells, NS0 cells, SP2/0 cells, YO myeloma cells, P3X63 mouse myeloma cells, PER cells, PER.C6 cells or hybridoma cells, other mammalian cells, yeast cells, insect cells, or plant cells are used as the background cell line to generate the engineered host cells of the invention. The host cells which contain the coding sequence of an antibody or antigen-binding fragment thereof of the invention and which express the biologically active gene products may be identified by at least four general approaches; (a) DNA-DNA or DNA-RNA hybridization; (b) the presence or absence of "marker" gene functions; (c) assessing the level of transcription as measured by the expression of the respective mRNA transcripts in the host cell; and (d) detection of the gene product as measured by immunoassay or by its biological activity.

Cysteine Engineered Antibody Variants

In some embodiments, it may be desirable to create cysteine engineered antibodies or antigen-binding fragment thereof, e.g., "thioMAbs," in which one or more residues of an antibody are substituted with cysteine residues. In some embodiments, the substituted residues occur at accessible sites of the antibody. Reactive thiol groups can be positioned at sites for conjugation to other moieties, such as drug moieties or linker-drug moieties, to create an immunoconjugate. In some embodiments, any one or more of the following residues may be substituted with cysteine: V205 (Kabat numbering) of the light chain; A118 (EU numbering) of the heavy chain; and S400 (EU numbering) of the heavy chain Fc region. Cysteine engineered antibodies may be generated as described. Any cysteine residue not involved in maintaining the proper conformation of the monoclonal, human, humanized, or variant antibody also may be substituted, generally with serine, to improve the oxidative stability of the molecule and prevent aberrant crosslinking. Conversely, cysteine bond(s) may be added to the antibody to improve its stability (particularly where the antibody is an antibody fragment such as an Fv fragment).

Antibody Derivatives

In some embodiments, an antibody or antigen-binding fragment thereof provided herein may be further modified to contain additional nonproteinaceous moieties that are known in the art and readily available. The moieties suitable for derivatization of the antibody include but are not limited to water soluble polymers. Non-limiting examples of water soluble polymers include, but are not limited to, polyethylene glycol (PEG), copolymers of ethylene glycol/propylene glycol, carboxymethylcellulose, dextran, polyvinyl alcohol, polyvinyl pyrrolidone, poly-1,3-dioxolane, poly-1,3,6-trioxane, ethylene/maleic anhydride copolymer, polyaminoacids (either homopolymers or random copolymers), and dextran or poly(n-vinyl pyrrolidone)polyethylene glycol, polypropylene glycol homopolymers, polypropylene oxide/ethylene oxide co-polymers, polyoxyethylated polyols (e.g., glycerol), polyvinyl alcohol, and mixtures thereof. Polyethylene glycol propionaldehyde may have advantages in manufacturing due to its stability in water. The polymer may be of any molecular weight, and may be branched or unbranched. The number of polymers attached to the antibody may vary, and if two or more polymers are attached, they can be the same or different molecules.

In another embodiment, conjugates of an antibody and nonproteinaceous moiety that may be selectively heated by exposure to radiation are provided. In some embodiments, the nonproteinaceous moiety is a carbon nanotube (See, e.g., Kam et al., Proc. Natl. Acad. Sci. USA 102: 11600-11605 (2005)). The radiation may be of any wavelength, and includes, but is not limited to, wavelengths that do not harm ordinary cells, but which heat the nonproteinaceous moiety to a temperature at which cells proximal to the antibody-nonproteinaceous moiety are killed.

Fc Region Variants

Mutation of residues within Fc receptor binding sites can result in altered effector function, such as altered ADCC, CDC activity, and/or altered half-life. Mutations include, for example, insertion, deletion, and/or substitution of one or more residues as described in more detail above, including substitution with alanine, a conservative substitution, a non-conservative substitution, and/or replacement with a corresponding amino acid residue at the same position from a different IgG subclass (e.g., replacing an IgG1 residue with a corresponding IgG2 residue at that position). An Fc region herein is a C-terminal region of an immunoglobulin heavy chain that contains at least a portion of the constant region. An Fc region includes native sequence Fc regions and variant Fc regions. The Fc region variant may comprise a human Fc region sequence (e.g., a human IgG1, IgG2, IgG3 or IgG4 Fc region) comprising an amino acid modification (e.g., a substitution) at one or more amino acid positions.

Previous studies mapped the binding site on human and murine IgG for FcγR primarily to the lower hinge region composed of IgG residues 233-239. Other studies proposed additional broad segments, e.g., Gly316-Lys338 for human Fc gamma receptor I, Lys274-Arg301 and Tyr407Arg416 for human Fc gamma receptor III, or found a few specific residues outside the lower hinge, e.g., Asn297 and Glu318 for murine IgG2b interacting with murine Fc gamma receptor II. The report of the 3.2-Å crystal structure of the human IgG Fc fragment with human Fc gamma receptor IIIA delineated IgG1 residues Leu234-Ser239, Asp265-Glu269, Asn297-Thr299, and Ala327-Ile332 as involved in binding to Fc receptor γIIIA. It has been suggested based on crystal structure that in addition to the lower hinge (Leu234-Gly237), residues in IgG CH2 domain loops FG (residues 326-330) and BC (residues 265-271) might play a role in binding to Fc gamma receptor IIA. See Shields et al., J. Biol. Chem., 276(9):6591-6604 (2001). Shields et al. reported that IgG1 residues involved in binding to all human Fc receptors are located in the CH2 domain proximal to the hinge and fall into two categories as follows: 1) positions that may interact directly with all FcR include Leu234-Pro238, Ala327, and Pro329 (and possibly Asp265); 2) positions that influence carbohydrate nature or position include Asp265 and Asn297.

In some embodiments, the invention contemplates an antibody variant that possesses some but not all effector functions, which make it a desirable candidate for applications in which the half-life of the antibody in vivo is important yet certain effector functions (such as complement and ADCC) are unnecessary or deleterious. In vitro and/or in vivo cytotoxicity assays can be conducted to confirm the effect of one or more Fc amino acid modifications on CDC and/or ADCC activities. For example, Fc receptor (FcR) binding assays can be conducted to ensure that the antibody lacks FcγR binding (hence likely lacking ADCC activity), but retains FcRn binding ability.

Fc Variants with Altered Binding to an Fc Gamma Receptor

In some instances, exhibits altered affinity for one or more Fc gamma receptors (FcγR). For example, an Fc variant exhibits increased affinity for one or more Fc gamma receptors (FcγR), decreased affinity for one or more Fc gamma receptors (FcγR), or a combination thereof. In one instance, an Fc variant exhibits increased ADCC activity. In yet another example, the Fc region is modified to increase the ability of the antibody to mediate antibody dependent cellular cytotoxicity (ADCC). The binding sites on human IgG1 for Fc gamma RI (FcγRI), Fc gamma RII (FcγRII), Fc gamma RIII (FcγRIII), and FcRn have been mapped and variants with altered binding have been described. Non-limiting examples of such modifications are described in, for example, U.S. Pat. No. 6,737,056; PCT Publication WO 00/42072 by Presta; Shields, R. L. et al. (2001) J. Biol.

Chem. 276:6591-6604; U.S. Pat. No. 7,332,581, etc. In some embodiments, the constant region of the antibodies disclosed herein is replaced with an IGHG1.

In some embodiments, an Fc variant provided herein that exhibits improved ADCC activity comprises an Fc region with a mutation at amino acid position 298, 333, and/or 334 of the Fc region (using Kabat numbering). In one instance, provided herein is an Fc variant with altered effector and/or Fc-gamma-receptor binding that contain at least one mutation in a human IgG Fc region at amino acid position 238, 239, 248, 249, 252, 254, 255, 256, 258, 265, 267, 268, 269, 270, 272, 276, 278, 280, 283, 285, 286, 289, 290, 292, 294, 295, 296, 298, 301, 303, 305, 307, 309, 312, 315, 320, 322, 324, 326, 327, 329, 330, 331, 333, 334, 335, 337, 338, 340, 360, 373, 376, 378, 382, 388, 389, 398, 414, 416, 419, 430, 434, 435, 437, 438, and/or 439 (using Kabat numbering), which variant displays a receptor binding profile associated with altered ADCC or CDC activity. In one instance, provided herein is an Fc variant that displays reduced binding to a FcγRI, which comprises an amino acid modification at amino acid position 238, 265, 269, 270, 327, and/or 329 (utilizing Kabat numbering). In one instance, provided herein is an Fc variant that displays reduced binding to a FcγRII, that contains an amino acid modification at amino acid position 238, 265, 269, 270, 292, 294, 295, 298, 303, 324, 327, 329, 333, 335, 338, 373, 376, 414, 416, 419, 435, 438, and/or 439 (utilizing Kabat numbering). In one instance, provided herein is an Fc variant that displays increased binding to FcγRII that contains an amino acid modification at amino acid position 255, 256, 258, 267, 268, 272, 276, 280, 283, 285, 286, 290, 301, 305, 307, 309, 312, 315, 320, 322, 326, 330, 331, 337, 340, 378, 398, and/or 430 (utilizing Kabat numbering).

In one instance, provided herein is an Fc variant that exhibits altered binding to a FcγRII that contains an amino acid modification at amino acid position Arg255, Thr256, Glu258, His268, Ser267, Asp270, Asn276, Glu272, Asp280, His285, Asn286, Lys290, Arg292, Gln295, Ser298, Arg301, Thr307, Leu309, Asn315, Lys322, Lys326, Pro331, Ser337, Ala339, Ala378, and/or Lys414 (utilizing Kabat numbering). In one instance, provided herein is an Fc variant that exhibits reduced binding to a FcγRII that contains an amino acid modification at amino acid position A327Q, A327S, P329A, D265A, and/or D270A (utilizing Kabat numbering). In one instance, provided herein is an Fc variant that displays reduced binding to a FcγRIII, that contains an amino acid modification at amino acid position 238, 239, 248, 249, 252, 254, 265, 268, 269, 270, 272, 278, 289, 293, 294, 295, 296, 301, 303, 322, 327, 329, 338, 340, 373, 376, 382, 388, 389, 416, 434, 435, and/or 437 (utilizing Kabat numbering). In one instance, provided herein is an Fc variant that displays improved binding to FcγRII and FcγRIIIA that contains an amino acid modification at amino acid position T256A and/or K290A (using Kabat numbering).

In one instance, provided herein is an Fc variant that displays reduced binding to FcγRII and FcγRIIIA that contains an amino acid modification at amino acid position D270A, Q295A, and/or A327S (using Kabat numbering). In one instance, provided herein is an Fc variant that displays improved binding to FcγRII and no effect FcγRIIIA that contains an amino acid modification at amino acid position Kabat numbering). In one instance, provided herein is an Fc variant that displays reduced binding to FcγRII and improved binding to FcγRIIIA that contains an amino acid modification at amino acid position S298A (using Kabat numbering). In one instance, provided herein is an Fc variant that displays improved binding to FcγRII and reduced binding to FcγRIIIA that contains an amino acid modification at amino acid position H268A, R301A, and/or K322A (using Kabat numbering). In one instance, provided herein is an Fc variant that displays reduced binding to FcγRII and no effect on FcγRIIIA that contains an amino acid modification at amino acid position R292A and/or K414A (using Kabat numbering).

In one instance, provided herein is an Fc variant that displays no effect on FcγRII and reduced binding to FcγRIIIA that contains an amino acid modification at amino acid position S239A, E269A, E293A, V296F, V303A, A327G, K338A, and/or D376A (using Kabat numbering). In one instance, provided herein is an Fc variant that displays increased binding to FcγRIIIA that contains an amino acid modification at amino acid position E333A, K334A, and/or A339T (using Kabat numbering).

An Fc variant that displays improved binding to a FcγR may also be made and may comprise an amino acid modification at amino acid position 255, 256, 258, 267, 268, 272, 276, 280, 283, 285, 286, 290, 298, 301, 305, 307, 309, 312, 315, 320, 322, 326, 330, 331, 333, 334, 337, 340, 360, 378, 398, and/or 430 (utilizing Kabat numbering). In one instance, provided herein is an Fc variant that displays improved binding to a FcγRIII, and optionally may further display decreased binding to FcγRII, which variant comprises an amino acid modification at amino acid position 298 and/or 333 of an Fc region (utilizing Kabat numbering). In one instance, provided herein is an Fc variant that displays improved binding to a FcγRII that contains an amino acid modification at amino acid position 255, 256, 258, 267, 268, 272, 276, 280, 283, 285, 286, 290, 301, 305, 307, 309, 312, 315, 320, 322, 326, 330, 331, 337, 340, 378, 398 and/or 430 (utilizing Kabat numbering). Such variant may further display decreased binding to FcγRIII if it includes an Fc region amino acid modification at any one or more of amino acid positions 268, 272, 298, 301, 322 or 340 (utilizing Kabat numbering).

In one instance, a variant described herein contains a mutation at amino acid positions 240, 243, 245, 247, 262, 263, 266, 299, 313, 325, 328, and/or 332 (using Kabat numbering); or at amino acid positions 234, 235, 239, 240, 241, 243, 244, 245, 247, 262, 263, 264, 265, 266, 267, 269, 296, 297, 298, 299, 313, 325, 327, 328, 329, 330, and/or 332 (using Kabat numbering), of which mutations at positions 234, 235, 239, 240, 241, 243, 244, 245, 247, 262, 263, 264, 265, 266, 267, 269, 296, 297, 298, 299, 313, 325, 327, 328, 329, 330, or 332 may reduce ADCC activity or reduce binding to an Fc gamma receptor. In one instant, an Fc variant described herein contains a mutation at amino acid position 234, 235, 239, 240, 243, 264, 266, 328, 330, 332, and/or 325 (using Kabat numbering) that increases ADCC activity, and wherein the Fc variant comprises at least one substitution selected from the group consisting of 234E, 234Y, 234I, 235D, 235S, 235Y, 235I, 239D, 239E, 239N, 239Q, 239T, 240I, 240M, 243L, 264I, 264T, 264Y, 266I, 328M, 328I, 328Q, 328D, 328V, 328T, 330Y, 330L, 330I, 332D, 332E, 332N, 332Q, and 325T.

In one instance, provided herein is an Fc variant that exhibits altered binding to a FcγRII that contains an amino acid modification at amino acid position Arg255, Thr256, Glu258, His268, Ser267, Asp270, Asn276, Glu272, Asp280, His285, Asn286, Lys290, Arg292, Gln295, Ser298, Arg301, Thr307, Leu309, Asn315, Lys322, Lys326, Pro331, Ser337, Ala339, Ala378, and/or Lys414 (utilizing Kabat numbering). In one instance, provided herein is an Fc variant that exhibits reduced binding to a FcγRII that contains an amino acid modification at amino acid position A327Q, A327S, P329A, D265A, and/or D270A (utilizing Kabat numbering). In one instance, provided herein is an Fc variant that exhibits reduced binding to a FcγRIIIA that contains an amino acid modification at amino acid position Ser239, Ser267 (Gly only), His268, Glu293, Gln295, Tyr296, Arg301, Val303, Lys338, and/or Asp376 (utilizing Kabat numbering). In one instance, provided herein is an Fc variant that exhibits reduced binding to a FcγRIIA and FcγRIIB that contains an amino acid modification at amino acid position Lys414 (utilizing Kabat numbering). In one instance, provided herein is an Fc variant that exhibits reduced binding to a FcγRIIA and FcγRIIIA that contains an amino acid modification at amino acid position Arg416 (utilizing Kabat numbering). In one instance, provided herein is an Fc variant that exhibits reduced binding to a FcγRIIA and FcγRIIB that contains an amino acid modification at amino acid position Gln419 (utilizing Kabat numbering).

In one instance, provided herein is an Fc variant that exhibits improved (increased) binding to a FcγRIIIA that contains an amino acid modification at amino acid position Lys360 (utilizing Kabat numbering). Armour et al. (Mol Immunol. 2003; 40(9):585-93) identified IgG1 variants which react with the activating receptor, FcγRIIa, at least 10-fold less efficiently than wildtype IgG1, but whose binding to the inhibitory receptor, FcγRIIb, is only four-fold reduced. Mutations were made in the region of amino acids 233-236 and/or at amino acid positions 327, 330 and 331. See also WO 99/58572. Non-limiting examples of in vitro assays to assess ADCC activity of a molecule of interest are described, for example, in U.S. Pat. Nos. 5,500,362 and 5,821,337. Alternatively, non-radioactive assays methods may be employed (e.g., ACTI™ and CYTOTOX 96® non-radioactive cytotoxicity assays). Useful effector cells for such assays include peripheral blood mononuclear cells (PBMC) and Natural Killer (NK) cells. Alternatively, or additionally, ADCC activity of the molecule of interest may be assessed in vivo, e.g., in an animal model (See, e.g., Clynes et al., Proc. Nat'l Acad. Sci. USA 95:652-656 (1998)).

Fc Variants with Decreased C1q Binding

In another instance, an Fc variant exhibits reduced C1q binding. C1q binding assays may also be carried out to confirm that the antibody is able or unable bind C1q and, hence, contains or lacks CDC activity (Idusogie et al., J. Immunol. 164: 4178-4184 (2000)). To assess complement activation, a CDC assay may be performed (See, e.g., Gazzano-Santoro et al., J. Immunol. Methods 202:163 (1996); Cragg, M. S. et al., Blood 101:1045-1052 (2003); and Cragg et al., Blood 103:2738-2743 (2004)).

In another example, one or more amino acids can be replaced with a different amino acid residue such that the antibody has altered C1q binding and/or reduced or abolished complement dependent cytotoxicity (CDC). This approach is described in further detail in U.S. Pat. No. 6,194,551 by Idusogie et al. In another example, one or more amino acid residues are altered to thereby alter the ability of the antibody to fix complement. This approach is described further in PCT Publication WO 94/2935 1 by Bodmer et al. In one instance, an Fc variant provided herein can contain a mutation at amino acid position 329, 331, and/or 322 (using Kabat numbering), and exhibits reduced C1q binding and/or CDC activity. In some instances, C1q binding activity and/or CDC activity of an antibody can be reduced by mutating amino acid residue 318, 320, and/or 322 (using Kabat numbering) of a heavy chain; replacing residue 297 (Asn) may result in removal of lytic activity of an antibody. Cytophilic activity of IgG1 is a property of its heavy chain CH2 domain. In one instance, where an Fc variant is an IgG, amino acid residues 234-237 are maintained as wild type to preserve cytophilic activity of the molecule. An IgG2 antibody containing the entire ELLGGP sequence (residues 233-238) may, in some instances, be more active than wild-type IgG1. In some instances, C1q binding activity and/or lytic activity of an IgG1 antibody can be reduced by mutating amino acid residue Pro331 to Ser. In other instances, C1q binding activity and/or lytic activity of an IgG4 antibody can be reduced by mutating amino acid residue Pro for Ser331 (Xu et al., J Biol Chem. 1994; 269(5):3469-74).

Fc Variants with Interchain Disulfide Binds or Dual Fc Regions

In yet another embodiment, it may be desirable to modify the antibody of the invention with respect to effector function, so as to enhance the effectiveness of the antibody in treating cancer, for example. For example, one or more cysteine residue(s) may be introduced in the Fc region, thereby allowing interchain disulfide bond formation in this region. The homodimeric antibody thus generated may have improved internalization capability, increased complement-mediated cell killing, and/or antibody-dependent cellular cytotoxicity (ADCC). See Caron et al., J. Exp Med. 176: 1191-1195 (1992) and Shapes, B. J. Immunol. 148: 2918-2922 (1992). Homodimeric antibodies with enhanced anti-tumor activity may also be prepared using heterobifunctional cross-linkers as described in Wolff et al., Cancer Research 53: 2560-2565 (1993). Alternatively, an antibody can be engineered which has dual Fc regions and may thereby have enhanced complement lysis and/or ADCC capabilities. See, Stevenson et al., Anti-Cancer Drug Design 3: 219-230 (1989).

Fc Variants with Increased FcRn Binding and In Vivo Half-Life

Fc region variants with altered binding affinity for the neonatal receptor (FcRn) are also contemplated herein. Fc region variants with improved affinity for FcRn are anticipated to have longer serum half-lives, and such variants are useful in methods of treating subjects where long half-life of the administered polypeptide is desired, e.g., to treat a chronic disease or disorder. Fc region variants with decreased FcRn binding affinity, on the contrary, are expected to have shorter half-lives, and such variants may be administered to a subject where a shortened circulation time may be preferred, e.g. for in vivo diagnostic imaging or for antibodies which have toxic side effects when left circulating in the blood stream for extended periods, etc.

Fc region variants with altered binding affinity for FcRn include those that contains an amino acid modification at amino acid position 238, 252, 253, 254, 255, 256, 265, 272, 286, 288, 303, 305, 307, 309, 311, 312, 317, 340, 356, 360, 362, 376, 378, 380, 382, 386, 388, 400, 413, 415, 424, 433, 434, 435, 436, 439, and/or 447 (utilizing Kabat numbering). Fc region variants with decreased FcRn binding affinity are less likely to cross the placenta and, therefore, may be utilized in the treatment of diseases or disorders in pregnant women. In one instance, provided herein is an Fc variant that exhibits reduced binding to FcRn that contains an amino acid modification at amino acid position 252, 253, 254, 255, 288, 309, 386, 388, 400, 415, 433, 435, 436, 439, and/or 447 (utilizing Kabat numbering).

In one instance, provided herein is an Fc variant that exhibits increased binding to a FcRn that contains an amino acid modification at amino acid position 238, 256, 265, 272, 286, 303, 305, 307, 311, 312, 317, 340, 356, 360, 362, 376, 378, 380, 382, 413, 424, and/or 434 (utilizing Kabat numbering). In one instance, provided herein is an Fc variant that exhibits increased binding to a FcRn that contains an amino acid of Pro238Ala, Thr256Ala, Thr307Ala, Gln311Ala, Asp312Ala, Glu380Ala, Glu382Ala, and/or Asn434Ala (utilizing Kabat numbering). In one instance, provided herein is an Fc variant that exhibits reduced binding to a FcRn that contains a modification at amino acid position Glu233-Gly236, Arg255, Lys288, Ser415, and/or His433 (utilizing Kabat numbering). In one instance, provided herein is an Fc variant that exhibits abrogated binding to a FcRn that contains a modification at amino acid position Ile253, Ser254, His435, and/or Tyr436 (utilizing Kabat numbering). Schuurman et al., Mol Immunol. 2001; 38(1):1-8, incorporated by reference herein in its entirety, report that mutating one of the hinge cysteines involved in the inter-heavy chain bond formation, Cys226, to serine resulted in a more stable inter-heavy chain linkage. Mutating the IgG4 hinge sequence Cys-Pro-Ser-Cys to the IgG1 hinge sequence Cys-Pro-Pro-Cys also markedly stabilizes the covalent interaction between the heavy chains. Angal et al., Mol Immunol. 1993; 30(1):105-8, incorporated by reference herein in its entirety, report that mutating the serine at amino acid position 241 in IgG4 to praline (found at that position in IgG1 and IgG2) led to the production of a homogeneous antibody, as well as extending serum half-life and improving tissue distribution compared to the original chimeric IgG4. Other such examples of Fc region variants are also contemplated (See, e.g., Duncan & Winter, Nature 322:738-40 (1988); Chan C A and Carter P J (2010) Nature Rev Immunol 10:301-316); and Shields et al., J. Biol. Chem. 9(2): 6591-6604 (2001). Determination of FcRn binding and in vivo clearance/half-life can be performed using methods known in the art (See, e.g., Petkova, S. B. et al., Int'l. Immunol. 18(12):1759-1769 (2006)).

Variants of Antibody Fragments and Salvage Receptor Binding Epitopes

In certain embodiments of the invention, it may be desirable to use an antibody fragment, rather than an intact antibody, to increase tumor penetration, for example. In this case, it may be desirable to modify the antibody fragment in order to increase its serum half-life, for example, adding molecules such as PEG or other water soluble polymers, including polysaccharide polymers, to antibody fragments to increase the half-life. This may also be achieved, for example, by incorporation of a salvage receptor binding epitope into the antibody fragment (e.g., by mutation of the appropriate region in the antibody fragment or by incorporating the epitope into a peptide tag that is then fused to the antibody fragment at either end or in the middle, e.g., by DNA or peptide synthesis) (see, e.g., WO 96/32478). The salvage receptor binding epitope preferably constitutes a region wherein any one or more amino acid residues from one or two loops of an Fc domain are transferred to an analogous position of the antibody fragment. Even more preferably, three or more residues from one or two loops of the Fc domain are transferred. Still more preferred, the epitope is taken from the CH2 domain of the Fc region (e.g., of an IgG) and transferred to the CHI, CH3, or VH region, or more than one such region, of the antibody. Alternatively, the epitope is taken from the CH2 domain of the Fc region and transferred to the CL region or VL region, or both, of the antibody fragment. See, also, International applications WO 97/34631 and WO 96/32478.

Thus, antibodies of the invention may comprise a human Fc portion, a human consensus Fc portion, or a variant thereof that retains the ability to interact with the Fc salvage receptor, including variants in which cysteines involved in disulfide bonding are modified or removed, and/or in which the a Met is added at the N-terminus and/or one or more of the N-terminal 20 amino acids are removed, and/or regions that interact with complement, such as the C1q binding site, are removed. Isaacs et al., J Immunol. 1998; 161(8):3862-9, incorporated herein by reference in its entirety, report that mutations within a motif critical for FcγR binding (glutamate 233 to praline, leucine/phenylalanine 234 to valine, and leucine 235 to alanine) completely prevented depletion of target cells. The mutation glutamate 318 to alanine eliminated effector function of mouse IgG2b and also reduced the potency of human IgG4.

Affinity Maturation

Affinity maturation involves preparing and screening antibody variants that have substitutions within the CDRs of a parent antibody and selecting variants that have improved biological properties such as binding affinity relative to the parent antibody. A convenient way for generating such substitutional variants is affinity maturation using phage display. Briefly, several hypervariable region sites (e.g. 6-7 sites) are mutated to generate all possible amino substitutions at each site. The antibody variants thus generated are displayed in a monovalent fashion from filamentous phage particles as fusions to the gene III product of M13 packaged within each particle. The phage-displayed variants are then screened for their biological activity (e.g. binding affinity) Alanine scanning mutagenesis can be performed to identify hypervariable region residues that contribute significantly to antigen binding. Alternatively, or in addition, it may be beneficial to analyze a crystal structure of the antigen-antibody complex to identify contact points between the antibody and antigen. Such contact residues and neighboring residues are candidates for substitution according to the techniques elaborated herein. Once such variants are generated, the panel of variants is subjected to screening as described herein and antibodies with superior properties in one or more relevant assays may be selected for further development.

Altered Glycosylation

Additionally or alternatively, an antibody can be made that has an altered type of glycosylation, such as a hypofucosylated antibody having reduced amounts of fucosyl residues or an antibody having increased bisecting GlcNac structures. Such altered glycosylation patterns have been demonstrated to increase the ADCC ability of antibodies. Embodiments encompassing glycosylated antibodies or antigen-binding fragments thereof have been described in above sections. Such carbohydrate modifications can be accomplished by, for example, expressing the antibody in a host cell with altered glycosylation machinery. Cells with altered glycosylation machinery have been described in the art and can be used as host cells in which to express recombinant antibodies according to at least some embodiments of the disclosure to thereby produce an antibody with altered glycosylation. For example, the cell lines Ms704, Ms705, and Ms709 lack the fucosyltransferase gene, FUT8 (alpha (1,6) fucosyltransferase), such that antibodies expressed in the Ms704, Ms705, and Ms709 cell lines lack fucose on their carbohydrates. The Ms704, Ms705, and Ms709 FUT8.−/− cell lines are created by the targeted disruption of the FUT8 gene in CHO/DG44 cells using two replacement vectors (see U.S. Patent Publication No. 20040110704 by Yamane et al. and Yamane-Ohnuki et al. (2004) Biotechnol Bioeng 87:614-22). As another example, EP 1,176,195 by Hanai et al. describes a cell line with a functionally disrupted FUT8 gene, which encodes a fucosyl transferase, such that antibodies expressed in such a cell line exhibit hypofucosylation by reducing or eliminating the alpha 1,6 bond-related enzyme. Hanai et al. also describe cell lines which have a low enzyme activity for adding fucose to the N-acetylglucosamine that binds to the Fc region of the antibody or does not have the enzyme activity, for example the rat myeloma cell line YB2/0 (ATCC CRL 1662). PCT Publication WO 03/035835 by Presta describes a variant CHO cell line, Lec13 cells, with reduced ability to attach fucose to Asn(297)-linked carbohydrates, also resulting in hypofucosylation of antibodies expressed in that host cell (see also Shields, R. L. et al. (2002) J. Biol. Chem. 277:26733-26740). PCT Publication WO 99/54342 by Umana et al. describes cell lines engineered to express glycoprotein-modifying glycosyl transferases (e.g., beta(1, 4)-N-acetylglucosaminyltransferase III (GnTIII)) such that antibodies expressed in the engineered cell lines exhibit increased bisecting GlcNac structures which results in increased ADCC activity of the antibodies (see also Umana et al. (1999) Nat. Biotech. 17:176-180). Alternatively, the fucose residues of the antibody may be cleaved off using a fucosidase enzyme. For example, the fucosidase alpha-L-fucosidase removes fucosyl residues from antibodies (Tarentino, A. L. et al. (1975) Biochem. 14:5516-23).

Pegylation

Another modification of the antibodies herein that is contemplated by the present disclosure is pegylation. An antibody can be pegylated to, for example, increase the biological (e.g., serum) half-life of the antibody. To pegylate an antibody, the antibody, or fragment thereof, typically is reacted with polyethylene glycol (PEG), such as a reactive ester or aldehyde derivative of PEG, under conditions in which one or more PEG groups become attached to the antibody or antibody fragment. Preferably, the pegylation is carried out via an acylation reaction or an alkylation reaction with a reactive PEG molecule (or an analogous reactive water-soluble polymer). As used herein, the term "polyethylene glycol" is intended to encompass any of the forms of PEG that have been used to derivatize other proteins, such as mono (C1-C10) alkoxy- or aryloxy-polyethylene glycol or polyethylene glycol-maleimide. In certain embodiments, the antibody to be pegylated is an aglycosylated antibody. Methods for pegylating proteins are known in the art and can be applied to the antibodies according to at least some embodiments of the invention. See, for example, EP 0 154 316 by Nishimura et al. and EP 0 401 384 by Ishikawa et al.

Other Covalent Modifications

Covalent modifications of the antibody are also included within the scope of this invention. They may be made by chemical synthesis or by enzymatic or chemical cleavage of the antibody, if applicable. Other types of covalent modifications of the antibody are introduced into the molecule by reacting targeted amino acid residues of the antibody with an organic derivatizing agent that is capable of reacting with selected side chains or the N- or C-terminal residues.

Cysteinyl residues most commonly are reacted with a haloacetate (and corresponding amines), such as chloroacetic acid or chloroacetamide, to give carboxymethyl or carboxyamidomethyl derivatives. Cysteinyl residues also are derivatized by reaction with bromotrifluoroacetone, alpha-bromo-(5 imidozoyl)propionic acid, chloroacetyl phosphate, N-alkylmaleimides, 3-nitro-2-pyridyl disulfide, methyl 2-pyridyl disulfide, p-chloromercuribenzoate, 2-chloromercuri-4-nitrophenol, or chloro-7-nitrobenzo-2-oxa-1,3-diazole.

Histidyl residues are derivatized by reaction with diethylpyrocarbonate at pH 5.5-7.0 because this agent is relatively specific for the histidyl side chain. Para-bromophenacyl bromide also is useful; the reaction is preferably performed in 0.1 M sodium cacodylate at pH 6.0. Lysinyl and amino-terminal residues are reacted with succinic or other carboxylic acid anhydrides. Derivatization with these agents has the effect of reversing the charge of the lysinyl residues. Other suitable reagents for derivatizing alpha amino-containing residues include imidoesters such as methyl picolinimidate, pyridoxal phosphate, pyridoxal, chloroborohydride, trinitrobenzenesulfonic acid, methylisourea, 2,4-pentanedione, and transaminase-catalyzed reaction with glyoxylate.

Arginyl residues are modified by reaction with one or several conventional reagents, among them phenylgly-oxal, 2,3-butanedione, 1,2-cyclohexanedione, and ninhydrin. Derivatization of arginine residues requires that the reaction be performed in alkaline conditions because of the high pKa of the guanidine functional group. Furthermore, these reagents may react with the groups of lysine as well as the arginine epsilon-amino group.

The specific modification of tyrosyl residues may be made, with particular interest in introducing spectral labels into tyrosyl residues by reaction with aromatic diazonium compounds or tetranitromethane. Most commonly, N-acetylimidizole and tetranitromethane are used to form 0-acetyl tyrosyl species and 3-nitro derivatives, respectively. Tyrosyl residues are iodinated using 125I or 131I to prepare labeled proteins for use in radioimmunoassay. Carboxyl side groups (aspartyl or glutamyl) are selectively modified by reaction with carbodiimides (R—N=C=N—R'), where R and R' are different alkyl groups, such as 1-cyclohexyl-3-(2-morpholinyl-4-ethyl) carbodiimide or 1-ethyl-3-(4-azonia-4,4-dimethylpentyl)carbodiimide. Furthermore, aspartyl and glutamyl residues are converted to asparaginyl and glutaminyl residues by reaction with ammonium ions.

Glutaminyl and asparaginyl residues are frequently deamidated to the corresponding glutamyl and aspartyl residues, respectively. These residues are deamidated under neutral or basic conditions. The deamidated form of these residues falls within the scope of this invention. Other modifications include hydroxylation of proline and lysine, phosphorylation of hydroxyl groups of seryl or threonyl residues, methylation of the alpha amino groups of lysine, arginine, and histidine side chains (T. E. Creighton, Proteins: Structure and Molecular Properties, W.H. Freeman & Co., San Francisco, pp. 79-86 (1983)), acetylation of the N-terminal amine, and amidation of any C-terminal carboxyl group.

Another type of covalent modification involves chemically or enzymatically coupling glycosides to the antibody. These procedures are advantageous in that they do not require production of the antibody in a host cell that has glycosylation capabilities for N- or O-linked glycosylation. Depending on the coupling mode used, the sugar(s) may be attached to (a) arginine and histidine, (b) free carboxyl groups, (c) free sulfhydryl groups such as those of cysteine, (d) free hydroxyl groups such as those of serine, threonine, or hydroxyproline, (e) aromatic residues such as those of phenylalanine, tyrosine, or tryptophan, or (f) the amide group of glutamine. These methods are described in WO 87/05330 published 11 Sep. 1987, and in Aplin and Wriston, CRC Crit. Rev. Biochem., pp. 259-306 (1981).

Removal of any carbohydrate moieties present on the antibody may be accomplished chemically or enzymatically. Chemical deglycosylation requires exposure of the antibody to the compound trifluoromethanesulfonic acid, or an equivalent compound. This treatment results in the cleavage of most or all sugars except the linking sugar (N-acetylglucosamine or N-acetylgalactosamine), while leaving the antibody intact. Chemical deglycosylation is described by Hakimuddin, et al. Arch. Biochem. Biophys. 259: 52 (1987) and by Edge et al. Anal. Biochem., 118: 131 (1981). Enzymatic cleavage of carbohydrate moieties on antibodies can be achieved by the use of a variety of endo- and exoglycosidases as described by Thotakura et al. Meth. Enzymol. 138: 350 (1987). Another type of covalent modification of the antibody comprises linking the antibody to one of a variety of nonproteinaceous polymers, e.g., polyethylene glycol, poly-propylene glycol, polyoxyethylated polyols, polyoxyethylated sorbitol, polyoxyethylated glucose, polyoxyethylated glycerol, polyoxyalkylenes, or polysaccharide polymers such as dextran. Such methods are known in the art, see, e.g. U.S. Pat. Nos. 4,640,835; 4,496,689; 4,301,144; 4,670,417; 4,791,192, 4,179,337, 4,766,106, 4,179,337, 4,495,285, 4,609,546 or EP 315 456.

Computationally Reconstructed Antibodies

Provided herein are reconstructed polypeptide and nucleic acid consensus sequences for cancer associated antibodies. The consensus sequences are reconstructed in silico. The term "polypeptide consensus sequence" as used herein refers to an amino acid sequence which comprises the most frequently occurring amino acid residues at each location in all immunoglobulins of any particular subclass or subunit structure. The polypeptide consensus sequence may be based on immunoglobulins of a particular species or of many species. A polypeptide "consensus" sequence, "consensus" structure, or "consensus" antibody is understood to encompass a human polypeptide consensus sequence as described in certain embodiments provided herein, and to refer to an amino acid sequence which comprises the most frequently occurring amino acid residues at each location in all human immunoglobulins of any particular subclass or subunit structure. The embodiments herein provide consensus human structures and consensus structures, which consider other species in addition to human.

The term, "nucleic acid consensus sequence" as used herein refers to a nucleic acid sequence, which comprises the most frequently occurring nucleotide residues at each location in all immunoglobulin nucleic acid sequence of any particular subclass or subunit structure. The nucleic acid consensus sequence may be based on immunoglobulins of a particular species or of many species. A nucleic acid "consensus" sequence, or "consensus" structure, is understood to encompass a human nucleic acid consensus sequence as described in certain embodiments of this invention, and to refer to a nucleic acid sequence which comprises the most frequently occurring nucleotide residues at each location in all human immunoglobulins nucleic acid of any particular subclass or subunit structure.

Provided herein are consensus human structures and consensus structures of other species in addition to human. Methods to computationally reconstruct the consensus sequences from RNA seq data are described in the examples herein. Non limiting examples of computational tools known in the art for reconstructing full-length antibody repertoires including MIGEC (Shugay et al. 2014), PRESTO (Vander Heiden et al. 2014), MiXCR (Bolotin et al. 2015), and IGREPERTOIRECONSTRUCTOR (Safonova et al. 2015). In some embodiments, the TraCeR pipeline by Stubbington and Teichmann is implemented, which uses de novo assembly after a pre-filtering step against a custom database containing in silico combinations for all known human V and J gene segments/alleles in the International Immunogenetics Information System (IMGT) repository. In some embodiments, another pipeline, VDJPuzzle, is implemented which filters in reads by mapping to TCR genes followed by a Trinity-based assembly; whereby the total reads are then mapped back to the assemblies in order to retrieve reads missed in the initial mapping step, followed by another round of assembly with Trinity. An exemplary method for computationally reconstructing consensus sequences can comprise somatic sequence identification, manual IGV investigation and (if necessary) correction of somatic vdj sequence and identification of germline sequence and CDR regions.

In some embodiments, RNA-seq FASTQ files retrieved for patients e.g., a cancer patient are recorded and analyzed. Kallisto, BWA, MiXCR or other known tools can be used, in some embodiments, to perform a first alignment of RNA-seq samples to reference V, D and J genes of immunoglobulins in order to identify the repertoire present in the samples. In further embodiments, identical CDR3 sequences are identified and grouped in clonotypes (Bolotin D A et al., Nature Methods, 2015; Bolotin D A et al. Nature Biotechnology, 2017). VDJ tools are used, in some embodiments, (Shugay M. et al. PLoS Computational Biology, 2015) to filter out non-functional (non-coding) clonotypes and to compute basic diversity statistics. In further embodiments, non-functional clonotypes are identified as those containing a stop codon or frameshift in their receptor sequence. In some embodiments, the diversity of the Ig repertoire is obtained based on the effective number of species which is calculated as the exponent of the Shannon-Wiener Entropy index (MacArthur R H. Biological reviews. 1965).

In some embodiments, further alignments against the immunoglobulin segments present in the samples are performed for viewing the results to explore the frequency distribution of sequence mismatches along the V, D, J gene segments and, in particular in the CDR3 region length statistics. This alignment step can be useful, for example, for summarizing repertoires, as well as offering a detailed view of rearrangements and region alignments for individual query sequences. Exemplary methodology for alignment and assembly is described in the examples herein.

In some embodiments, the immunoglobulin segments present in the samples are identified using IMGT reference files or equivalent. In some instances, the heavy D segment and light V-J junction sequences can be assembled using an assembler. Non limiting examples of assembler known in the art include Trinity and V'DJer. A FASTA file with corrected heavy D and light V-J junction sequences can be generated for each sample in some embodiments. In addition to the assembled FASTA files, germline FASTA files can be generated, for example, by using IgBLAST v1.9.0 [Ye J, et al Nucleic Acids Research, 2013] and the IMGT database. In further embodiments, the somatic FASTA sequence can be input to IgBLAST to obtain the closest segment ids for the heavy and light chain. The germline FASTA can be generated by merging corresponding segment sequences from the IMGT database. The final assembled FASTA sequences can serve as 'reference' sequences for the alignment and visualization steps.

In further embodiments, using the reference files generated from the assembly step, the FASTQs can be aligned in BowTie2 default mode. Other alignment tools, known in the art, for example STAR or TopHat2 can also be used. The output BAM file can be used for IGV visualization and mutations in the patient can be observed.

In further embodiments, the identification of the CDR3 region and corresponding V, D, and J chains from the final assembled FASTA sequences can be done, for example with IgBLAST. The standardized output using version v.1.9.0 of IgBLAST can be delivered by wrapping IgBLASTn with default parameters in some instances. In other instances, the output from the IgBLAST service can be extracted using a purpose-built parser tool designed to extract the CDR1, CDR2 and CDR3 nucleotide and amino acid sequences.

Exemplary Cancer Associated Antibodies or Antigen-Binding Fragments Thereof

The present disclosure provides cancer associated antibodies comprising a consensus sequence. In some embodiments, the antibodies or antigen-binding fragment thereof induce lysis of cancer cells. Lysis can be induced by any mechanism, such as by mediating an effector function, such as C1q binding and complement dependent cytotoxicity (CDC); Fc receptor binding; antibody-dependent cell-mediated cytotoxicity (ADCC); phagocytosis, or direct induction of cell apoptosis.

In some embodiments, an antibody or antigen-binding fragment thereof, disclosed herein, is engineered to have at least one increase in effector function as compared to the non-engineered parent antibody or antigen-binding fragment thereof. Effector functions are biological activities attributable to the Fc region of an antibody, which vary with the antibody isotype. Examples of antibody effector functions include: C1q binding and complement dependent cytotoxicity (CDC); Fc receptor binding; antibody-dependent cell-mediated cytotoxicity (ADCC); phagocytosis. For example, an antibody or antigen-binding fragment thereof, disclosed herein can be glycoengineered to have at least one increase in effector function as compared to the non-glycoengineered parent. Antibody-dependent cellular cytotoxicity (ADCC) is the result of the formation of a complex between the IgG Fab portion of the antibody with the viral protein on the cell surface and binding of the Fc portion to the Fc receptors (FcγRs), on effector cells. The increase in effector function can be increased binding affinity to an Fc receptor, increased ADCC; increased cell mediated immunity; increased binding to cytotoxic CD8 T cells; increased binding to NK cells; increased binding to macrophages; increased binding to polymorphonuclear cells; increased binding to monocytes; increased binding to macrophages; increased binding to large granular lymphocytes; increased binding to granulocytes; direct signaling inducing apoptosis; increased dendritic cell maturation; or increased T cell priming.

Exemplary Sequences of the Antibodies of the Disclosure and Antigen Binding Fragments Thereof In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence of any one of SEQ ID NOs: 1-271. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence of any one of SEQ ID NOs: 1-271. In some embodiments, substitutions, insertions, or deletions occur in regions outside the CDRs (e.g., in the FRs). Optionally, the antibody or antigen-binding fragment thereof comprises the VH sequence of any one of SEQ ID NOs: 1-271, including one or more post-translational modifications of that sequence. In a particular embodiment, the VH comprises one, two or three CDRs selected from: (a) CDR-H1, comprising the amino acid sequence of any one of SEQ ID NOs: 543-813, (b) CDR-H2, comprising the amino acid sequence of any one of SEQ ID NOs: 1085-1355; and (c) CDR-H3, comprising the amino acid sequence of any one of SEQ ID NOs: 1627-1897.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence of any one of SEQ ID NOs: 272-542. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence of any one of SEQ ID NOs: 272-542. In some embodiments, the substitutions, insertions, or deletions occur in regions outside the CDRs (e.g., in the FRs). Optionally, the antibody or antigen-binding fragment thereof comprises the VL sequence of any one of SEQ ID NOs: 272-542, including one or more post-translational modifications of that sequence. In a particular embodiment, the VL comprises one, two or three CDRs selected from: (a) CDR-L1, comprising the amino acid sequence of any one of SEQ ID NOs: 814-1084; (b) CDR-L2, comprising the amino acid sequence of any one of SEQ ID NOs: 1356-1626; and (c) CDR-L3, comprising the amino acid sequence of any one of SEQ ID NOs: 1898-2168.

In one aspect, an antibody or antigen-binding fragment thereof is provided, wherein the antibody or antigen-binding fragment thereof comprises: a. a VH as in any of the embodiments provided above, and b. a VL as in any of the embodiments provided above, and wherein the selected VH and VL are paired according to table 5. In one aspect, an antibody or antigen-binding fragment thereof is provided, wherein the antibody or antigen-binding fragment thereof comprises: a. a CDR-H1 selected from any CDR-H1 in table 1, and b. a CDR-L1 selected from any CDR-L1 in table 1, wherein the selected CDR-H1 and CDR-L1 are paired according to table 5. In one aspect, an antibody or antigen-binding fragment thereof is provided, wherein the antibody or antigen-binding fragment thereof comprises: a. a CDR-H2 selected from any CDR-H2 in table 1, and b. a CDR-L2 selected from any CDR-L2 in table 1, wherein the selected CDR-H2 and CDR-L2 are paired according to table 5. In one aspect, an antibody or antigen-binding fragment thereof is provided, wherein the antibody or antigen-binding fragment thereof comprises: a. a CDR-H3 selected from any CDR-H3 in table 1, and b. a CDR-L3 selected from any CDR-L3 in table 1, wherein the selected CDR-H3 and CDR-L3 are paired according to table 5. In one aspect, an antibody or antigen-binding fragment thereof is provided, wherein the antibody or antigen-binding fragment thereof comprises: a. a CDR-H1, a CDR-H2, and a CDR-H3 selected from any CDR-H1, a CDR-H2, and a CDR-H3 in table 1, and b. a CDR-L1, a CDR-L2, and a CDR-L3 selected from any CDR-L1, CDR-L2, or CDR-L3 in table 1, wherein the selected CDR-H1, CDR-H2, CDR-H3, CDR-L1, CDR-L2, and CDR-L3 are paired according to table 1.

TBLA1001

In one aspect, the present disclosure provides an antibody or antigen-binding fragment thereof comprising at least one or both variable regions selected from the group consisting of (a) VH comprising the amino acid sequence of SEQ ID NO: 1; and (b) VL comprising the amino acid sequence of SEQ ID NO: 272.

In one aspect, the present disclosure provides an antibody or antigen-binding fragment thereof comprising at least one, two, three, four, five, or six CDRs selected from the group consisting of: (a) CDR-H1 comprising the amino acid sequence of SEQ ID NO: 543, (b) CDR-H2 comprising the amino acid sequence of SEQ ID NO: 1085, (c) CDR-H3 comprising the amino acid sequence of SEQ ID NO: 1627, (d) CDR-L1 comprising the amino acid sequence of SEQ ID NO: 814, (e) CDR-L2 comprising the amino acid sequence of SEQ ID NO: 1356, and (f) CDR-L3 comprising the amino acid sequence of SEQ ID NO: 1898.

In one aspect, the present disclosure provides an antibody or antigen-binding fragment thereof comprising a. CDR-H1 comprising the amino acid sequence of SEQ ID NO: 543, (b) CDR-H2 comprising the amino acid sequence of SEQ ID NO: 1085, (c) CDR-H3 comprising the amino acid sequence of SEQ ID NO: 1627, (d) CDR-L1 comprising the amino acid sequence of SEQ ID NO: 814, (e) CDR-L2 comprising the amino acid sequence of SEQ ID NO: 1356, and (f) CDR-L3 comprising the amino acid sequence of SEQ ID NO: 1898.

In one aspect, the present disclosure provides an antibody or antigen-binding fragment thereof comprising CDR-H3 comprising the amino acid sequence of SEQ ID NO: 1627, and CDR-L3 comprising the amino acid sequence of SEQ ID NO: 1898.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 543; b. CDR-H2 comprising the amino acid sequence of SEQ ID NO: 1085; c. CDR-H3 comprising the amino acid sequence of SEQ ID NO: 1627; and a VL comprising the amino acid sequence of SEQ ID NO: 272.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 814; b. CDR-L2 comprising the amino acid sequence of SEQ ID NO: 1356; c. CDR-L3 comprising the amino acid sequence of SEQ ID NO: 1898; and a VH comprising the amino acid sequence of SEQ ID NO: 1.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 1. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 1. In some embodiments, substitutions, insertions, or deletions occur in regions outside the CDRs (e.g., in the FRs). Optionally, the antibody or antigen-binding fragment thereof comprises the VH sequence SEQ ID NO: 1, including one or more post-translational modifications of that sequence. In a particular embodiment, the VH comprises one, two or three CDRs selected from: a. CDR-H1, comprising the amino acid sequence SEQ ID NO: 543; b. CDR-H2, comprising the amino acid sequence SEQ ID NO: 1085; and c. CDR-H3, comprising the amino acid sequence SEQ ID NO: 1627.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 272. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 272. In some embodiments, the substitutions, insertions, or deletions occur in regions outside the CDRs (e.g., in the FRs). Optionally, the antibody or antigen-binding fragment thereof comprises the VL sequence SEQ ID NO: 272, including one or more post-translational modifications of that sequence. In a particular embodiment, the VL comprises one, two or three CDRs selected from: a. CDR-L1, comprising the amino acid sequence SEQ ID NO: 814; b. CDR-L2, comprising the amino acid sequence SEQ ID NO: 1356; and c. CDR-L3, comprising the amino acid sequence SEQ ID NO: 1898.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 1, and the VL amino acid sequence of SEQ ID NO: 272, optionally including post-translational modifications of those sequences.

TBLA1002

In one aspect, the present disclosure provides an antibody or antigen-binding fragment thereof comprising at least one or both variable regions selected from: a. VH comprising the amino acid sequence of SEQ ID NO: 2; and b. VL comprising the amino acid sequence of SEQ ID NO: 273.

In one aspect, the present disclosure provides an antibody or antigen-binding fragment thereof comprising at least one, two, three, four, five, or six CDRs selected from: a. CDR-H1 comprising the amino acid sequence of SEQ ID NO: 544; b. CDR-H2 comprising the amino acid sequence of SEQ ID NO: 1086, c. CDR-H3 comprising the amino acid sequence of SEQ ID NO: 1628; d. CDR-L1 comprising the amino acid sequence of SEQ ID NO: 815; e. CDR-L2 comprising the amino acid sequence of SEQ ID NO: 1357; and f. CDR-L3 comprising the amino acid sequence of SEQ ID NO: 1899.

In one aspect, the present disclosure provides an antibody or antigen-binding fragment thereof comprising: a. CDR-H1 comprising the amino acid sequence of SEQ ID NO: 544; b. CDR-H2 comprising the amino acid sequence of SEQ ID NO: 1086, c. CDR-H3 comprising the amino acid sequence of SEQ ID NO: 1628; d. CDR-L1 comprising the amino acid sequence of SEQ ID NO: 815; e. CDR-L2 comprising the amino acid sequence of SEQ ID NO: 1357; and f. CDR-L3 comprising the amino acid sequence of SEQ ID NO: 1899.

In one aspect, the present disclosure provides an antibody or antigen-binding fragment thereof comprising CDR-H3 comprising the amino acid sequence of SEQ ID NO: 1628; and CDR-L3 comprising the amino acid sequence of SEQ ID NO: 1899.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 544; b. CDR-H2 comprising the amino acid sequence of SEQ ID NO: 1086; c. CDR-H3 comprising the amino acid sequence of SEQ ID NO: 1628; and a VL comprising the amino acid sequence of SEQ ID NO: 273.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 815; b. CDR-L2 comprising the amino acid sequence of SEQ ID NO: 1357; c. CDR-L3 comprising the amino acid sequence of SEQ ID NO: 1899, and a VH comprising the amino acid sequence of SEQ ID NO: 2.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 2. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 2. In some embodiments, substitutions, insertions, or deletions occur in regions outside the CDRs (e.g., in the FRs). Optionally, the antibody or antigen-binding fragment thereof comprises the VH sequence SEQ ID NO: 2, including one or more post-translational modifications of that sequence. In a particular embodiment, the VH comprises one, two or three CDRs selected from: a. CDR-H1, comprising the amino acid sequence SEQ ID NO: 544; b. CDR-H2, comprising the amino acid sequence SEQ ID NO: 1086; and c. CDR-H3, comprising the amino acid sequence SEQ ID NO: 1628.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 273. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 273. In some embodiments, the substitutions, insertions, or deletions occur in regions outside the CDRs (e.g., in the FRs). Optionally, the antibody or antigen-binding fragment thereof comprises the VL sequence SEQ ID NO: 273, including one or more post-translational modifications of that sequence. In a particular embodiment, the VL comprises one, two or three CDRs selected from: a. CDR-L1, comprising the amino acid sequence SEQ ID NO: 815; b. CDR-L2, comprising the amino acid sequence SEQ ID NO: 1357; and c. CDR-L3, comprising the amino acid sequence SEQ ID NO: 1899.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 2, and the VL amino acid sequence of SEQ ID NO: 273, optionally including post-translational modifications of those sequences.

TBLA1003

In one aspect, the present disclosure provides an antibody or antigen-binding fragment thereof comprising at least one or both variable regions selected from: a. VH comprising the amino acid sequence of SEQ ID NO: 3; and b. VL comprising the amino acid sequence of SEQ ID NO: 274.

In one aspect, the present disclosure provides an antibody or antigen-binding fragment thereof comprising at least one, two, three, four, five, or six CDRs selected from: a. CDR-H1 comprising the amino acid sequence of SEQ ID NO: 545; b. CDR-H2 comprising the amino acid sequence of SEQ ID NO: 1087; c. CDR-H3 comprising the amino acid sequence of SEQ ID NO: 1629; d. CDR-L1 comprising the amino acid sequence of SEQ ID NO: 816; e. CDR-L2 comprising the amino acid sequence of SEQ ID NO: 1358; and f. CDR-L3 comprising the amino acid sequence of SEQ ID NO: 1900.

In one aspect, the present disclosure provides an antibody or antigen-binding fragment thereof comprising: a. CDR-H1 comprising the amino acid sequence of SEQ ID NO: 545; b. CDR-H2 comprising the amino acid sequence of SEQ ID NO: 1087; c. CDR-H3 comprising the amino acid sequence of SEQ ID NO: 1629; d. CDR-L1 comprising the amino acid sequence of SEQ ID NO: 816; e. CDR-L2 comprising the amino acid sequence of SEQ ID NO: 1358; and f. CDR-L3 comprising the amino acid sequence of SEQ ID NO: 1900.

In one aspect, the present disclosure provides an antibody or antigen-binding fragment thereof comprising CDR-H3 comprising the amino acid sequence of SEQ ID NO: 1629; and CDR-L3 comprising the amino acid sequence of SEQ ID NO: 1900.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 545; b. CDR-H2 comprising the amino acid sequence of SEQ ID NO: 1087; c. CDR-H3 comprising the amino acid sequence of SEQ ID NO: 1629; and a VL comprising the amino acid sequence of SEQ ID NO: 274.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 816; b. CDR-L2 comprising the amino acid sequence of SEQ ID NO: 1358; c. CDR-L3 comprising the amino acid sequence of SEQ ID NO: 1900; and a VH comprising the amino acid sequence of SEQ ID NO: 3.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 3. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 3. In some embodiments, substitutions, insertions, or deletions occur in regions outside the CDRs (e.g., in the FRs). Optionally, the antibody or antigen-binding fragment thereof comprises the VH sequence SEQ ID NO: 3, including one or more post-translational modifications of that sequence. In a particular embodiment, the VH comprises one, two or three CDRs selected from: a. CDR-H1, comprising the amino acid sequence SEQ ID NO: 545; b. CDR-H2, comprising the amino acid sequence SEQ ID NO: 1087; and c. CDR-H3, comprising the amino acid sequence SEQ ID NO: 1629.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 274. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 274. In some embodiments, the substitutions, insertions, or deletions occur in regions outside the CDRs (e.g., in the FRs). Optionally, the antibody or antigen-binding fragment thereof comprises the VL sequence SEQ ID NO: 274, including one or more post-translational modifications of that sequence. In a particular embodiment, the VL comprises one, two or three CDRs selected from: a CDR-L1, comprising the amino acid sequence SEQ ID NO: 816; b. CDR-L2, comprising the amino acid sequence SEQ ID NO: 1358; and c. CDR-L3, comprising the amino acid sequence SEQ ID NO: 1900.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 3, and the VL amino acid sequence of SEQ ID NO: 274, optionally including post-translational modifications of those sequences.
TBLA1004

In one aspect, the present disclosure provides an antibody or antigen-binding fragment thereof comprising at least one or both variable regions selected from: a VH comprising the amino acid sequence of SEQ ID NO: 4; and b. a VL comprising the amino acid sequence of SEQ ID NO: 275.

In one aspect, the present disclosure provides an antibody or antigen-binding fragment thereof comprising at least one, two, three, four, five, or six CDRs selected from: a. CDR-H1 comprising the amino acid sequence of SEQ ID NO: 546; b. CDR-H2 comprising the amino acid sequence of SEQ ID NO: 1088; c. CDR-H3 comprising the amino acid sequence of SEQ ID NO: 1630; d. CDR-L1 comprising the amino acid sequence of SEQ ID NO: 817; e. CDR-L2 comprising the amino acid sequence of SEQ ID NO: 1359; and f. CDR-L3 comprising the amino acid sequence of SEQ ID NO: 1901.

In one aspect, the present disclosure provides an antibody or antigen-binding fragment thereof comprising CDR-H3 comprising the amino acid sequence of SEQ ID NO: 1630; d. CDR-L1 comprising the amino acid sequence of SEQ ID NO: 817; e. CDR-L2 comprising the amino acid sequence of SEQ ID NO: 1359; and CDR-L3 comprising the amino acid sequence of SEQ ID NO: 1901. In one aspect, the present disclosure provides an antibody or antigen-binding fragment thereof comprising a. CDR-H1 comprising the amino acid sequence of SEQ ID NO: 546; b. CDR-H2 comprising the amino acid sequence of SEQ ID NO: 1088; c. CDR-H3 comprising the amino acid sequence of SEQ ID NO: 1630; d. CDR-L1 comprising the amino acid sequence of SEQ ID NO: 817; e. CDR-L2 comprising the amino acid sequence of SEQ ID NO: 1359; and f. CDR-L3 comprising the amino acid sequence of SEQ ID NO: 1901.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 546; b. CDR-H2 comprising the amino acid sequence of SEQ ID NO: 1088, c. CDR-H3 comprising the amino acid sequence of SEQ ID NO: 1630; and a VL comprising the amino acid sequence of SEQ ID NO: 275.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 817; b. CDR-L2 comprising the amino acid sequence of SEQ ID NO: 1359; c. CDR-L3 comprising the amino acid sequence of SEQ ID NO: 1901; and a VH comprising the amino acid sequence of SEQ ID NO: 4.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 4. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 4. In some embodiments, substitutions, insertions, or deletions occur in regions outside the CDRs (e.g., in the FRs). Optionally, the antibody or antigen-binding fragment thereof comprises the VH sequence SEQ ID NO: 4, including one or more post-translational modifications of that sequence. In a particular embodiment, the VH comprises one, two or three CDRs selected from: a CDR-H1, comprising the amino acid sequence SEQ ID NO: 546; b CDR-H2, comprising the amino acid sequence SEQ ID NO: 1088; and c. CDR-H3, comprising the amino acid sequence SEQ ID NO: 1630.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 275. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 275. In some embodiments, the substitutions, insertions, or deletions occur in regions outside the CDRs (e.g., in the FRs). Optionally, the antibody or antigen-binding fragment thereof comprises the VL sequence SEQ ID NO: 275, including one or more post-translational modifications of that sequence. In a particular embodiment, the VL comprises one, two or three CDRs selected from: a. CDR-L1, comprising the amino acid sequence SEQ ID NO: 817; b. CDR-L2, comprising the amino acid sequence SEQ ID NO: 1359; and c. CDR-L3, comprising the amino acid sequence SEQ ID NO: 1901.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 4, and the VL amino acid sequence of SEQ ID NO: 275, optionally including post-translational modifications of those sequences.

TBLA1005

In one aspect, the present disclosure provides an antibody or antigen-binding fragment thereof comprising at least one or both variable regions selected from: a. VH comprising the amino acid sequence of SEQ ID NO: 5 and b. VL comprising the amino acid sequence of SEQ ID NO: 276.

In one aspect, the present disclosure provides an antibody or antigen-binding fragment thereof comprising at least one, two, three, four, five, or six CDRs selected from: a. CDR-H1 comprising the amino acid sequence of SEQ ID NO: 547; b. CDR-H2 comprising the amino acid sequence of SEQ ID NO: 1089; c. CDR-H3 comprising the amino acid sequence of SEQ ID NO: 1631; d. CDR-L1 comprising the amino acid sequence of SEQ ID NO: 818; e. CDR-L2 comprising the amino acid sequence of SEQ ID NO: 1360; and f. CDR-L3 comprising the amino acid sequence of SEQ ID NO: 1902.

In one aspect, the present disclosure provides an antibody or antigen-binding fragment thereof comprising a. CDR-H1 comprising the amino acid sequence of SEQ ID NO: 547; b. CDR-H2 comprising the amino acid sequence of SEQ ID NO: 1089; c. CDR-H3 comprising the amino acid sequence of SEQ ID NO: 1631; d. CDR-L1 comprising the amino acid sequence of SEQ ID NO: 818; e. CDR-L2 comprising the amino acid sequence of SEQ ID NO: 1360; and f. CDR-L3 comprising the amino acid sequence of SEQ ID NO: 1902. In one aspect, the present disclosure provides an antibody or antigen-binding fragment thereof comprising CDR-H3 comprising the amino acid sequence of SEQ ID NO: 1631; and CDR-L3 comprising the amino acid sequence of SEQ ID NO: 1902.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 547; b. CDR-H2 comprising the amino acid sequence of SEQ ID NO: 1089; c. CDR-H3 comprising the amino acid sequence of SEQ ID NO: 1631; and a VL comprising the amino acid sequence of SEQ ID NO: 276.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 818; b. CDR-L2 comprising the amino acid sequence of SEQ ID NO: 1360; c. CDR-L3 comprising the amino acid sequence of SEQ ID NO: 1902; and a VH comprising the amino acid sequence of SEQ ID NO: 5.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 5. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 5. In some embodiments, substitutions, insertions, or deletions occur in regions outside the CDRs (e.g., in the FRs). Optionally, the antibody or antigen-binding fragment thereof comprises the VH sequence SEQ ID NO: 5, including one or more post-translational modifications of that sequence. In a particular embodiment, the VH comprises one, two or three CDRs selected from: a. CDR-H1, comprising the amino acid sequence SEQ ID NO: 547; b. CDR-H2, comprising the amino acid sequence SEQ ID NO: 1089; and c. CDR-H3, comprising the amino acid sequence SEQ ID NO: 1631.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 276. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 276. In some embodiments, the substitutions, insertions, or deletions occur in regions outside the CDRs (e.g., in the FRs). Optionally, the antibody or antigen-binding fragment thereof comprises the VL sequence SEQ ID NO: 276, including one or more post-translational modifications of that sequence. In a particular embodiment, the VL comprises one, two or three CDRs selected from: a. CDR-L1, comprising the amino acid sequence SEQ ID NO: 818; b. CDR-L2, comprising the amino acid sequence SEQ ID NO: 1360; and c. CDR-L3, comprising the amino acid sequence SEQ ID NO: 1902.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 5, and the VL amino acid sequence of SEQ ID NO: 276, optionally including post-translational modifications of those sequences.

TBLA1006

In one aspect, the present disclosure provides an antibody or antigen-binding fragment thereof comprising at least one or both variable regions selected from: a. VH comprising the amino acid sequence of SEQ ID NO: 6 and b. VL comprising the amino acid sequence of SEQ ID NO: 277.

In one aspect, the present disclosure provides an antibody or antigen-binding fragment thereof comprising at least one, two, three, four, five, or six CDRs selected from: a. CDR-H1 comprising the amino acid sequence of SEQ ID NO: 548; b. CDR-H2 comprising the amino acid sequence of SEQ ID NO: 1090; c. CDR-H3 comprising the amino acid sequence of SEQ ID NO: 1632; d. CDR-L1 comprising the amino acid sequence of SEQ ID NO: 819; e. CDR-L2 comprising the amino acid sequence of SEQ ID NO: 1361; and f. CDR-L3 comprising the amino acid sequence of SEQ ID NO: 1903.

In one aspect, the present disclosure provides an antibody or antigen-binding fragment thereof comprising: a. CDR-H1 comprising the amino acid sequence of SEQ ID NO: 548; b. CDR-H2 comprising the amino acid sequence of SEQ ID NO: 1090; c. CDR-H3 comprising the amino acid sequence of SEQ ID NO: 1632; d. CDR-L1 comprising the amino acid sequence of SEQ ID NO: 819; e. CDR-L2 comprising the amino acid sequence of SEQ ID NO: 1361; and f. CDR-L3 comprising the amino acid sequence of SEQ ID NO: 1903. In one aspect, the present disclosure provides an antibody or antigen-binding fragment thereof comprising CDR-H3 comprising the amino acid sequence of SEQ ID NO: 1632; and CDR-L3 comprising the amino acid sequence of SEQ ID NO: 1903.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 548; b. CDR-H2 comprising the amino acid sequence of SEQ ID NO: 1090; c. CDR-H3 comprising the amino acid sequence of SEQ ID NO: 1632; and a VL comprising the amino acid sequence of SEQ ID NO: 277.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 819; b. CDR-L2 comprising the amino acid sequence of SEQ ID NO: 1361; c. CDR-L3 comprising the amino acid sequence of SEQ ID NO: 1903; and a VH comprising the amino acid sequence of SEQ ID NO: 6.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 6. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 6. In some embodiments, substitutions, insertions, or deletions occur in regions outside the CDRs (e.g., in the FRs). Optionally, the antibody or antigen-binding fragment thereof comprises the VH sequence SEQ ID NO: 6, including one or more post-translational modifications of that sequence. In a particular embodiment, the VH comprises one, two or three CDRs selected from: a. CDR-H1, comprising the amino acid sequence SEQ ID NO: 548; b. CDR-H2, comprising the amino acid sequence SEQ ID NO: 1090; and c. CDR-H3, comprising the amino acid sequence SEQ ID NO: 1632.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 277. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 277. In some embodiments, the substitutions, insertions, or deletions occur in regions outside the CDRs (e.g., in the FRs). Optionally, the antibody or antigen-binding fragment thereof comprises the VL sequence SEQ ID NO: 277, including one or more post-translational modifications of that sequence. In a particular embodiment, the VL comprises one, two or three CDRs selected from: a. CDR-L1, comprising the amino acid sequence SEQ ID NO: 819; b. CDR-L2, comprising the amino acid sequence SEQ ID NO: 1361; and c. CDR-L3, comprising the amino acid sequence SEQ ID NO: 1903.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 6, and the VL amino acid sequence of SEQ ID NO: 277, optionally including post-translational modifications of those sequences.

TBLA1007

In one aspect, the present disclosure provides an antibody or antigen-binding fragment thereof comprising at least one or both variable regions selected from: a. VH comprising the amino acid sequence of SEQ ID NO: 7 and b. VL comprising the amino acid sequence of SEQ ID NO: 278.

In one aspect, the present disclosure provides an antibody or antigen-binding fragment thereof comprising at least one, two, three, four, five, or six CDRs selected from: a. CDR-H1 comprising the amino acid sequence of SEQ ID NO: 549; b. CDR-H2 comprising the amino acid sequence of SEQ ID NO: 1091; c. CDR-H3 comprising the amino acid sequence of SEQ ID NO: 1633; d. CDR-L1 comprising the amino acid sequence of SEQ ID NO: 820; e. CDR-L2 comprising the amino acid sequence of SEQ ID NO: 1362; and f. CDR-L3 comprising the amino acid sequence of SEQ ID NO: 1904.

In one aspect, the present disclosure provides an antibody or antigen-binding fragment thereof comprising: a. CDR-H1 comprising the amino acid sequence of SEQ ID NO: 549; b. CDR-H2 comprising the amino acid sequence of SEQ ID NO: 1091; c. CDR-H3 comprising the amino acid sequence of SEQ ID NO: 1633; d. CDR-L1 comprising the amino acid sequence of SEQ ID NO: 820; e. CDR-L2 comprising the amino acid sequence of SEQ ID NO: 1362; and f. CDR-L3 comprising the amino acid sequence of SEQ ID NO: 1904. In one aspect, the present disclosure provides an antibody or antigen-binding fragment thereof comprising CDR-H3 comprising the amino acid sequence of SEQ ID NO: 1633; and CDR-L3 comprising the amino acid sequence of SEQ ID NO: 1904.

In one aspect, the present disclosure provides an antibody or antigen-binding fragment thereof comprising at least one, at least two, or all three VH CDR sequences selected from:

a. CDR-H1 comprising the amino acid sequence of SEQ ID NO: 549; b. CDR-H2 comprising the amino acid sequence of SEQ ID NO: 1091; c. CDR-H3 comprising the amino acid sequence of SEQ ID NO: 1633; and a VL comprising the amino acid sequence of SEQ ID NO: 278.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 820; b. CDR-L2 comprising the amino acid sequence of SEQ ID NO: 1362; c. CDR-L3 comprising the amino acid sequence of SEQ ID NO: 1904; and a VH comprising the amino acid sequence of SEQ ID NO: 7.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 7. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 7. In some embodiments, substitutions, insertions, or deletions occur in regions outside the CDRs (e.g., in the FRs). Optionally, the antibody or antigen-binding fragment thereof comprises the VH sequence SEQ ID NO: 7, including one or more post-translational modifications of that sequence. In a particular embodiment, the VH comprises one, two or three CDRs selected from: a. CDR-H1, comprising the amino acid sequence SEQ ID NO: 549; b. CDR-H2, comprising the amino acid sequence SEQ ID NO: 1091; and c. CDR-H3, comprising the amino acid sequence SEQ ID NO: 1633.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 278. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 278. In some embodiments, the substitutions, insertions, or deletions occur in regions outside the CDRs (e.g., in the FRs). Optionally, the antibody or antigen-binding fragment thereof comprises the VL sequence SEQ ID NO: 278, including one or more post-translational modifications of that sequence. In a particular embodiment, the VL comprises one, two or three CDRs selected from: a. CDR-L1, comprising the amino acid sequence SEQ ID NO: 820; b. CDR-L2, comprising the amino acid sequence SEQ ID NO: 1362; and c. CDR-L3, comprising the amino acid sequence SEQ ID NO: 1904.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 7, and the VL amino acid sequence of SEQ ID NO: 278, optionally including post-translational modifications of those sequences.

TBLA1008

In one aspect, the present disclosure provides an antibody or antigen-binding fragment thereof comprising at least one or both variable regions selected from: a. VH comprising the amino acid sequence of SEQ ID NO: 8 and b. VL comprising the amino acid sequence of SEQ ID NO: 279.

In one aspect, the present disclosure provides an antibody or antigen-binding fragment thereof comprising at least one, two, three, four, five, or six CDRs selected from: a. CDR-H1 comprising the amino acid sequence of SEQ ID NO: 550; b. CDR-H2 comprising the amino acid sequence of SEQ ID NO: 1092; c. CDR-H3 comprising the amino acid sequence of SEQ ID NO: 1634; d. CDR-L1 comprising the amino acid sequence of SEQ ID NO: 821; e. CDR-L2 comprising the amino acid sequence of SEQ ID NO: 1363; and f. CDR-L3 comprising the amino acid sequence of SEQ ID NO: 1905.

In one aspect, the present disclosure provides an antibody or antigen-binding fragment thereof comprising: a. CDR-H1 comprising the amino acid sequence of SEQ ID NO: 550; b. CDR-H2 comprising the amino acid sequence of SEQ ID NO: 1092; c. CDR-H3 comprising the amino acid sequence of SEQ ID NO: 1634; d. CDR-L1 comprising the amino acid sequence of SEQ ID NO: 821; e. CDR-L2 comprising the amino acid sequence of SEQ ID NO: 1363; and f. CDR-L3 comprising the amino acid sequence of SEQ ID NO: 1905. In one aspect, the present disclosure provides an antibody or antigen-binding fragment thereof comprising a CDR-H3 comprising the amino acid sequence of SEQ ID NO: 1634; and CDR-L3 comprising the amino acid sequence of SEQ ID NO: 1905.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 550; b. CDR-H2 comprising the amino acid sequence of SEQ ID NO: 1092; c. CDR-H3 comprising the amino acid sequence of SEQ ID NO: 1634; and a VL comprising the amino acid sequence of SEQ ID NO: 279.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 821; b. CDR-L2 comprising the amino acid sequence of SEQ ID NO: 1363; c. CDR-L3 comprising the amino acid sequence of SEQ ID NO: 1905; and a VH comprising the amino acid sequence of SEQ ID NO: 8.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 8. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 8. In some embodiments, substitutions, insertions, or deletions occur in regions outside the CDRs (e.g., in the FRs). Optionally, the antibody or antigen-binding fragment thereof comprises the VH sequence SEQ ID NO: 8, including one or more post-translational modifications of that sequence. In a particular embodiment, the VH comprises one, two or three CDRs selected from: a. CDR-H1, comprising the amino acid sequence SEQ ID NO: 550; b. CDR-H2, comprising the amino acid sequence SEQ ID NO: 1092; and c. CDR-H3, comprising the amino acid sequence SEQ ID NO: 1634.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 279. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 279. In some embodiments, the substitutions, insertions, or deletions occur in regions outside the CDRs (e.g., in the FRs). Optionally, the antibody or antigen-binding fragment thereof comprises the VL sequence SEQ ID NO: 279, including one or more post-translational modifications of that sequence. In a particular embodiment, the VL comprises one, two or three CDRs selected from: a. CDR-L1, comprising the amino acid sequence SEQ ID NO: 821; b. CDR-L2, comprising the amino acid sequence SEQ ID NO: 1363; and c. CDR-L3, comprising the amino acid sequence SEQ ID NO: 1905.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 8, and the VL amino acid sequence of SEQ ID NO: 279, optionally including post-translational modifications of those sequences.
TBLA1009

In one aspect, the present disclosure provides an antibody or antigen-binding fragment thereof comprising at least one or both variable regions selected from: a. VH comprising the amino acid sequence of SEQ ID NO: 9 and b. VL comprising the amino acid sequence of SEQ ID NO: 280.

In one aspect, the present disclosure provides an antibody or antigen-binding fragment thereof comprising at least one, two, three, four, five, or six CDRs selected from: a. CDR-H1 comprising the amino acid sequence of SEQ ID NO: 551; b. CDR-H2 comprising the amino acid sequence of SEQ ID NO: 1093; c. CDR-H3 comprising the amino acid sequence of SEQ ID NO: 1635; d. CDR-L1 comprising the amino acid sequence of SEQ ID NO: 822; e. CDR-L2 comprising the amino acid sequence of SEQ ID NO: 1364; and f. CDR-L3 comprising the amino acid sequence of SEQ ID NO: 1906.

In one aspect, the present disclosure provides an antibody or antigen-binding fragment thereof comprising: a. CDR-H1 comprising the amino acid sequence of SEQ ID NO: 551; b. CDR-H2 comprising the amino acid sequence of SEQ ID NO: 1093; c. CDR-H3 comprising the amino acid sequence of SEQ ID NO: 1635; d. CDR-L1 comprising the amino acid sequence of SEQ ID NO: 822; e. CDR-L2 comprising the amino acid sequence of SEQ ID NO: 1364; and f. CDR-L3 comprising the amino acid sequence of SEQ ID NO: 1906.

In one aspect, the present disclosure provides an antibody or antigen-binding fragment thereof comprising a CDR-H3 comprising the amino acid sequence of SEQ ID NO: 1635; and a CDR-L3 comprising the amino acid sequence of SEQ ID NO: 1906.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 551; b. CDR-H2 comprising the amino acid sequence of SEQ ID NO: 1093; c. CDR-H3 comprising the amino acid sequence of SEQ ID NO: 1635; and a VL comprising the amino acid sequence of SEQ ID NO: 280.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 822; b. CDR-L2 comprising the amino acid sequence of SEQ ID NO: 1364; c. CDR-L3 comprising the amino acid sequence of SEQ ID NO: 1906; and a VH comprising the amino acid sequence of SEQ ID NO: 9.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 9. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 9. In some embodiments, substitutions, insertions, or deletions occur in regions outside the CDRs (e.g., in the FRs). Optionally, the antibody or antigen-binding fragment thereof comprises the VH sequence SEQ ID NO: 9, including one or more post-translational modifications of that sequence. In a particular embodiment, the VH comprises one, two or three CDRs selected from: a. CDR-H1, comprising the amino acid sequence SEQ ID NO: 551; b. CDR-H2, comprising the amino acid sequence SEQ ID NO: 1093; and c. CDR-H3, comprising the amino acid sequence SEQ ID NO: 1635.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 280. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 280. In some embodiments, the substitutions, insertions, or deletions occur in regions outside the CDRs (e.g., in the FRs). Optionally, the antibody or antigen-binding fragment thereof comprises the VL sequence SEQ ID NO: 280, including one or more post-translational modifications of that sequence. In a particular embodiment, the VL comprises one, two or three CDRs selected from: a. CDR-L1, comprising the amino acid sequence SEQ ID NO: 822; b. CDR-L2, comprising the amino acid sequence SEQ ID NO: 1364; and c. CDR-L3, comprising the amino acid sequence SEQ ID NO: 1906.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 9, and the VL amino acid sequence of SEQ ID NO: 280, optionally including post-translational modifications of those sequences.
TBLA1010

In one aspect, the present disclosure provides an antibody or antigen-binding fragment thereof comprising at least one or both variable regions selected from: a. VH comprising the amino acid sequence of SEQ ID NO: 10 and b. VL comprising the amino acid sequence of SEQ ID NO: 281.

In one aspect, the present disclosure provides an antibody or antigen-binding fragment thereof comprising at least one, two, three, four, five, or six CDRs selected from: a. CDR-H1 comprising the amino acid sequence of SEQ ID NO: 552; b. CDR-H2 comprising the amino acid sequence of SEQ ID NO: 1094; c. CDR-H3 comprising the amino acid sequence of SEQ ID NO: 1636; d. CDR-L1 comprising the amino acid sequence of SEQ ID NO: 823; e. CDR-L2 comprising the amino acid sequence of SEQ ID NO: 1365; and f. CDR-L3 comprising the amino acid sequence of SEQ ID NO: 1907.

In one aspect, the present disclosure provides an antibody or antigen-binding fragment thereof comprising: a. CDR-H1 comprising the amino acid sequence of SEQ ID NO: 552; b. CDR-H2 comprising the amino acid sequence of SEQ ID NO: 1094; c. CDR-H3 comprising the amino acid sequence of SEQ ID NO: 1636; d. CDR-L1 comprising the amino acid sequence of SEQ ID NO: 823; e. CDR-L2 comprising the amino acid sequence of SEQ ID NO: 1365; and f. CDR-L3 comprising the amino acid sequence of SEQ ID NO: 1907. In one aspect, the present disclosure provides an antibody or antigen-binding fragment thereof comprising a CDR-H3 comprising the amino acid sequence of SEQ ID NO: 1636; and a CDR-L3 comprising the amino acid sequence of SEQ ID NO: 1907.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 552; b. CDR-H2 comprising the amino acid sequence of SEQ ID NO: 1094; c. CDR-H3 comprising the amino acid sequence of SEQ ID NO: 1636; and a VL comprising the amino acid sequence of SEQ ID NO: 281.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 823; b. CDR-L2 comprising the amino acid sequence of SEQ ID NO: 1365; c. CDR-L3 comprising the amino acid sequence of SEQ ID NO: 1907; and a VH comprising the amino acid sequence of SEQ ID NO: 10.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 10. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 10. In some embodiments, substitutions, insertions, or deletions occur in regions outside the CDRs (e.g., in the FRs). Optionally, the antibody or antigen-binding fragment thereof comprises the VH sequence SEQ ID NO: 10, including one or more post-translational modifications of that sequence. In a particular embodiment, the VH comprises one, two or three CDRs selected from: a. CDR-H1, comprising the amino acid sequence SEQ ID NO: 552; b. CDR-H2, comprising the amino acid sequence SEQ ID NO: 1094; and a CDR-H3, comprising the amino acid sequence SEQ ID NO: 1636.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 281. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 281. In some embodiments, the substitutions, insertions, or deletions occur in regions outside the CDRs (e.g., in the FRs). Optionally, the antibody or antigen-binding fragment thereof comprises the VL sequence SEQ ID NO: 281, including one or more post-translational modifications of that sequence. In a particular embodiment, the VL comprises one, two or three CDRs selected from: a. CDR-L1, comprising the amino acid sequence SEQ ID NO: 823; b. CDR-L2, comprising the amino acid sequence SEQ ID NO: 1365; and c. CDR-L3, comprising the amino acid sequence SEQ ID NO: 1907.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 10, and the VL amino acid sequence of SEQ ID NO: 281, optionally including post-translational modifications of those sequences.
TBLA1011

In one aspect, the present disclosure provides an antibody or antigen-binding fragment thereof comprising at least one or both variable regions selected from: a. VH comprising the amino acid sequence of SEQ ID NO: 11 and VL comprising the amino acid sequence of SEQ ID NO: 282.

In one aspect, the present disclosure provides an antibody or antigen-binding fragment thereof comprising at least one, two, three, four, five, or six CDRs selected from: a. CDR-H1 comprising the amino acid sequence of SEQ ID NO: 553; b. CDR-H2 comprising the amino acid sequence of SEQ ID NO: 1095; c. CDR-H3 comprising the amino acid sequence of SEQ ID NO: 1637; d. CDR-L1 comprising the amino acid sequence of SEQ ID NO: 824; e. CDR-L2 comprising the amino acid sequence of SEQ ID NO: 1366; and f. CDR-L3 comprising the amino acid sequence of SEQ ID NO: 1908.

In one aspect, the present disclosure provides an antibody or antigen-binding fragment thereof comprising: a. CDR-H1 comprising the amino acid sequence of SEQ ID NO: 553; b. CDR-H2 comprising the amino acid sequence of SEQ ID NO: 1095; c. CDR-H3 comprising the amino acid sequence of SEQ ID NO: 1637; d. CDR-L1 comprising the amino acid sequence of SEQ ID NO: 824; e. CDR-L2 comprising the amino acid sequence of SEQ ID NO: 1366; and f. CDR-L3 comprising the amino acid sequence of SEQ ID NO: 1908. In one aspect, the present disclosure provides an antibody or antigen-binding fragment thereof comprising a CDR-H3 comprising the amino acid sequence of SEQ ID NO: 1637; and a CDR-L3 comprising the amino acid sequence of SEQ ID NO: 1908.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 553; b. CDR-H2 comprising the amino acid sequence of SEQ ID NO: 1095; c. CDR-H3 comprising the amino acid sequence of SEQ ID NO: 1637; and a VL comprising the amino acid sequence of SEQ ID NO: 282.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 824; b. CDR-L2 comprising the amino acid sequence of SEQ ID NO: 1366; c. CDR-L3 comprising the amino acid sequence of SEQ ID NO: 1908; and a VH comprising the amino acid sequence of SEQ ID NO: 11.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 11. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 11. In some embodiments, substitutions, insertions, or deletions occur in regions outside the CDRs (e.g., in the FRs). Optionally, the antibody or antigen-binding fragment thereof comprises the VH sequence SEQ ID NO: 11, including one or more post-translational modifications of that sequence. In a particular embodiment, the VH comprises one, two or three CDRs selected from: a. CDR-H1, comprising the amino acid sequence SEQ ID NO: 553; b. CDR-H2, comprising the amino acid sequence SEQ ID NO: 1095; and c. CDR-H3, comprising the amino acid sequence SEQ ID NO: 1637.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 282. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 282. In some embodiments, the substitutions, insertions, or deletions occur in regions outside the CDRs (e.g., in the FRs). Optionally, the antibody or antigen-binding fragment thereof comprises the VL sequence SEQ ID NO: 282, including one or more post-translational modifications of that sequence. In a particular embodiment, the VL comprises one, two or three CDRs selected from: a. CDR-L1, comprising the amino acid sequence SEQ ID NO: 824; b. CDR-L2, comprising the amino acid sequence SEQ ID NO: 1366; and c. CDR-L3, comprising the amino acid sequence SEQ ID NO: 1908.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 11, and the VL amino acid sequence of SEQ ID NO: 282, optionally including post-translational modifications of those sequences.

TBLA1012

In one aspect, the present disclosure provides an antibody or antigen-binding fragment thereof comprising at least one or both variable regions selected from: a. VH comprising the amino acid sequence of SEQ ID NO: 12 and b. VL comprising the amino acid sequence of SEQ ID NO: 283.

In one aspect, the present disclosure provides an antibody or antigen-binding fragment thereof comprising at least one, two, three, four, five, or six CDRs selected from: a. CDR-H1 comprising the amino acid sequence of SEQ ID NO: 554; b. CDR-H2 comprising the amino acid sequence of SEQ ID NO: 1096; c. CDR-H3 comprising the amino acid sequence of SEQ ID NO: 1638; d. CDR-L1 comprising the amino acid sequence of SEQ ID NO: 825; e. CDR-L2 comprising the amino acid sequence of SEQ ID NO: 1367; and f. CDR-L3 comprising the amino acid sequence of SEQ ID NO: 1909.

In one aspect, the present disclosure provides an antibody or antigen-binding fragment thereof comprising: a. CDR-H1 comprising the amino acid sequence of SEQ ID NO: 554; b. CDR-H2 comprising the amino acid sequence of SEQ ID NO: 1096; c. CDR-H3 comprising the amino acid sequence of SEQ ID NO: 1638; d. CDR-L1 comprising the amino acid sequence of SEQ ID NO: 825; e. CDR-L2 comprising the amino acid sequence of SEQ ID NO: 1367; and f. CDR-L3 comprising the amino acid sequence of SEQ ID NO: 1909. In one aspect, the present disclosure provides an antibody or antigen-binding fragment thereof comprising a CDR-H3 comprising the amino acid sequence of SEQ ID NO: 1638 and a CDR-L3 comprising the amino acid sequence of SEQ ID NO: 1909.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 554; b. CDR-H2 comprising the amino acid sequence of SEQ ID NO: 1096; c. CDR-H3 comprising the amino acid sequence of SEQ ID NO: 1638; and a VL comprising the amino acid sequence of SEQ ID NO: 283.

In one aspect, the present disclosure provides an antibody or antigen-binding fragment thereof comprising at least one, at least two, or all three VL CDR sequences selected from: a CDR-L1 comprising the amino acid sequence of SEQ ID NO: 825; b CDR-L2 comprising the amino acid sequence of SEQ ID NO: 1367; c CDR-L3 comprising the amino acid sequence of SEQ ID NO: 1909; and a VH comprising the amino acid sequence of SEQ ID NO: 12.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 12. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 12. In some embodiments, substitutions, insertions, or deletions occur in regions outside the CDRs (e.g., in the FRs). Optionally, the antibody or antigen-binding fragment thereof comprises the VH sequence SEQ ID NO: 12, including one or more post-translational modifications of that sequence. In a particular embodiment, the VH comprises one, two or three CDRs selected from: a. CDR-H1, comprising the amino acid sequence SEQ ID NO: 554; b. CDR-H2, comprising the amino acid sequence SEQ ID NO: 1096; and c. CDR-H3, comprising the amino acid sequence SEQ ID NO: 1638.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 283. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 283. In some embodiments, the substitutions, insertions, or deletions occur in regions outside the CDRs (e.g., in the FRs). Optionally, the antibody or antigen-binding fragment thereof comprises the VL sequence SEQ ID NO: 283, including one or more post-translational modifications of that sequence. In a particular embodiment, the VL comprises one, two or three CDRs selected from: a. CDR-L1, comprising the amino acid sequence SEQ ID NO: 825; b. CDR-L2, comprising the amino acid sequence SEQ ID NO: 1367; and c. CDR-L3, comprising the amino acid sequence SEQ ID NO: 1909.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 12, and the VL amino acid sequence of SEQ ID NO: 283, optionally including post-translational modifications of those sequences.
TBLA1013

In one aspect, the present disclosure provides an antibody or antigen-binding fragment thereof comprising at least one or both variable regions selected from: a. VH comprising the amino acid sequence of SEQ ID NO: 13 and b. VL comprising the amino acid sequence of SEQ ID NO: 284.

In one aspect, the present disclosure provides an antibody or antigen-binding fragment thereof comprising at least one, two, three, four, five, or six CDRs selected from: a. CDR-H1 comprising the amino acid sequence of SEQ ID NO: 555; b. CDR-H2 comprising the amino acid sequence of SEQ ID NO: 1097; c. CDR-H3 comprising the amino acid sequence of SEQ ID NO: 1639; d. CDR-L1 comprising the amino acid sequence of SEQ ID NO: 826; e. CDR-L2 comprising the amino acid sequence of SEQ ID NO: 1368; and f. CDR-L3 comprising the amino acid sequence of SEQ ID NO: 1910.

In one aspect, the present disclosure provides an antibody or antigen-binding fragment thereof comprising: a. CDR-H1 comprising the amino acid sequence of SEQ ID NO: 555; b. CDR-H2 comprising the amino acid sequence of SEQ ID NO: 1097; c. CDR-H3 comprising the amino acid sequence of SEQ ID NO: 1639; d. CDR-L1 comprising the amino acid sequence of SEQ ID NO: 826; e. CDR-L2 comprising the amino acid sequence of SEQ ID NO: 1368; and f. CDR-L3 comprising the amino acid sequence of SEQ ID NO: 1910.

In one aspect, the present disclosure provides an antibody or antigen-binding fragment thereof comprising a CDR-H3 comprising the amino acid sequence of SEQ ID NO: 1639; and a CDR-L3 comprising the amino acid sequence of SEQ ID NO: 1910.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 555; b. CDR-H2 comprising the amino acid sequence of SEQ ID NO: 1097; c. CDR-H3 comprising the amino acid sequence of SEQ ID NO: 1639; and a VL comprising the amino acid sequence of SEQ ID NO: 284.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 826; b. CDR-L2 comprising the amino acid sequence of SEQ ID NO: 1368; c. CDR-L3 comprising the amino acid sequence of SEQ ID NO: 1910; and a VH comprising the amino acid sequence of SEQ ID NO: 13.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 13. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 13. In some embodiments, substitutions, insertions, or deletions occur in regions outside the CDRs (e.g., in the FRs). Optionally, the antibody or antigen-binding fragment thereof comprises the VH sequence SEQ ID NO: 13, including one or more post-translational modifications of that sequence. In a particular embodiment, the VH comprises one, two or three CDRs selected from: a. CDR-H1, comprising the amino acid sequence SEQ ID NO: 555; b. CDR-H2, comprising the amino acid sequence SEQ ID NO: 1097; and c. CDR-H3, comprising the amino acid sequence SEQ ID NO: 1639.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 284. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 284. In some embodiments, the substitutions, insertions, or deletions occur in regions outside the CDRs (e.g., in the FRs). Optionally, the antibody or antigen-binding fragment thereof comprises the VL sequence SEQ ID NO: 284, including one or more post-translational modifications of that sequence. In a particular embodiment, the VL comprises one, two or three CDRs selected from: a. CDR-L1, comprising the amino acid sequence SEQ ID NO: 826; b. CDR-L2, comprising the amino acid sequence SEQ ID NO: 1368; and c. CDR-L3, comprising the amino acid sequence SEQ ID NO: 1910.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 13, and the VL amino acid sequence of SEQ ID NO: 284, optionally including post-translational modifications of those sequences.
TBRE1001

In one aspect, the present disclosure provides an antibody or antigen-binding fragment thereof comprising at least one or both variable regions selected from: a. VH comprising the amino acid sequence of SEQ ID NO: 14 and b. VL comprising the amino acid sequence of SEQ ID NO: 285.

In one aspect, the present disclosure provides an antibody or antigen-binding fragment thereof comprising at least one, two, three, four, five, or six CDRs selected from: a. CDR-H1 comprising the amino acid sequence of SEQ ID NO: 556; b. CDR-H2 comprising the amino acid sequence of SEQ ID NO: 1098; c. CDR-H3 comprising the amino acid sequence of SEQ ID NO: 1640; d. CDR-L1 comprising the amino acid sequence of SEQ ID NO: 827; e. CDR-L2 comprising the amino acid sequence of SEQ ID NO: 1369; and f. CDR-L3 comprising the amino acid sequence of SEQ ID NO: 1911.

In one aspect, the present disclosure provides an antibody or antigen-binding fragment thereof comprising: a. CDR-H1 comprising the amino acid sequence of SEQ ID NO: 556; b. CDR-H2 comprising the amino acid sequence of SEQ ID NO: 1098; c. CDR-H3 comprising the amino acid sequence of SEQ ID NO: 1640; d. CDR-L1 comprising the amino acid sequence of SEQ ID NO: 827; e. CDR-L2 comprising the amino acid sequence of SEQ ID NO: 1369; and f. CDR-L3 comprising the amino acid sequence of SEQ ID NO: 1911.
In one aspect, the present disclosure provides an antibody or antigen-binding fragment thereof comprising a CDR-H3 comprising the amino acid sequence of SEQ ID NO: 1640; and a CDR-L3 comprising the amino acid sequence of SEQ ID NO: 1911.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 556; b. CDR-H2 comprising the amino acid sequence of SEQ ID NO: 1098; c. CDR-H3 comprising the amino acid sequence of SEQ ID NO: 1640; and a VL comprising the amino acid sequence of SEQ ID NO: 285.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 827; b. CDR-L2 comprising the amino acid sequence of SEQ ID NO: 1369; c. CDR-L3 comprising the amino acid sequence of SEQ ID NO: 1911; and a VH comprising the amino acid sequence of SEQ ID NO: 14.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 14. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 14. In some embodiments, substitutions, insertions, or deletions occur in regions outside the CDRs (e.g., in the FRs). Optionally, the antibody or antigen-binding fragment thereof comprises the VH sequence SEQ ID NO: 14, including one or more post-translational modifications of that sequence. In a particular embodiment, the VH comprises one, two or three CDRs selected from: a. CDR-H1, comprising the amino acid sequence SEQ ID NO: 556; b. CDR-H2, comprising the amino acid sequence SEQ ID NO: 1098; and c. CDR-H3, comprising the amino acid sequence SEQ ID NO: 1640.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 285. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 285. In some embodiments, the substitutions, insertions, or deletions occur in regions outside the CDRs (e.g., in the FRs). Optionally, the antibody or antigen-binding fragment thereof comprises the VL sequence SEQ ID NO: 285, including one or more post-translational modifications of that sequence. In a particular embodiment, the VL comprises one, two or three CDRs selected from: a. CDR-L1, comprising the amino acid sequence SEQ ID NO: 827; b. CDR-L2, comprising the amino acid sequence SEQ ID NO: 1369; and c. CDR-L3, comprising the amino acid sequence SEQ ID NO: 1911.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 14, and the VL amino acid sequence of SEQ ID NO: 285, optionally including post-translational modifications of those sequences.

TBRE1002

In one aspect, the present disclosure provides an antibody or antigen-binding fragment thereof comprising at least one or both variable regions selected from: a. VH comprising the amino acid sequence of SEQ ID NO: 15 and b. VL comprising the amino acid sequence of SEQ ID NO: 286.

In one aspect, the present disclosure provides an antibody or antigen-binding fragment thereof comprising at least one, two, three, four, five, or six CDRs selected from: a. CDR-H1 comprising the amino acid sequence of SEQ ID NO: 557; b. CDR-H2 comprising the amino acid sequence of SEQ ID NO: 1099; c. CDR-H3 comprising the amino acid sequence of SEQ ID NO: 1641; d. CDR-L1 comprising the amino acid sequence of SEQ ID NO: 828; e. CDR-L2 comprising the amino acid sequence of SEQ ID NO: 1370; and f. CDR-L3 comprising the amino acid sequence of SEQ ID NO: 1912.

In one aspect, the present disclosure provides an antibody or antigen-binding fragment thereof comprising: a. CDR-H1 comprising the amino acid sequence of SEQ ID NO: 557; b. CDR-H2 comprising the amino acid sequence of SEQ ID NO: 1099; c. CDR-H3 comprising the amino acid sequence of SEQ ID NO: 1641; d. CDR-L1 comprising the amino acid sequence of SEQ ID NO: 828; e. CDR-L2 comprising the amino acid sequence of SEQ ID NO: 1370; and f. CDR-L3 comprising the amino acid sequence of SEQ ID NO: 1912. In one aspect, the present disclosure provides an antibody or antigen-binding fragment thereof comprising a CDR-H3 comprising the amino acid sequence of SEQ ID NO: 1641; and a CDR-L3 comprising the amino acid sequence of SEQ ID NO: 1912.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 557; b. CDR-H2 comprising the amino acid sequence of SEQ ID NO: 1099; c. CDR-H3 comprising the amino acid sequence of SEQ ID NO: 1641; and a VL comprising the amino acid sequence of SEQ ID NO: 286.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 828; b. CDR-L2 comprising the amino acid sequence of SEQ ID NO: 1370; c. CDR-L3 comprising the amino acid sequence of SEQ ID NO: 1912; and a VH comprising the amino acid sequence of SEQ ID NO: 15.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 15. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 15. In some embodiments, substitutions, insertions, or deletions occur in regions outside the CDRs (e.g., in the FRs). Optionally, the antibody or antigen-binding fragment thereof comprises the VH sequence SEQ ID NO: 15, including one or more post-translational modifications of that sequence. In a particular embodiment, the VH comprises one, two or three CDRs selected from: a. CDR-H1, comprising the amino acid sequence SEQ ID NO: 557; b. CDR-H2, comprising the amino acid sequence SEQ ID NO: 1099; and c. CDR-H3, comprising the amino acid sequence SEQ ID NO: 1641.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 286. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 286. In some embodiments, the substitutions, insertions, or deletions occur in regions outside the CDRs (e.g., in the FRs). Optionally, the antibody or antigen-binding fragment thereof comprises the VL sequence SEQ ID NO: 286, including one or more post-translational modifications of that sequence. In a particular embodiment, the VL comprises one, two or three CDRs selected from: a. CDR-L1, comprising the amino acid sequence SEQ ID NO: 828; b. CDR-L2, comprising the amino acid sequence SEQ ID NO: 1370; and c. CDR-L3, comprising the amino acid sequence SEQ ID NO: 1912.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 15, and the VL amino acid sequence of SEQ ID NO: 286, optionally including post-translational modifications of those sequences.

TBRE1003

In one aspect, the present disclosure provides an antibody or antigen-binding fragment thereof comprising at least one or both variable regions selected from: a. VH comprising the amino acid sequence of SEQ ID NO: 16 and b. VL comprising the amino acid sequence of SEQ ID NO: 287.

In one aspect, the present disclosure provides an antibody or antigen-binding fragment thereof comprising at least one, two, three, four, five, or six CDRs selected from: a. CDR-H1 comprising the amino acid sequence of SEQ ID NO: 558; b. CDR-H2 comprising the amino acid sequence of SEQ ID NO: 1100; c. CDR-H3 comprising the amino acid sequence of SEQ ID NO: 1642; d. CDR-L1 comprising the amino acid sequence of SEQ ID NO: 829; e. CDR-L2 comprising the amino acid sequence of SEQ ID NO: 1371; and f. CDR-L3 comprising the amino acid sequence of SEQ ID NO: 1913.

In one aspect, the present disclosure provides an antibody or antigen-binding fragment thereof comprising: a. CDR-H1 comprising the amino acid sequence of SEQ ID NO: 558; b. CDR-H2 comprising the amino acid sequence of SEQ ID NO: 1100; c. CDR-H3 comprising the amino acid sequence of SEQ ID NO: 1642; d. CDR-L1 comprising the amino acid sequence of SEQ ID NO: 829; e. CDR-L2 comprising the amino acid sequence of SEQ ID NO: 1371; and f. CDR-L3 comprising the amino acid sequence of SEQ ID NO: 1913. In one aspect, the present disclosure provides an antibody or antigen-binding fragment thereof comprising a CDR-H3 comprising the amino acid sequence of SEQ ID NO: 1642; and a CDR-L3 comprising the amino acid sequence of SEQ ID NO: 1913.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 558; b. CDR-H2 comprising the amino acid sequence of SEQ ID NO: 1100; c. CDR-H3 comprising the amino acid sequence of SEQ ID NO: 1642; and a VL comprising the amino acid sequence of SEQ ID NO: 287.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 829; b. CDR-L2 comprising the amino acid sequence of SEQ ID NO: 1371; c. CDR-L3 comprising the amino acid sequence of SEQ ID NO: 1913; and a VH comprising the amino acid sequence of SEQ ID NO: 16.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 16. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 16. In some embodiments, substitutions, insertions, or deletions occur in regions outside the CDRs (e.g., in the FRs). Optionally, the antibody or antigen-binding fragment thereof comprises the VH sequence SEQ ID NO: 16, including one or more post-translational modifications of that sequence. In a particular embodiment, the VH comprises one, two or three CDRs selected from: a. CDR-H1, comprising the amino acid sequence SEQ ID NO: 558; b. CDR-H2, comprising the amino acid sequence SEQ ID NO: 1100; and c. CDR-H3, comprising the amino acid sequence SEQ ID NO: 1642.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 287. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 287. In some embodiments, the substitutions, insertions, or deletions occur in regions outside the CDRs (e.g., in the FRs). Optionally, the antibody or antigen-binding fragment thereof comprises the VL sequence SEQ ID NO: 287, including one or more post-translational modifications of that sequence. In a particular embodiment, the VL comprises one, two or three CDRs selected from: a. CDR-L1, comprising the amino acid sequence SEQ ID NO: 829; b. CDR-L2, comprising the amino acid sequence SEQ ID NO: 1371; and c. CDR-L3, comprising the amino acid sequence SEQ ID NO: 1913.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 16, and the VL amino acid sequence of SEQ ID NO: 287, optionally including post-translational modifications of those sequences.

TBRE1004

In one aspect, the present disclosure provides an antibody or antigen-binding fragment thereof comprising at least one or both variable regions selected from: a. VH comprising the amino acid sequence of SEQ ID NO: 17 and b. VL comprising the amino acid sequence of SEQ ID NO: 288.

In one aspect, the present disclosure provides an antibody or antigen-binding fragment thereof comprising at least one, two, three, four, five, or six CDRs selected from: a. CDR-H1 comprising the amino acid sequence of SEQ ID NO: 559; b. CDR-H2 comprising the amino acid sequence of SEQ ID NO: 1101; c. CDR-H3 comprising the amino acid sequence of SEQ ID NO: 1643; d. CDR-L1 comprising the amino acid sequence of SEQ ID NO: 830; e. CDR-L2 comprising the amino acid sequence of SEQ ID NO: 1372; and f. CDR-L3 comprising the amino acid sequence of SEQ ID NO: 1914.

In one aspect, the present disclosure provides an antibody or antigen-binding fragment thereof comprising: a. CDR-H1 comprising the amino acid sequence of SEQ ID NO: 559; b. CDR-H2 comprising the amino acid sequence of SEQ ID NO: 1101; c. CDR-H3 comprising the amino acid sequence of SEQ ID NO: 1643; d. CDR-L1 comprising the amino acid sequence of SEQ ID NO: 830; e. CDR-L2 comprising the amino acid sequence of SEQ ID NO: 1372; and f. CDR-L3 comprising the amino acid sequence of SEQ ID NO: 1914.

In one aspect, the present disclosure provides an antibody or antigen-binding fragment thereof comprising a CDR-H3 comprising the amino acid sequence of SEQ ID NO: 1643; and a CDR-L3 comprising the amino acid sequence of SEQ ID NO: 1914.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 559; b. CDR-H2 comprising the amino acid sequence of SEQ ID NO: 1101; c. CDR-H3 comprising the amino acid sequence of SEQ ID NO: 1643; and a VL comprising the amino acid sequence of SEQ ID NO: 288.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 830; b. CDR-L2 comprising the amino acid sequence of SEQ ID NO: 1372; c. CDR-L3 comprising the amino acid sequence of SEQ ID NO: 1914; and a VH comprising the amino acid sequence of SEQ ID NO: 17.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 17. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 17. In some embodiments, substitutions, insertions, or deletions occur in regions outside the CDRs (e.g., in the FRs). Optionally, the antibody or antigen-binding fragment thereof comprises the VH sequence SEQ ID NO: 17, including one or more post-translational modifications of that sequence. In a particular embodiment, the VH comprises one, two or three CDRs selected from: a. CDR-H1, comprising the amino acid sequence SEQ ID NO: 559; b. CDR-H2, comprising the amino acid sequence SEQ ID NO: 1101; and c. CDR-H3, comprising the amino acid sequence SEQ ID NO: 1643.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 288. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 288. In some embodiments, the substitutions, insertions, or deletions occur in regions outside the CDRs (e.g., in the FRs). Optionally, the antibody or antigen-binding fragment thereof comprises the VL sequence SEQ ID NO: 288, including one or more post-translational modifications of that sequence. In a particular embodiment, the VL comprises one, two or three CDRs selected from: a. CDR-L1, comprising the amino acid sequence SEQ ID NO: 830; b. CDR-L2, comprising the amino acid sequence SEQ ID NO: 1372; and c. CDR-L3, comprising the amino acid sequence SEQ ID NO: 1914.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 17, and the VL amino acid sequence of SEQ ID NO: 288, optionally including post-translational modifications of those sequences.
TBRE1005

In one aspect, the present disclosure provides an antibody or antigen-binding fragment thereof comprising at least one or both variable regions selected from: a. VH comprising the amino acid sequence of SEQ ID NO: 18 and b. VL comprising the amino acid sequence of SEQ ID NO: 289.

In one aspect, the present disclosure provides an antibody or antigen-binding fragment thereof comprising at least one, two, three, four, five, or six CDRs selected from: a. CDR-H1 comprising the amino acid sequence of SEQ ID NO: 560; b. CDR-H2 comprising the amino acid sequence of SEQ ID NO: 1102; c. CDR-H3 comprising the amino acid sequence of SEQ ID NO: 1644; d. CDR-L1 comprising the amino acid sequence of SEQ ID NO: 831; e. CDR-L2 comprising the amino acid sequence of SEQ ID NO: 1373; and f. CDR-L3 comprising the amino acid sequence of SEQ ID NO: 1915.

In one aspect, the present disclosure provides an antibody or antigen-binding fragment thereof comprising: a. CDR-H1 comprising the amino acid sequence of SEQ ID NO: 560; b. CDR-H2 comprising the amino acid sequence of SEQ ID NO: 1102; c. CDR-H3 comprising the amino acid sequence of SEQ ID NO: 1644; d. CDR-L1 comprising the amino acid sequence of SEQ ID NO: 831; e. CDR-L2 comprising the amino acid sequence of SEQ ID NO: 1373; and f. CDR-L3 comprising the amino acid sequence of SEQ ID NO: 1915.

In one aspect, the present disclosure provides an antibody or antigen-binding fragment thereof comprising a CDR-H3 comprising the amino acid sequence of SEQ ID NO: 1644; and a CDR-L3 comprising the amino acid sequence of SEQ ID NO: 1915.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 560; b. CDR-H2 comprising the amino acid sequence of SEQ ID NO: 1102; c. CDR-H3 comprising the amino acid sequence of SEQ ID NO: 1644; and a VL comprising the amino acid sequence of SEQ ID NO: 289.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 831; b. CDR-L2 comprising the amino acid sequence of SEQ ID NO: 1373; c. CDR-L3 comprising the amino acid sequence of SEQ ID NO: 1915; and a VH comprising the amino acid sequence of SEQ ID NO: 18.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 18. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 18. In some embodiments, substitutions, insertions, or deletions occur in regions outside the CDRs (e.g., in the FRs). Optionally, the antibody or antigen-binding fragment thereof comprises the VH sequence SEQ ID NO: 18, including one or more post-translational modifications of that sequence. In a particular embodiment, the VH comprises one, two or three CDRs selected from: a. CDR-H1, comprising the amino acid sequence SEQ ID NO: 560; b. CDR-H2, comprising the amino acid sequence SEQ ID NO: 1102; and c. CDR-H3, comprising the amino acid sequence SEQ ID NO: 1644.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 289. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 289. In some embodiments, the substitutions, insertions, or deletions occur in regions outside the CDRs (e.g., in the FRs). Optionally, the antibody or antigen-binding fragment thereof comprises the VL sequence SEQ ID NO: 289, including one or more post-translational modifications of that sequence. In a particular embodiment, the VL comprises one, two or three CDRs selected from: a. CDR-L1, comprising the amino acid sequence SEQ ID NO: 831; b. CDR-L2, comprising the amino acid sequence SEQ ID NO: 1373; and c. CDR-L3, comprising the amino acid sequence SEQ ID NO: 1915.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 18, and the VL amino acid sequence of SEQ ID NO: 289, optionally including post-translational modifications of those sequences.
TBRE1006

In one aspect, the present disclosure provides an antibody or antigen-binding fragment thereof comprising at least one or both variable regions selected from: a. VH comprising the amino acid sequence of SEQ ID NO: 19 and b. VL comprising the amino acid sequence of SEQ ID NO: 290.

In one aspect, the present disclosure provides an antibody or antigen-binding fragment thereof comprising at least one, two, three, four, five, or six CDRs selected from: a. CDR-H1 comprising the amino acid sequence of SEQ ID NO: 561; b. CDR-H2 comprising the amino acid sequence of SEQ ID NO: 1103; c. CDR-H3 comprising the amino acid sequence of SEQ ID NO: 1645; d. CDR-L1 comprising the amino acid sequence of SEQ ID NO: 832; e. CDR-L2 comprising the amino acid sequence of SEQ ID NO: 1374; and f. CDR-L3 comprising the amino acid sequence of SEQ ID NO: 1916.

In one aspect, the present disclosure provides an antibody or antigen-binding fragment thereof comprising: a. CDR-H1 comprising the amino acid sequence of SEQ ID NO: 561; b. CDR-H2 comprising the amino acid sequence of SEQ ID NO: 1103; c. CDR-H3 comprising the amino acid sequence of SEQ ID NO: 1645; d. CDR-L1 comprising the amino acid sequence of SEQ ID NO: 832; e. CDR-L2 comprising the amino acid sequence of SEQ ID NO: 1374; and f. CDR-L3 comprising the amino acid sequence of SEQ ID NO: 1916. In one aspect, the present disclosure provides an antibody or antigen-binding fragment thereof comprising a CDR-H3 comprising the amino acid sequence of SEQ ID NO: 1645; and a CDR-L3 comprising the amino acid sequence of SEQ ID NO: 1916.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 561; b. CDR-H2 comprising the amino acid sequence of SEQ ID NO: 1103; c. CDR-H3 comprising the amino acid sequence of SEQ ID NO: 1645; and a VL comprising the amino acid sequence of SEQ ID NO: 290.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 832; c. CDR-L2 comprising the amino acid sequence of SEQ ID NO: 1374; b. CDR-L3 comprising the amino acid sequence of SEQ ID NO: 1916, and a VH comprising the amino acid sequence of SEQ ID NO: 19.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 19. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 19. In some embodiments, substitutions, insertions, or deletions occur in regions outside the CDRs (e.g., in the FRs). Optionally, the antibody or antigen-binding fragment thereof comprises the VH sequence SEQ ID NO: 19, including one or more post-translational modifications of that sequence. In a particular embodiment, the VH comprises one, two or three CDRs selected from: a. CDR-H1, comprising the amino acid sequence SEQ ID NO: 561; b. CDR-H2, comprising the amino acid sequence SEQ ID NO: 1103; and c. CDR-H3, comprising the amino acid sequence SEQ ID NO: 1645.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 290. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 290. In some embodiments, the substitutions, insertions, or deletions occur in regions outside the CDRs (e.g., in the FRs). Optionally, the antibody or antigen-binding fragment thereof comprises the VL sequence SEQ ID NO: 290, including one or more post-translational modifications of that sequence. In a particular embodiment, the VL comprises one, two or three CDRs selected from: a. CDR-L1, comprising the amino acid sequence SEQ ID NO: 832; b. CDR-L2, comprising the amino acid sequence SEQ ID NO: 1374; and c. CDR-L3, comprising the amino acid sequence SEQ ID NO: 1916.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 19, and the VL amino acid sequence of SEQ ID NO: 290, optionally including post-translational modifications of those sequences.
TBRE1007

In one aspect, the present disclosure provides an antibody or antigen-binding fragment thereof comprising at least one or both variable regions selected from: a. VH comprising the amino acid sequence of SEQ ID NO: 20 and b. VL comprising the amino acid sequence of SEQ ID NO: 291.

In one aspect, the present disclosure provides an antibody or antigen-binding fragment thereof comprising at least one, two, three, four, five, or six CDRs selected from: a. CDR-H1 comprising the amino acid sequence of SEQ ID NO: 562; b. CDR-H2 comprising the amino acid sequence of SEQ ID NO: 1104; c. CDR-H3 comprising the amino acid sequence of SEQ ID NO: 1646; d. CDR-L1 comprising the amino acid sequence of SEQ ID NO: 833; e. CDR-L2 comprising the amino acid sequence of SEQ ID NO: 1375; and f. CDR-L3 comprising the amino acid sequence of SEQ ID NO: 1917.

In one aspect, the present disclosure provides an antibody or antigen-binding fragment thereof comprising: a. CDR-H1 comprising the amino acid sequence of SEQ ID NO: 562; b. CDR-H2 comprising the amino acid sequence of SEQ ID NO: 1104; c. CDR-H3 comprising the amino acid sequence of SEQ ID NO: 1646; d. CDR-L1 comprising the amino acid sequence of SEQ ID NO: 833; e. CDR-L2 comprising the amino acid sequence of SEQ ID NO: 1375; and f. CDR-L3 comprising the amino acid sequence of SEQ ID NO: 1917. In one aspect, the present disclosure provides an antibody or antigen-binding fragment thereof comprising a CDR-H3 comprising the amino acid sequence of SEQ ID NO: 1646; and a CDR-L3 comprising the amino acid sequence of SEQ ID NO: 1917.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 562; b. CDR-H2 comprising the amino acid sequence of SEQ ID NO: 1104; c. CDR-H3 comprising the amino acid sequence of SEQ ID NO: 1646; and a VL comprising the amino acid sequence of SEQ ID NO: 291.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 833; b. CDR-L2 comprising the amino acid sequence of SEQ ID NO: 1375; c. CDR-L3 comprising the amino acid sequence of SEQ ID NO: 1917; and a VH comprising the amino acid sequence of SEQ ID NO: 20.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 20. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 20. In some embodiments, substitutions, insertions, or deletions occur in regions outside the CDRs (e.g., in the FRs). Optionally, the antibody or antigen-binding fragment thereof comprises the VH sequence SEQ ID NO: 20, including one or more post-translational modifications of that sequence. In a particular embodiment, the VH comprises one, two or three CDRs selected from: a. CDR-H1, comprising the amino acid sequence SEQ ID NO: 562; b. CDR-H2, comprising the amino acid sequence SEQ ID NO: 1104; and c. CDR-H3, comprising the amino acid sequence SEQ ID NO: 1646.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 291. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 291. In some embodiments, the substitutions, insertions, or deletions occur in regions outside the CDRs (e.g., in the FRs). Optionally, the antibody or antigen-binding fragment thereof comprises the VL sequence SEQ ID NO: 291, including one or more post-translational modifications of that sequence. In a particular embodiment, the VL comprises one, two or three CDRs selected from: a. CDR-L1, comprising the amino acid sequence SEQ ID NO: 833; b. CDR-L2, comprising the amino acid sequence SEQ ID NO: 1375; and c. CDR-L3, comprising the amino acid sequence SEQ ID NO: 1917.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 20, and the VL amino acid sequence of SEQ ID NO: 291, optionally including post-translational modifications of those sequences.

TBRE1008

In one aspect, the present disclosure provides an antibody or antigen-binding fragment thereof comprising at least one or both variable regions selected from: a. VH comprising the amino acid sequence of SEQ ID NO: 21 and b. VL comprising the amino acid sequence of SEQ ID NO: 292.

In one aspect, the present disclosure provides an antibody or antigen-binding fragment thereof comprising at least one, two, three, four, five, or six CDRs selected from: a. CDR-H1 comprising the amino acid sequence of SEQ ID NO: 563; b. CDR-H2 comprising the amino acid sequence of SEQ ID NO: 1105; c. CDR-H3 comprising the amino acid sequence of SEQ ID NO: 1647; d. CDR-L1 comprising the amino acid sequence of SEQ ID NO: 834; e. CDR-L2 comprising the amino acid sequence of SEQ ID NO: 1376; and f. CDR-L3 comprising the amino acid sequence of SEQ ID NO: 1918.

In one aspect, the present disclosure provides an antibody or antigen-binding fragment thereof comprising: a. CDR-H1 comprising the amino acid sequence of SEQ ID NO: 563; b. CDR-H2 comprising the amino acid sequence of SEQ ID NO: 1105; c. CDR-H3 comprising the amino acid sequence of SEQ ID NO: 1647; d. CDR-L1 comprising the amino acid sequence of SEQ ID NO: 834; e. CDR-L2 comprising the amino acid sequence of SEQ ID NO: 1376; and f. CDR-L3 comprising the amino acid sequence of SEQ ID NO: 1918. In one aspect, the present disclosure provides an antibody or antigen-binding fragment thereof comprising a CDR-H3 comprising the amino acid sequence of SEQ ID NO: 1647; and a CDR-L3 comprising the amino acid sequence of SEQ ID NO: 1918.

In one aspect, the present disclosure provides an antibody or antigen-binding fragment thereof comprising at least one, at least two, or all three VH CDR sequences selected from:

a. CDR-H1 comprising the amino acid sequence of SEQ ID NO: 563; b. CDR-H2 comprising the amino acid sequence of SEQ ID NO: 1105; c. CDR-H3 comprising the amino acid sequence of SEQ ID NO: 1647; and a VL comprising the amino acid sequence of SEQ ID NO: 292.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 834; b. CDR-L2 comprising the amino acid sequence of SEQ ID NO: 1376; c. CDR-L3 comprising the amino acid sequence of SEQ ID NO: 1918; and a VH comprising the amino acid sequence of SEQ ID NO: 21.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 21. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 21. In some embodiments, substitutions, insertions, or deletions occur in regions outside the CDRs (e.g., in the FRs). Optionally, the antibody or antigen-binding fragment thereof comprises the VH sequence SEQ ID NO: 21, including one or more post-translational modifications of that sequence. In a particular embodiment, the VH comprises one, two or three CDRs selected from: a. CDR-H1, comprising the amino acid sequence SEQ ID NO: 563; b. CDR-H2, comprising the amino acid sequence SEQ ID NO: 1105; and c. CDR-H3, comprising the amino acid sequence SEQ ID NO: 1647.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 292. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 292. In some embodiments, the substitutions, insertions, or deletions occur in regions outside the CDRs (e.g., in the FRs). Optionally, the antibody or antigen-binding fragment thereof comprises the VL sequence SEQ ID NO: 292, including one or more post-translational modifications of that sequence. In a particular embodiment, the VL comprises one, two or three CDRs selected from: a. CDR-L1, comprising the amino acid sequence SEQ ID NO: 834; b. CDR-L2, comprising the amino acid sequence SEQ ID NO: 1376; and c. CDR-L3, comprising the amino acid sequence SEQ ID NO: 1918.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 21, and the VL amino acid sequence of SEQ ID NO: 292, optionally including post-translational modifications of those sequences.
TBRE1009

In one aspect, the present disclosure provides an antibody or antigen-binding fragment thereof comprising at least one or both variable regions selected from: a. VH comprising the amino acid sequence of SEQ ID NO: 22 and b. VL comprising the amino acid sequence of SEQ ID NO: 293.

In one aspect, the present disclosure provides an antibody or antigen-binding fragment thereof comprising at least one, two, three, four, five, or six CDRs selected from: a. CDR-H1 comprising the amino acid sequence of SEQ ID NO: 564; b. CDR-H2 comprising the amino acid sequence of SEQ ID NO: 1106; c. CDR-H3 comprising the amino acid sequence of SEQ ID NO: 1648; d. CDR-L1 comprising the amino acid sequence of SEQ ID NO: 835; e. CDR-L2 comprising the amino acid sequence of SEQ ID NO: 1377; and f. CDR-L3 comprising the amino acid sequence of SEQ ID NO: 1919.

In one aspect, the present disclosure provides an antibody or antigen-binding fragment thereof comprising: a. CDR-H1 comprising the amino acid sequence of SEQ ID NO: 564; b. CDR-H2 comprising the amino acid sequence of SEQ ID NO: 1106; c. CDR-H3 comprising the amino acid sequence of SEQ ID NO: 1648; d. CDR-L1 comprising the amino acid sequence of SEQ ID NO: 835; e. CDR-L2 comprising the amino acid sequence of SEQ ID NO: 1377; and f. CDR-L3 comprising the amino acid sequence of SEQ ID NO: 1919. In one aspect, the present disclosure provides an antibody or antigen-binding fragment thereof comprising a CDR-H3 comprising the amino acid sequence of SEQ ID NO: 1648; and a CDR-L3 comprising the amino acid sequence of SEQ ID NO: 1919.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 564; b. CDR-H2 comprising the amino acid sequence of SEQ ID NO: 1106; c. CDR-H3 comprising the amino acid sequence of SEQ ID NO: 1648; and a VL comprising the amino acid sequence of SEQ ID NO: 293.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 835; b. CDR-L2 comprising the amino acid sequence of SEQ ID NO: 1377; c. CDR-L3 comprising the amino acid sequence of SEQ ID NO: 1919; and a VH comprising the amino acid sequence of SEQ ID NO: 22.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 22. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 22. In some embodiments, substitutions, insertions, or deletions occur in regions outside the CDRs (e.g., in the FRs). Optionally, the antibody or antigen-binding fragment thereof comprises the VH sequence SEQ ID NO: 22, including one or more post-translational modifications of that sequence. In a particular embodiment, the VH comprises one, two or three CDRs selected from: a. CDR-H1, comprising the amino acid sequence SEQ ID NO: 564; b. CDR-H2, comprising the amino acid sequence SEQ ID NO: 1106; and c. CDR-H3, comprising the amino acid sequence SEQ ID NO: 1648.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 293. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 293. In some embodiments, the substitutions, insertions, or deletions occur in regions outside the CDRs (e.g., in the FRs). Optionally, the antibody or antigen-binding fragment thereof comprises the VL sequence SEQ ID NO: 293, including one or more post-translational modifications of that sequence. In a particular embodiment, the VL comprises one, two or three CDRs selected from: a. CDR-L1, comprising the amino acid sequence SEQ ID NO: 835; b. CDR-L2, comprising the amino acid sequence SEQ ID NO: 1377; and c. CDR-L3, comprising the amino acid sequence SEQ ID NO: 1919.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 22, and the VL amino acid sequence of SEQ ID NO: 293, optionally including post-translational modifications of those sequences.
TBRE1010

In one aspect, the present disclosure provides an antibody or antigen-binding fragment thereof comprising at least one or both variable regions selected from: a. VH comprising the amino acid sequence of SEQ ID NO: 23 and b. VL comprising the amino acid sequence of SEQ ID NO: 294.

In one aspect, the present disclosure provides an antibody or antigen-binding fragment thereof comprising at least one, two, three, four, five, or six CDRs selected from: a. CDR-H1 comprising the amino acid sequence of SEQ ID NO: 565; b. CDR-H2 comprising the amino acid sequence of SEQ ID NO: 1107; c. CDR-H3 comprising the amino acid sequence of SEQ ID NO: 1649; d. CDR-L1 comprising the amino acid sequence of SEQ ID NO: 836; e. CDR-L2 comprising the amino acid sequence of SEQ ID NO: 1378; and f. CDR-L3 comprising the amino acid sequence of SEQ ID NO: 1920.

In one aspect, the present disclosure provides an antibody or antigen-binding fragment thereof comprising: a. CDR-H1 comprising the amino acid sequence of SEQ ID NO: 565; b. CDR-H2 comprising the amino acid sequence of SEQ ID NO: 1107; c. CDR-H3 comprising the amino acid sequence of SEQ ID NO: 1649; d. CDR-L1 comprising the amino acid sequence of SEQ ID NO: 836; e. CDR-L2 comprising the amino acid sequence of SEQ ID NO: 1378; and f. CDR-L3 comprising the amino acid sequence of SEQ ID NO: 1920.

In one aspect, the present disclosure provides an antibody or antigen-binding fragment thereof comprising a CDR-H3 comprising the amino acid sequence of SEQ ID NO: 1649; and a CDR-L3 comprising the amino acid sequence of SEQ ID NO: 1920.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 565; b. CDR-H2 comprising the amino acid sequence of SEQ ID NO: 1107; c. CDR-H3 comprising the amino acid sequence of SEQ ID NO: 1649; and a VL comprising the amino acid sequence of SEQ ID NO: 294.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 836; b. CDR-L2 comprising the amino acid sequence of SEQ ID NO: 1378; c. CDR-L3 comprising the amino acid sequence of SEQ ID NO: 1920; and a VH comprising the amino acid sequence of SEQ ID NO: 23.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 23. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 23. In some embodiments, substitutions, insertions, or deletions occur in regions outside the CDRs (e.g., in the FRs). Optionally, the antibody or antigen-binding fragment thereof comprises the VH sequence SEQ ID NO: 23, including one or more post-translational modifications of that sequence. In a particular embodiment, the VH comprises one, two or three CDRs selected from: a. CDR-H1, comprising the amino acid sequence SEQ ID NO: 565; b. CDR-H2, comprising the amino acid sequence SEQ ID NO: 1107; and a. CDR-H3, comprising the amino acid sequence SEQ ID NO: 1649.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 294. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 294. In some embodiments, the substitutions, insertions, or deletions occur in regions outside the CDRs (e.g., in the FRs). Optionally, the antibody or antigen-binding fragment thereof comprises the VL sequence SEQ ID NO: 294, including one or more post-translational modifications of that sequence. In a particular embodiment, the VL comprises one, two or three CDRs selected from: a. CDR-L1, comprising the amino acid sequence SEQ ID NO: 836; b. CDR-L2, comprising the amino acid sequence SEQ ID NO: 1378; and a. CDR-L3, comprising the amino acid sequence SEQ ID NO: 1920.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 23, and the VL amino acid sequence of SEQ ID NO: 294, optionally including post-translational modifications of those sequences.
TBRE1011

In one aspect, the present disclosure provides an antibody or antigen-binding fragment thereof comprising at least one or both variable regions selected from: a. VH comprising the amino acid sequence of SEQ ID NO: 24 and a. VL comprising the amino acid sequence of SEQ ID NO: 295.

In one aspect, the present disclosure provides an antibody or antigen-binding fragment thereof comprising at least one, two, three, four, five, or six CDRs selected from: a. CDR-H1 comprising the amino acid sequence of SEQ ID NO: 566, b. CDR-H2 comprising the amino acid sequence of SEQ ID NO: 1108, c. CDR-H3 comprising the amino acid sequence of SEQ ID NO: 1650, d. CDR-L1 comprising the amino acid sequence of SEQ ID NO: 837, e. CDR-L2 comprising the amino acid sequence of SEQ ID NO: 1379, and f. CDR-L3 comprising the amino acid sequence of SEQ ID NO: 1921.

In one aspect, the present disclosure provides an antibody or antigen-binding fragment thereof comprising: a. CDR-H1 comprising the amino acid sequence of SEQ ID NO: 566, b. CDR-H2 comprising the amino acid sequence of SEQ ID NO: 1108, c. CDR-H3 comprising the amino acid sequence of SEQ ID NO: 1650, d. CDR-L1 comprising the amino acid sequence of SEQ ID NO: 837, e. CDR-L2 comprising the amino acid sequence of SEQ ID NO: 1379, and f. CDR-L3 comprising the amino acid sequence of SEQ ID NO: 1921. In one aspect, the present disclosure provides an antibody or antigen-binding fragment thereof comprising a CDR-H3 comprising the amino acid sequence of SEQ ID NO: 1650, and a CDR-L3 comprising the amino acid sequence of SEQ ID NO: 1921.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 566, b. CDR-H2 comprising the amino acid sequence of SEQ ID NO: 1108, c. CDR-H3 comprising the amino acid sequence of SEQ ID NO: 1650, and a VL comprising the amino acid sequence of SEQ ID NO: 295.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 837, b. CDR-L2 comprising the amino acid sequence of SEQ ID NO: 1379, c. CDR-L3 comprising the amino acid sequence of SEQ ID NO: 1921, and a VH comprising the amino acid sequence of SEQ ID NO: 24.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 24. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 24. In some embodiments, substitutions, insertions, or deletions occur in regions outside the CDRs (e.g., in the FRs). Optionally, the antibody or antigen-binding fragment thereof comprises the VH sequence SEQ ID NO: 24, including one or more post-translational modifications of that sequence. In a particular embodiment, the VH comprises one, two or three CDRs selected from: a. CDR-H1, comprising the amino acid sequence SEQ ID NO: 566, b. CDR-H2, comprising the amino acid sequence SEQ ID NO: 1108, and c. CDR-H3, comprising the amino acid sequence SEQ ID NO: 1650.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 295. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 295. In some embodiments, the substitutions, insertions, or deletions occur in regions outside the CDRs (e.g., in the FRs). Optionally, the antibody or antigen-binding fragment thereof comprises the VL sequence SEQ ID NO: 295, including one or more post-translational modifications of that sequence. In a particular embodiment, the VL comprises one, two or three CDRs selected from: a. CDR-L1, comprising the amino acid sequence SEQ ID NO: 837, b. CDR-L2, comprising the amino acid sequence SEQ ID NO: 1379, and c. CDR-L3, comprising the amino acid sequence SEQ ID NO: 1921.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 24, and the VL amino acid sequence of SEQ ID NO: 295, optionally including post-translational modifications of those sequences.
TBRE1012

In one aspect, the present disclosure provides an antibody or antigen-binding fragment thereof comprising at least one or both variable regions selected from: a. VH comprising the amino acid sequence of SEQ ID NO: 25 and b. VL comprising the amino acid sequence of SEQ ID NO: 296.

In one aspect, the present disclosure provides an antibody or antigen-binding fragment thereof comprising at least one, two, three, four, five, or six CDRs selected from: a. CDR-H1 comprising the amino acid sequence of SEQ ID NO: 567, b. CDR-H2 comprising the amino acid sequence of SEQ ID NO: 1109, c. CDR-H3 comprising the amino acid sequence of SEQ ID NO: 1651, d. CDR-L1 comprising the amino acid sequence of SEQ ID NO: 838, e. CDR-L2 comprising the amino acid sequence of SEQ ID NO: 1380, and f. CDR-L3 comprising the amino acid sequence of SEQ ID NO: 1922.

In one aspect, the present disclosure provides an antibody or antigen-binding fragment thereof comprising: a. CDR-H1 comprising the amino acid sequence of SEQ ID NO: 567, b. CDR-H2 comprising the amino acid sequence of SEQ ID NO: 1109, c. CDR-H3 comprising the amino acid sequence of SEQ ID NO: 1651, d. CDR-L1 comprising the amino acid sequence of SEQ ID NO: 838, e. CDR-L2 comprising the amino acid sequence of SEQ ID NO: 1380, and f. CDR-L3 comprising the amino acid sequence of SEQ ID NO: 1922. In one aspect, the present disclosure provides an antibody or antigen-binding fragment thereof comprising a CDR-H3 comprising the amino acid sequence of SEQ ID NO: 1651, and a CDR-L3 comprising the amino acid sequence of SEQ ID NO: 1922.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 567, b. CDR-H2 comprising the amino acid sequence of SEQ ID NO: 1109, c. CDR-H3 comprising the amino acid sequence of SEQ ID NO: 1651, and a VL comprising the amino acid sequence of SEQ ID NO: 296.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 838, b. CDR-L2 comprising the amino acid sequence of SEQ ID NO: 1380, c. CDR-L3 comprising the amino acid sequence of SEQ ID NO: 1922, and a VH comprising the amino acid sequence of SEQ ID NO: 25.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 25. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 25. In some embodiments, substitutions, insertions, or deletions occur in regions outside the CDRs (e.g., in the FRs). Optionally, the antibody or antigen-binding fragment thereof comprises the VH sequence SEQ ID NO: 25, including one or more post-translational modifications of that sequence. In a particular embodiment, the VH comprises one, two or three CDRs selected from: a. CDR-H1, comprising the amino acid sequence SEQ ID NO: 567, b. CDR-H2, comprising the amino acid sequence SEQ ID NO: 1109, and c. CDR-H3, comprising the amino acid sequence SEQ ID NO: 1651.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 296. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 296. In some embodiments, the substitutions, insertions, or deletions occur in regions outside the CDRs (e.g., in the FRs). Optionally, the antibody or antigen-binding fragment thereof comprises the VL sequence SEQ ID NO: 296, including one or more post-translational modifications of that sequence. In a particular embodiment, the VL comprises one, two or three CDRs selected from: a. CDR-L1, comprising the amino acid sequence SEQ ID NO: 838, b. CDR-L2, comprising the amino acid sequence SEQ ID NO: 1380, and c. CDR-L3, comprising the amino acid sequence SEQ ID NO: 1922.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 25, and the VL amino acid sequence of SEQ ID NO: 296, optionally including post-translational modifications of those sequences.

TBRE1013

In one aspect, the present disclosure provides an antibody or antigen-binding fragment thereof comprising at least one or both variable regions selected from: a. VH comprising the amino acid sequence of SEQ ID NO: 26 and b. VL comprising the amino acid sequence of SEQ ID NO: 297.

In one aspect, the present disclosure provides an antibody or antigen-binding fragment thereof comprising at least one, two, three, four, five, or six CDRs selected from: a. CDR-H1 comprising the amino acid sequence of SEQ ID NO: 568, b. CDR-H2 comprising the amino acid sequence of SEQ ID NO: 1110, c. CDR-H3 comprising the amino acid sequence of SEQ ID NO: 1652, d. CDR-L1 comprising the amino acid sequence of SEQ ID NO: 839, e. CDR-L2 comprising the amino acid sequence of SEQ ID NO: 1381, and f. CDR-L3 comprising the amino acid sequence of SEQ ID NO: 1923.

In one aspect, the present disclosure provides an antibody or antigen-binding fragment thereof comprising: a. CDR-H1 comprising the amino acid sequence of SEQ ID NO: 568, b. CDR-H2 comprising the amino acid sequence of SEQ ID NO: 1110, c. CDR-H3 comprising the amino acid sequence of SEQ ID NO: 1652, d. CDR-L1 comprising the amino acid sequence of SEQ ID NO: 839, e. CDR-L2 comprising the amino acid sequence of SEQ ID NO: 1381, and f. CDR-L3 comprising the amino acid sequence of SEQ ID NO: 1923. In one aspect, the present disclosure provides an antibody or antigen-binding fragment thereof comprising a CDR-H3 comprising the amino acid sequence of SEQ ID NO: 1652, and a CDR-L3 comprising the amino acid sequence of SEQ ID NO: 1923.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 568, b. CDR-H2 comprising the amino acid sequence of SEQ ID NO: 1110, c. CDR-H3 comprising the amino acid sequence of SEQ ID NO: 1652, and a VL comprising the amino acid sequence of SEQ ID NO: 297.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 839, b. CDR-L2 comprising the amino acid sequence of SEQ ID NO: 1381, c. CDR-L3 comprising the amino acid sequence of SEQ ID NO: 1923, and a VH comprising the amino acid sequence of SEQ ID NO: 26.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 26. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 26. In some embodiments, substitutions, insertions, or deletions occur in regions outside the CDRs (e.g., in the FRs). Optionally, the antibody or antigen-binding fragment thereof comprises the VH sequence SEQ ID NO: 26, including one or more post-translational modifications of that sequence. In a particular embodiment, the VH comprises one, two or three CDRs selected from: a. CDR-H1, comprising the amino acid sequence SEQ ID NO: 568, b. CDR-H2, comprising the amino acid sequence SEQ ID NO: 1110, and c. CDR-H3, comprising the amino acid sequence SEQ ID NO: 1652.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 297. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 297. In some embodiments, the substitutions, insertions, or deletions occur in regions outside the CDRs (e.g., in the FRs). Optionally, the antibody or antigen-binding fragment thereof comprises the VL sequence SEQ ID NO: 297, including one or more post-translational modifications of that sequence. In a particular embodiment, the VL comprises one, two or three CDRs selected from: a. CDR-L1, comprising the amino acid sequence SEQ ID NO: 839, b. CDR-L2, comprising the amino acid sequence SEQ ID NO: 1381, and c. CDR-L3, comprising the amino acid sequence SEQ ID NO: 1923.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 26, and the VL amino acid sequence of SEQ ID NO: 297, optionally including post-translational modifications of those sequences.
TBRE1014

In one aspect, the present disclosure provides an antibody or antigen-binding fragment thereof comprising at least one or both variable regions selected from: a. VH comprising the amino acid sequence of SEQ ID NO: 27 and b. VL comprising the amino acid sequence of SEQ ID NO: 298.

In one aspect, the present disclosure provides an antibody or antigen-binding fragment thereof comprising at least one, two, three, four, five, or six CDRs selected from: a. CDR-H1 comprising the amino acid sequence of SEQ ID NO: 569, b. CDR-H2 comprising the amino acid sequence of SEQ ID NO: 1111, c. CDR-H3 comprising the amino acid sequence of SEQ ID NO: 1653, d. CDR-L1 comprising the amino acid sequence of SEQ ID NO: 840, e. CDR-L2 comprising the amino acid sequence of SEQ ID NO: 1382, and f. CDR-L3 comprising the amino acid sequence of SEQ ID NO: 1924.

In one aspect, the present disclosure provides an antibody or antigen-binding fragment thereof comprising: a. CDR-H1 comprising the amino acid sequence of SEQ ID NO: 569, b. CDR-H2 comprising the amino acid sequence of SEQ ID NO: 1111, c. CDR-H3 comprising the amino acid sequence of SEQ ID NO: 1653, d. CDR-L1 comprising the amino acid sequence of SEQ ID NO: 840, e. CDR-L2 comprising the amino acid sequence of SEQ ID NO: 1382, and f. CDR-L3 comprising the amino acid sequence of SEQ ID NO: 1924.

In one aspect, the present disclosure provides an antibody or antigen-binding fragment thereof comprising a CDR-H3 comprising the amino acid sequence of SEQ ID NO: 1653, and a CDR-L3 comprising the amino acid sequence of SEQ ID NO: 1924.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 569, b. CDR-H2 comprising the amino acid sequence of SEQ ID NO: 1111, c. CDR-H3 comprising the amino acid sequence of SEQ ID NO: 1653, and a VL comprising the amino acid sequence of SEQ ID NO: 298.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 840, b. CDR-L2 comprising the amino acid sequence of SEQ ID NO: 1382, c. CDR-L3 comprising the amino acid sequence of SEQ ID NO: 1924, and a VH comprising the amino acid sequence of SEQ ID NO: 27.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 27. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 27. In some embodiments, substitutions, insertions, or deletions occur in regions outside the CDRs (e.g., in the FRs). Optionally, the antibody or antigen-binding fragment thereof comprises the VH sequence SEQ ID NO: 27, including one or more post-translational modifications of that sequence. In a particular embodiment, the VH comprises one, two or three CDRs selected from: a. CDR-H1, comprising the amino acid sequence SEQ ID NO: 569, b. CDR-H2, comprising the amino acid sequence SEQ ID NO: 1111, and c. CDR-H3, comprising the amino acid sequence SEQ ID NO: 1653.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 298. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 298. In some embodiments, the substitutions, insertions, or deletions occur in regions outside the CDRs (e.g., in the FRs). Optionally, the antibody or antigen-binding fragment thereof comprises the VL sequence SEQ ID NO: 298, including one or more post-translational modifications of that sequence. In a particular embodiment, the VL comprises one, two or three CDRs selected from: a. CDR-L1, comprising the amino acid sequence SEQ ID NO: 840, b. CDR-L2, comprising the amino acid sequence SEQ ID NO: 1382, and c. CDR-L3, comprising the amino acid sequence SEQ ID NO: 1924.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 27, and the VL amino acid sequence of SEQ ID NO: 298, optionally including post-translational modifications of those sequences.
TBRE1015

In one aspect, the present disclosure provides an antibody or antigen-binding fragment thereof comprising at least one or both variable regions selected from: a. VH comprising the amino acid sequence of SEQ ID NO: 28 and b. VL comprising the amino acid sequence of SEQ ID NO: 299.

In one aspect, the present disclosure provides an antibody or antigen-binding fragment thereof comprising at least one, two, three, four, five, or six CDRs selected from: a. CDR-H1 comprising the amino acid sequence of SEQ ID NO: 570, b. CDR-H2 comprising the amino acid sequence of SEQ ID NO: 1112, c. CDR-H3 comprising the amino acid sequence of SEQ ID NO: 1654, d. CDR-L1 comprising the amino acid sequence of SEQ ID NO: 841, e. CDR-L2 comprising the amino acid sequence of SEQ ID NO: 1383, and f. CDR-L3 comprising the amino acid sequence of SEQ ID NO: 1925.

In one aspect, the present disclosure provides an antibody or antigen-binding fragment thereof comprising: a. CDR-H1 comprising the amino acid sequence of SEQ ID NO: 570, b. CDR-H2 comprising the amino acid sequence of SEQ ID NO: 1112, c. CDR-H3 comprising the amino acid sequence of SEQ ID NO: 1654, d. CDR-L1 comprising the amino acid sequence of SEQ ID NO: 841, e. CDR-L2 comprising the amino acid sequence of SEQ ID NO: 1383, and f. CDR-L3 comprising the amino acid sequence of SEQ ID NO: 1925.
In one aspect, the present disclosure provides an antibody or antigen-binding fragment thereof comprising a CDR-H3 comprising the amino acid sequence of SEQ ID NO: 1654, and a CDR-L3 comprising the amino acid sequence of SEQ ID NO: 1925.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 570, b. CDR-H2 comprising the amino acid sequence of SEQ ID NO: 1112, c. CDR-H3 comprising the amino acid sequence of SEQ ID NO: 1654, and a VL comprising the amino acid sequence of SEQ ID NO: 299.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 841, b. CDR-L2 comprising the amino acid sequence of SEQ ID NO: 1383, c. CDR-L3 comprising the amino acid sequence of SEQ ID NO: 1925, and a VH comprising the amino acid sequence of SEQ ID NO: 28.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 28. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 28. In some embodiments, substitutions, insertions, or deletions occur in regions outside the CDRs (e.g., in the FRs). Optionally, the antibody or antigen-binding fragment thereof comprises the VH sequence SEQ ID NO: 28, including one or more post-translational modifications of that sequence. In a particular embodiment, the VH comprises one, two or three CDRs selected from: a. CDR-H1, comprising the amino acid sequence SEQ ID NO: 570, b. CDR-H2, comprising the amino acid sequence SEQ ID NO: 1112, and c. CDR-H3, comprising the amino acid sequence SEQ ID NO: 1654.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 299. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 299. In some embodiments, the substitutions, insertions, or deletions occur in regions outside the CDRs (e.g., in the FRs). Optionally, the antibody or antigen-binding fragment thereof comprises the VL sequence SEQ ID NO: 299, including one or more post-translational modifications of that sequence. In a particular embodiment, the VL comprises one, two or three CDRs selected from: a. CDR-L1, comprising the amino acid sequence SEQ ID NO: 841, b. CDR-L2, comprising the amino acid sequence SEQ ID NO: 1383, and c. CDR-L3, comprising the amino acid sequence SEQ ID NO: 1925.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 28, and the VL amino acid sequence of SEQ ID NO: 299, optionally including post-translational modifications of those sequences.
TBRE1016

In one aspect, the present disclosure provides an antibody or antigen-binding fragment thereof comprising at least one or both variable regions selected from: a. VH comprising the amino acid sequence of SEQ ID NO: 29 and b. VL comprising the amino acid sequence of SEQ ID NO: 300.

In one aspect, the present disclosure provides an antibody or antigen-binding fragment thereof comprising at least one, two, three, four, five, or six CDRs selected from: a. CDR-H1 comprising the amino acid sequence of SEQ ID NO: 571, b. CDR-H2 comprising the amino acid sequence of SEQ ID NO: 1113, c. CDR-H3 comprising the amino acid sequence of SEQ ID NO: 1655, d. CDR-L1 comprising the amino acid sequence of SEQ ID NO: 842, e. CDR-L2 comprising the amino acid sequence of SEQ ID NO: 1384, and f. CDR-L3 comprising the amino acid sequence of SEQ ID NO: 1926.

In one aspect, the present disclosure provides an antibody or antigen-binding fragment thereof comprising: a. CDR-H1 comprising the amino acid sequence of SEQ ID NO: 571, b. CDR-H2 comprising the amino acid sequence of SEQ ID NO: 1113, c. CDR-H3 comprising the amino acid sequence of SEQ ID NO: 1655, d. CDR-L1 comprising the amino acid sequence of SEQ ID NO: 842, e. CDR-L2 comprising the amino acid sequence of SEQ ID NO: 1384, and f. CDR-L3 comprising the amino acid sequence of SEQ ID NO: 1926. In one aspect, the present disclosure provides an antibody or antigen-binding fragment thereof comprising a CDR-H3 comprising the amino acid sequence of SEQ ID NO: 1655, and a CDR-L3 comprising the amino acid sequence of SEQ ID NO: 1926.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 571, b. CDR-H2 comprising the amino acid sequence of SEQ ID NO: 1113, c. CDR-H3 comprising the amino acid sequence of SEQ ID NO: 1655, and a VL comprising the amino acid sequence of SEQ ID NO: 300.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 842, b. CDR-L2 comprising the amino acid sequence of SEQ ID NO: 1384, c. CDR-L3 comprising the amino acid sequence of SEQ ID NO: 1926, and a VH comprising the amino acid sequence of SEQ ID NO: 29.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 29. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 29. In some embodiments, substitutions, insertions, or deletions occur in regions outside the CDRs (e.g., in the FRs). Optionally, the antibody or antigen-binding fragment thereof comprises the VH sequence SEQ ID NO: 29, including one or more post-translational modifications of that sequence. In a particular embodiment, the VH comprises one, two or three CDRs selected from: a. CDR-H1, comprising the amino acid sequence SEQ ID NO: 571, b. CDR-H2, comprising the amino acid sequence SEQ ID NO: 1113, and c. CDR-H3, comprising the amino acid sequence SEQ ID NO: 1655.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 300. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 300. In some embodiments, the substitutions, insertions, or deletions occur in regions outside the CDRs (e.g., in the FRs). Optionally, the antibody or antigen-binding fragment thereof comprises the VL sequence SEQ ID NO: 300, including one or more post-translational modifications of that sequence. In a particular embodiment, the VL comprises one, two or three CDRs selected from: a. CDR-L1, comprising the amino acid sequence SEQ ID NO: 842, b. CDR-L2, comprising the amino acid sequence SEQ ID NO: 1384, and c. CDR-L3, comprising the amino acid sequence SEQ ID NO: 1926.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 29, and the VL amino acid sequence of SEQ ID NO: 300, optionally including post-translational modifications of those sequences.
TBRE1017

In one aspect, the present disclosure provides an antibody or antigen-binding fragment thereof comprising at least one or both variable regions selected from: a. VH comprising the amino acid sequence of SEQ ID NO: 30 and b. VL comprising the amino acid sequence of SEQ ID NO: 301.

In one aspect, the present disclosure provides an antibody or antigen-binding fragment thereof comprising at least one, two, three, four, five, or six CDRs selected from: a. CDR-H1 comprising the amino acid sequence of SEQ ID NO: 572, b. CDR-H2 comprising the amino acid sequence of SEQ ID NO: 1114, c. CDR-H3 comprising the amino acid sequence of SEQ ID NO: 1656, d. CDR-L1 comprising the amino acid sequence of SEQ ID NO: 843, e. CDR-L2 comprising the amino acid sequence of SEQ ID NO: 1385, and f. CDR-L3 comprising the amino acid sequence of SEQ ID NO: 1927.

In one aspect, the present disclosure provides an antibody or antigen-binding fragment thereof comprising: a. CDR-H1 comprising the amino acid sequence of SEQ ID NO: 572, b. CDR-H2 comprising the amino acid sequence of SEQ ID NO: 1114, c. CDR-H3 comprising the amino acid sequence of SEQ ID NO: 1656, d. CDR-L1 comprising the amino acid sequence of SEQ ID NO: 843, e. CDR-L2 comprising the amino acid sequence of SEQ ID NO: 1385, and f. CDR-L3 comprising the amino acid sequence of SEQ ID NO: 1927. In one aspect, the present disclosure provides an antibody or antigen-binding fragment thereof comprising a CDR-H3 comprising the amino acid sequence of SEQ ID NO: 1656, and a CDR-L3 comprising the amino acid sequence of SEQ ID NO: 1927.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 572, b. CDR-H2 comprising the amino acid sequence of SEQ ID NO: 1114, c. CDR-H3 comprising the amino acid sequence of SEQ ID NO: 1656, and a VL comprising the amino acid sequence of SEQ ID NO: 301.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 843, b. CDR-L2 comprising the amino acid sequence of SEQ ID NO: 1385, c. CDR-L3 comprising the amino acid sequence of SEQ ID NO: 1927, and a VH comprising the amino acid sequence of SEQ ID NO: 30.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 30. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 30. In some embodiments, substitutions, insertions, or deletions occur in regions outside the CDRs (e.g., in the FRs). Optionally, the antibody or antigen-binding fragment thereof comprises the VH sequence SEQ ID NO: 30, including one or more post-translational modifications of that sequence. In a particular embodiment, the VH comprises one, two or three CDRs selected from: a. CDR-H1, comprising the amino acid sequence SEQ ID NO: 572, b. CDR-H2, comprising the amino acid sequence SEQ ID NO: 1114, and c. CDR-H3, comprising the amino acid sequence SEQ ID NO: 1656.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 301. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 301. In some embodiments, the substitutions, insertions, or deletions occur in regions outside the CDRs (e.g., in the FRs). Optionally, the antibody or antigen-binding fragment thereof comprises the VL sequence SEQ ID NO: 301, including one or more post-translational modifications of that sequence. In a particular embodiment, the VL comprises one, two or three CDRs selected from: a. CDR-L1, comprising the amino acid sequence SEQ ID NO: 843, b. CDR-L2, comprising the amino acid sequence SEQ ID NO: 1385, and c. CDR-L3, comprising the amino acid sequence SEQ ID NO: 1927.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 30, and the VL amino acid sequence of SEQ ID NO: 301, optionally including post-translational modifications of those sequences.

TBRE1018

In one aspect, the present disclosure provides an antibody or antigen-binding fragment thereof comprising at least one or both variable regions selected from: a. VH comprising the amino acid sequence of SEQ ID NO: 31 and b. VL comprising the amino acid sequence of SEQ ID NO: 302.

In one aspect, the present disclosure provides an antibody or antigen-binding fragment thereof comprising at least one, two, three, four, five, or six CDRs selected from: a. CDR-H1 comprising the amino acid sequence of SEQ ID NO: 573, b. CDR-H2 comprising the amino acid sequence of SEQ ID NO: 1115, c. CDR-H3 comprising the amino acid sequence of SEQ ID NO: 1657, d. CDR-L1 comprising the amino acid sequence of SEQ ID NO: 844, e. CDR-L2 comprising the amino acid sequence of SEQ ID NO: 1386, and f. CDR-L3 comprising the amino acid sequence of SEQ ID NO: 1928.

In one aspect, the present disclosure provides an antibody or antigen-binding fragment thereof comprising: a. CDR-H1 comprising the amino acid sequence of SEQ ID NO: 573, b. CDR-H2 comprising the amino acid sequence of SEQ ID NO: 1115, c. CDR-H3 comprising the amino acid sequence of SEQ ID NO: 1657, d. CDR-L1 comprising the amino acid sequence of SEQ ID NO: 844, e. CDR-L2 comprising the amino acid sequence of SEQ ID NO: 1386, and f. CDR-L3 comprising the amino acid sequence of SEQ ID NO: 1928. In one aspect, the present disclosure provides an antibody or antigen-binding fragment thereof comprising a CDR-H3 comprising the amino acid sequence of SEQ ID NO: 1657, and a CDR-L3 comprising the amino acid sequence of SEQ ID NO: 1928.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 573, b. CDR-H2 comprising the amino acid sequence of SEQ ID NO: 1115, c. CDR-H3 comprising the amino acid sequence of SEQ ID NO: 1657, and a VL comprising the amino acid sequence of SEQ ID NO: 302.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 844, b. CDR-L2 comprising the amino acid sequence of SEQ ID NO: 1386, c. CDR-L3 comprising the amino acid sequence of SEQ ID NO: 1928, and a VH comprising the amino acid sequence of SEQ ID NO: 31.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 31. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 31. In some embodiments, substitutions, insertions, or deletions occur in regions outside the CDRs (e.g., in the FRs). Optionally, the antibody or antigen-binding fragment thereof comprises the VH sequence SEQ ID NO: 31, including one or more post-translational modifications of that sequence. In a particular embodiment, the VH comprises one, two or three CDRs selected from: a. CDR-H1, comprising the amino acid sequence SEQ ID NO: 573, b. CDR-H2, comprising the amino acid sequence SEQ ID NO: 1115, and c. CDR-H3, comprising the amino acid sequence SEQ ID NO: 1657.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 302. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 302. In some embodiments, the substitutions, insertions, or deletions occur in regions outside the CDRs (e.g., in the FRs). Optionally, the antibody or antigen-binding fragment thereof comprises the VL sequence SEQ ID NO: 302, including one or more post-translational modifications of that sequence. In a particular embodiment, the VL comprises one, two or three CDRs selected from: a. CDR-L1, comprising the amino acid sequence SEQ ID NO: 844, b. CDR-L2, comprising the amino acid sequence SEQ ID NO: 1386, and c. CDR-L3, comprising the amino acid sequence SEQ ID NO: 1928.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 31, and the VL amino acid sequence of SEQ ID NO: 302, optionally including post-translational modifications of those sequences.

TBRE1019

In one aspect, the present disclosure provides an antibody or antigen-binding fragment thereof comprising at least one or both variable regions selected from: a. VH comprising the amino acid sequence of SEQ ID NO: 32 and b. VL comprising the amino acid sequence of SEQ ID NO: 303.

In one aspect, the present disclosure provides an antibody or antigen-binding fragment thereof comprising at least one, two, three, four, five, or six CDRs selected from: a. CDR-H1 comprising the amino acid sequence of SEQ ID NO: 574, b. CDR-H2 comprising the amino acid sequence of SEQ ID NO: 1116, c. CDR-H3 comprising the amino acid sequence of SEQ ID NO: 1658, d. CDR-L1 comprising the amino acid sequence of SEQ ID NO: 845, e. CDR-L2 comprising the amino acid sequence of SEQ ID NO: 1387, and f. CDR-L3 comprising the amino acid sequence of SEQ ID NO: 1929.

In one aspect, the present disclosure provides an antibody or antigen-binding fragment thereof comprising: a. CDR-H1 comprising the amino acid sequence of SEQ ID NO: 574, b. CDR-H2 comprising the amino acid sequence of SEQ ID NO: 1116, c. CDR-H3 comprising the amino acid sequence of SEQ ID NO: 1658, d. CDR-L1 comprising the amino acid sequence of SEQ ID NO: 845, e. CDR-L2 comprising the amino acid sequence of SEQ ID NO: 1387, and f. CDR-L3 comprising the amino acid sequence of SEQ ID NO: 1929.

In one aspect, the present disclosure provides an antibody or antigen-binding fragment thereof comprising a CDR-H3 comprising the amino acid sequence of SEQ ID NO: 1658, and a CDR-L3 comprising the amino acid sequence of SEQ ID NO: 1929.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 574, b. CDR-H2 comprising the amino acid sequence of SEQ ID NO: 1116, c. CDR-H3 comprising the amino acid sequence of SEQ ID NO: 1658, and a VL comprising the amino acid sequence of SEQ ID NO: 303.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 845, b. CDR-L2 comprising the amino acid sequence of SEQ ID NO: 1387, c. CDR-L3 comprising the amino acid sequence of SEQ ID NO: 1929, and a VH comprising the amino acid sequence of SEQ ID NO: 32.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 32. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 32. In some embodiments, substitutions, insertions, or deletions occur in regions outside the CDRs (e.g., in the FRs). Optionally, the antibody or antigen-binding fragment thereof comprises the VH sequence SEQ ID NO: 32, including one or more post-translational modifications of that sequence. In a particular embodiment, the VH comprises one, two or three CDRs selected from: a. CDR-H1, comprising the amino acid sequence SEQ ID NO: 574, b. CDR-H2, comprising the amino acid sequence SEQ ID NO: 1116, and c. CDR-H3, comprising the amino acid sequence SEQ ID NO: 1658.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 303. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 303. In some embodiments, the substitutions, insertions, or deletions occur in regions outside the CDRs (e.g., in the FRs). Optionally, the antibody or antigen-binding fragment thereof comprises the VL sequence SEQ ID NO: 303, including one or more post-translational modifications of that sequence. In a particular embodiment, the VL comprises one, two or three CDRs selected from: a. CDR-L1, comprising the amino acid sequence SEQ ID NO: 845, b. CDR-L2, comprising the amino acid sequence SEQ ID NO: 1387, and c. CDR-L3, comprising the amino acid sequence SEQ ID NO: 1929.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 32, and the VL amino acid sequence of SEQ ID NO: 303, optionally including post-translational modifications of those sequences.
TBRE1020

In one aspect, the present disclosure provides an antibody or antigen-binding fragment thereof comprising at least one or both variable regions selected from: a. VH comprising the amino acid sequence of SEQ ID NO: 33 and b. VL comprising the amino acid sequence of SEQ ID NO: 304.

In one aspect, the present disclosure provides an antibody or antigen-binding fragment thereof comprising at least one, two, three, four, five, or six CDRs selected from: a. CDR-H1 comprising the amino acid sequence of SEQ ID NO: 575, b. CDR-H2 comprising the amino acid sequence of SEQ ID NO: 1117, c. CDR-H3 comprising the amino acid sequence of SEQ ID NO: 1659, d. CDR-L1 comprising the amino acid sequence of SEQ ID NO: 846, e. CDR-L2 comprising the amino acid sequence of SEQ ID NO: 1388, and f. CDR-L3 comprising the amino acid sequence of SEQ ID NO: 1930.

In one aspect, the present disclosure provides an antibody or antigen-binding fragment thereof comprising: a. CDR-H1 comprising the amino acid sequence of SEQ ID NO: 575, b. CDR-H2 comprising the amino acid sequence of SEQ ID NO: 1117, c. CDR-H3 comprising the amino acid sequence of SEQ ID NO: 1659, d. CDR-L1 comprising the amino acid sequence of SEQ ID NO: 846, e. CDR-L2 comprising the amino acid sequence of SEQ ID NO: 1388, and f. CDR-L3 comprising the amino acid sequence of SEQ ID NO: 1930. In one aspect, the present disclosure provides an antibody or antigen-binding fragment thereof comprising a CDR-H3 comprising the amino acid sequence of SEQ ID NO: 1659, and a CDR-L3 comprising the amino acid sequence of SEQ ID NO: 1930.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 575, b. CDR-H2 comprising the amino acid sequence of SEQ ID NO: 1117, c. CDR-H3 comprising the amino acid sequence of SEQ ID NO: 1659, and a VL comprising the amino acid sequence of SEQ ID NO: 304.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 846, b. CDR-L2 comprising the amino acid sequence of SEQ ID NO: 1388, c. CDR-L3 comprising the amino acid sequence of SEQ ID NO: 1930, and a VH comprising the amino acid sequence of SEQ ID NO: 33.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 33. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 33. In some embodiments, substitutions, insertions, or deletions occur in regions outside the CDRs (e.g., in the FRs). Optionally, the antibody or antigen-binding fragment thereof comprises the VH sequence SEQ ID NO: 33, including one or more post-translational modifications of that sequence. In a particular embodiment, the VH comprises one, two or three CDRs selected from: a. CDR-H1, comprising the amino acid sequence SEQ ID NO: 575, b. CDR-H2, comprising the amino acid sequence SEQ ID NO: 1117, and c. CDR-H3, comprising the amino acid sequence SEQ ID NO: 1659.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 304. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 304. In some embodiments, the substitutions, insertions, or deletions occur in regions outside the CDRs (e.g., in the FRs). Optionally, the antibody or antigen-binding fragment thereof comprises the VL sequence SEQ ID NO: 304, including one or more post-translational modifications of that sequence. In a particular embodiment, the VL comprises one, two or three CDRs selected from: a. CDR-L1, comprising the amino acid sequence SEQ ID NO: 846, b. CDR-L2, comprising the amino acid sequence SEQ ID NO: 1388, and c. CDR-L3, comprising the amino acid sequence SEQ ID NO: 1930.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 33, and the VL amino acid sequence of SEQ ID NO: 304, optionally including post-translational modifications of those sequences.
TBRE1021

In one aspect, the present disclosure provides an antibody or antigen-binding fragment thereof comprising at least one or both variable regions selected from: a. VH comprising the amino acid sequence of SEQ ID NO: 34 and b. VL comprising the amino acid sequence of SEQ ID NO: 305.

In one aspect, the present disclosure provides an antibody or antigen-binding fragment thereof comprising at least one, two, three, four, five, or six CDRs selected from: a. CDR-H1 comprising the amino acid sequence of SEQ ID NO: 576, b. CDR-H2 comprising the amino acid sequence of SEQ ID NO: 1118, c. CDR-H3 comprising the amino acid sequence of SEQ ID NO: 1660, d. CDR-L1 comprising the amino acid sequence of SEQ ID NO: 847, e. CDR-L2 comprising the amino acid sequence of SEQ ID NO: 1389, and f. CDR-L3 comprising the amino acid sequence of SEQ ID NO: 1931.

In one aspect, the present disclosure provides an antibody or antigen-binding fragment thereof comprising: a. CDR-H1 comprising the amino acid sequence of SEQ ID NO: 576, b. CDR-H2 comprising the amino acid sequence of SEQ ID NO: 1118, c. CDR-H3 comprising the amino acid sequence of SEQ ID NO: 1660, d. CDR-L1 comprising the amino acid sequence of SEQ ID NO: 847, e. CDR-L2 comprising the amino acid sequence of SEQ ID NO: 1389, and f. CDR-L3 comprising the amino acid sequence of SEQ ID NO: 1931. In one aspect, the present disclosure provides an antibody or antigen-binding fragment thereof comprising a CDR-H3 comprising the amino acid sequence of SEQ ID NO: 1660, and a CDR-L3 comprising the amino acid sequence of SEQ ID NO: 1931.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 576, b. CDR-H2 comprising the amino acid sequence of SEQ ID NO: 1118, c. CDR-H3 comprising the amino acid sequence of SEQ ID NO: 1660, and a VL comprising the amino acid sequence of SEQ ID NO: 305.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 847, b. CDR-L2 comprising the amino acid sequence of SEQ ID NO: 1389, c. CDR-L3 comprising the amino acid sequence of SEQ ID NO: 1931, and a VH comprising the amino acid sequence of SEQ ID NO: 34.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 34. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 34. In some embodiments, substitutions, insertions, or deletions occur in regions outside the CDRs (e.g., in the FRs). Optionally, the antibody or antigen-binding fragment thereof comprises the VH sequence SEQ ID NO: 34, including one or more post-translational modifications of that sequence. In a particular embodiment, the VH comprises one, two or three CDRs selected from: a. CDR-H1, comprising the amino acid sequence SEQ ID NO: 576, b. CDR-H2, comprising the amino acid sequence SEQ ID NO: 1118, and c. CDR-H3, comprising the amino acid sequence SEQ ID NO: 1660.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 305. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 305. In some embodiments, the substitutions, insertions, or deletions occur in regions outside the CDRs (e.g., in the FRs). Optionally, the antibody or antigen-binding fragment thereof comprises the VL sequence SEQ ID NO: 305, including one or more post-translational modifications of that sequence. In a particular embodiment, the VL comprises one, two or three CDRs selected from: a. CDR-L1, comprising the amino acid sequence SEQ ID NO: 847, b. CDR-L2, comprising the amino acid sequence SEQ ID NO: 1389, and c. CDR-L3, comprising the amino acid sequence SEQ ID NO: 1931.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 34, and the VL amino acid sequence of SEQ ID NO: 305, optionally including post-translational modifications of those sequences.
TBRE1022

In one aspect, the present disclosure provides an antibody or antigen-binding fragment thereof comprising at least one or both variable regions selected from: a. VH comprising the amino acid sequence of SEQ ID NO: 35 and b. VL comprising the amino acid sequence of SEQ ID NO: 306.

In one aspect, the present disclosure provides an antibody or antigen-binding fragment thereof comprising at least one, two, three, four, five, or six CDRs selected from: a. CDR-H1 comprising the amino acid sequence of SEQ ID NO: 577, b. CDR-H2 comprising the amino acid sequence of SEQ ID NO: 1119, c. CDR-H3 comprising the amino acid sequence of SEQ ID NO: 1661, d. CDR-L1 comprising the amino acid sequence of SEQ ID NO: 848, e. CDR-L2 comprising the amino acid sequence of SEQ ID NO: 1390, and f. CDR-L3 comprising the amino acid sequence of SEQ ID NO: 1932.

In one aspect, the present disclosure provides an antibody or antigen-binding fragment thereof comprising: a. CDR-H1 comprising the amino acid sequence of SEQ ID NO: 577, b. CDR-H2 comprising the amino acid sequence of SEQ ID NO: 1119, c. CDR-H3 comprising the amino acid sequence of SEQ ID NO: 1661, d. CDR-L1 comprising the amino acid sequence of SEQ ID NO: 848, e. CDR-L2 comprising the amino acid sequence of SEQ ID NO: 1390, and f. CDR-L3 comprising the amino acid sequence of SEQ ID NO: 1932. In one aspect, the present disclosure provides an antibody or antigen-binding fragment thereof comprising a CDR-H3 comprising the amino acid sequence of SEQ ID NO: 1661, and a CDR-L3 comprising the amino acid sequence of SEQ ID NO: 1932.

In one aspect, the present disclosure provides an antibody or antigen-binding fragment thereof comprising at least one, at least two, or all three VH CDR sequences selected from:

a. CDR-H1 comprising the amino acid sequence of SEQ ID NO: 577, b. CDR-H2 comprising the amino acid sequence of SEQ ID NO: 1119, c. CDR-H3 comprising the amino acid sequence of SEQ ID NO: 1661, and a. VL comprising the amino acid sequence of SEQ ID NO: 306.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 848, b. CDR-L2 comprising the amino acid sequence of SEQ ID NO: 1390, c. CDR-L3 comprising the amino acid sequence of SEQ ID NO: 1932, and a VH comprising the amino acid sequence of SEQ ID NO: 35.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 35. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 35. In some embodiments, substitutions, insertions, or deletions occur in regions outside the CDRs (e.g., in the FRs). Optionally, the antibody or antigen-binding fragment thereof comprises the VH sequence SEQ ID NO: 35, including one or more post-translational modifications of that sequence. In a particular embodiment, the VH comprises one, two or three CDRs selected from: a. CDR-H1, comprising the amino acid sequence SEQ ID NO: 577, b. CDR-H2, comprising the amino acid sequence SEQ ID NO: 1119, and c. CDR-H3, comprising the amino acid sequence SEQ ID NO: 1661.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 306. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 306. In some embodiments, the substitutions, insertions, or deletions occur in regions outside the CDRs (e.g., in the FRs). Optionally, the antibody or antigen-binding fragment thereof comprises the VL sequence SEQ ID NO: 306, including one or more post-translational modifications of that sequence. In a particular embodiment, the VL comprises one, two or three CDRs selected from: a. CDR-L1, comprising the amino acid sequence SEQ ID NO: 848, b. CDR-L2, comprising the amino acid sequence SEQ ID NO: 1390, and c. CDR-L3, comprising the amino acid sequence SEQ ID NO: 1932.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 35, and the VL amino acid sequence of SEQ ID NO: 306, optionally including post-translational modifications of those sequences.

TBRE1023

In one aspect, the present disclosure provides an antibody or antigen-binding fragment thereof comprising at least one or both variable regions selected from: a. VH comprising the amino acid sequence of SEQ ID NO: 36 and b. VL comprising the amino acid sequence of SEQ ID NO: 307.

In one aspect, the present disclosure provides an antibody or antigen-binding fragment thereof comprising at least one, two, three, four, five, or six CDRs selected from: a. CDR-H1 comprising the amino acid sequence of SEQ ID NO: 578, b. CDR-H2 comprising the amino acid sequence of SEQ ID NO: 1120, c. CDR-H3 comprising the amino acid sequence of SEQ ID NO: 1662, d. CDR-L1 comprising the amino acid sequence of SEQ ID NO: 849, e. CDR-L2 comprising the amino acid sequence of SEQ ID NO: 1391, and f. CDR-L3 comprising the amino acid sequence of SEQ ID NO: 1933.

In one aspect, the present disclosure provides an antibody or antigen-binding fragment thereof comprising: a. CDR-H1 comprising the amino acid sequence of SEQ ID NO: 578, b. CDR-H2 comprising the amino acid sequence of SEQ ID NO: 1120, c. CDR-H3 comprising the amino acid sequence of SEQ ID NO: 1662, d. CDR-L1 comprising the amino acid sequence of SEQ ID NO: 849, e. CDR-L2 comprising the amino acid sequence of SEQ ID NO: 1391, and f. CDR-L3 comprising the amino acid sequence of SEQ ID NO: 1933. In one aspect, the present disclosure provides an antibody or antigen-binding fragment thereof comprising a CDR-H3 comprising the amino acid sequence of SEQ ID NO: 1662, and a CDR-L3 comprising the amino acid sequence of SEQ ID NO: 1933.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 578, b. CDR-H2 comprising the amino acid sequence of SEQ ID NO: 1120, c. CDR-H3 comprising the amino acid sequence of SEQ ID NO: 1662, and a VL comprising the amino acid sequence of SEQ ID NO: 307.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 849, b. CDR-L2 comprising the amino acid sequence of SEQ ID NO: 1391, c. CDR-L3 comprising the amino acid sequence of SEQ ID NO: 1933, and a VH comprising the amino acid sequence of SEQ ID NO: 36.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 36. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 36. In some embodiments, substitutions, insertions, or deletions occur in regions outside the CDRs (e.g., in the FRs). Optionally, the antibody or antigen-binding fragment thereof comprises the VH sequence SEQ ID NO: 36, including one or more post-translational modifications of that sequence. In a particular embodiment, the VH comprises one, two or three CDRs selected from: a. CDR-H1, comprising the amino acid sequence SEQ ID NO: 578, b. CDR-H2, comprising the amino acid sequence SEQ ID NO: 1120, and c. CDR-H3, comprising the amino acid sequence SEQ ID NO: 1662.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 307. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 307. In some embodiments, the substitutions, insertions, or deletions occur in regions outside the CDRs (e.g., in the FRs). Optionally, the antibody or antigen-binding fragment thereof comprises the VL sequence SEQ ID NO: 307, including one or more post-translational modifications of that sequence. In a particular embodiment, the VL comprises one, two or three CDRs selected from: a. CDR-L1, comprising the amino acid sequence SEQ ID NO: 849, b. CDR-L2, comprising the amino acid sequence SEQ ID NO: 1391, and c. CDR-L3, comprising the amino acid sequence SEQ ID NO: 1933.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 36, and the VL amino acid sequence of SEQ ID NO: 307, optionally including post-translational modifications of those sequences.
TBRE1024

In one aspect, the present disclosure provides an antibody or antigen-binding fragment thereof comprising at least one or both variable regions selected from: a. VH comprising the amino acid sequence of SEQ ID NO: 37 and b. VL comprising the amino acid sequence of SEQ ID NO: 308.

In one aspect, the present disclosure provides an antibody or antigen-binding fragment thereof comprising at least one, two, three, four, five, or six CDRs selected from: a. CDR-H1 comprising the amino acid sequence of SEQ ID NO: 579, b. CDR-H2 comprising the amino acid sequence of SEQ ID NO: 1121, c. CDR-H3 comprising the amino acid sequence of SEQ ID NO: 1663, d. CDR-L1 comprising the amino acid sequence of SEQ ID NO: 850, e. CDR-L2 comprising the amino acid sequence of SEQ ID NO: 1392, and f. CDR-L3 comprising the amino acid sequence of SEQ ID NO: 1934.

In one aspect, the present disclosure provides an antibody or antigen-binding fragment thereof comprising: a. CDR-H1 comprising the amino acid sequence of SEQ ID NO: 579, b. CDR-H2 comprising the amino acid sequence of SEQ ID NO: 1121, c. CDR-H3 comprising the amino acid sequence of SEQ ID NO: 1663, d. CDR-L1 comprising the amino acid sequence of SEQ ID NO: 850, e. CDR-L2 comprising the amino acid sequence of SEQ ID NO: 1392, and f. CDR-L3 comprising the amino acid sequence of SEQ ID NO: 1934.

In one aspect, the present disclosure provides an antibody or antigen-binding fragment thereof comprising a CDR-H3 comprising the amino acid sequence of SEQ ID NO: 1663, and a CDR-L3 comprising the amino acid sequence of SEQ ID NO: 1934.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 579, b. CDR-H2 comprising the amino acid sequence of SEQ ID NO: 1121, c. CDR-H3 comprising the amino acid sequence of SEQ ID NO: 1663, and a VL comprising the amino acid sequence of SEQ ID NO: 308.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 850, b. CDR-L2 comprising the amino acid sequence of SEQ ID NO: 1392, c. CDR-L3 comprising the amino acid sequence of SEQ ID NO: 1934, and a VH comprising the amino acid sequence of SEQ ID NO: 37.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 37. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 37. In some embodiments, substitutions, insertions, or deletions occur in regions outside the CDRs (e.g., in the FRs). Optionally, the antibody or antigen-binding fragment thereof comprises the VH sequence SEQ ID NO: 37, including one or more post-translational modifications of that sequence. In a particular embodiment, the VH comprises one, two or three CDRs selected from: a. CDR-H1, comprising the amino acid sequence SEQ ID NO: 579, b. CDR-H2, comprising the amino acid sequence SEQ ID NO: 1121, and c. CDR-H3, comprising the amino acid sequence SEQ ID NO: 1663.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 308. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 308. In some embodiments, the substitutions, insertions, or deletions occur in regions outside the CDRs (e.g., in the FRs). Optionally, the antibody or antigen-binding fragment thereof comprises the VL sequence SEQ ID NO: 308, including one or more post-translational modifications of that sequence. In a particular embodiment, the VL comprises one, two or three CDRs selected from: a. CDR-L1, comprising the amino acid sequence SEQ ID NO: 850, b. CDR-L2, comprising the amino acid sequence SEQ ID NO: 1392, and c. CDR-L3, comprising the amino acid sequence SEQ ID NO: 1934.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 37, and the VL amino acid sequence of SEQ ID NO: 308, optionally including post-translational modifications of those sequences.

TBRE1025

In one aspect, the present disclosure provides an antibody or antigen-binding fragment thereof comprising at least one or both variable regions selected from: a. VH comprising the amino acid sequence of SEQ ID NO: 38 and b. VL comprising the amino acid sequence of SEQ ID NO: 309.

In one aspect, the present disclosure provides an antibody or antigen-binding fragment thereof comprising at least one, two, three, four, five, or six CDRs selected from: a. CDR-H1 comprising the amino acid sequence of SEQ ID NO: 580, b. CDR-H2 comprising the amino acid sequence of SEQ ID NO: 1122, c. CDR-H3 comprising the amino acid sequence of SEQ ID NO: 1664, d. CDR-L1 comprising the amino acid sequence of SEQ ID NO: 851, e. CDR-L2 comprising the amino acid sequence of SEQ ID NO: 1393, and f. CDR-L3 comprising the amino acid sequence of SEQ ID NO: 1935.

In one aspect, the present disclosure provides an antibody or antigen-binding fragment thereof comprising: a. CDR-H1 comprising the amino acid sequence of SEQ ID NO: 580, b. CDR-H2 comprising the amino acid sequence of SEQ ID NO: 1122, c. CDR-H3 comprising the amino acid sequence of SEQ ID NO: 1664, d. CDR-L1 comprising the amino acid sequence of SEQ ID NO: 851, e. CDR-L2 comprising the amino acid sequence of SEQ ID NO: 1393, and f. CDR-L3 comprising the amino acid sequence of SEQ ID NO: 1935. In one aspect, the present disclosure provides an antibody or antigen-binding fragment thereof comprising a CDR-H3 comprising the amino acid sequence of SEQ ID NO: 1664, and a CDR-L3 comprising the amino acid sequence of SEQ ID NO: 1935.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 580, b. CDR-H2 comprising the amino acid sequence of SEQ ID NO: 1122, c. CDR-H3 comprising the amino acid sequence of SEQ ID NO: 1664, and a VL comprising the amino acid sequence of SEQ ID NO: 309.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 851, b. CDR-L2 comprising the amino acid sequence of SEQ ID NO: 1393, c. CDR-L3 comprising the amino acid sequence of SEQ ID NO: 1935, and a VH comprising the amino acid sequence of SEQ ID NO: 38.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 38. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 38. In some embodiments, substitutions, insertions, or deletions occur in regions outside the CDRs (e.g., in the FRs). Optionally, the antibody or antigen-binding fragment thereof comprises the VH sequence SEQ ID NO: 38, including one or more post-translational modifications of that sequence. In a particular embodiment, the VH comprises one, two or three CDRs selected from: a. CDR-H1, comprising the amino acid sequence SEQ ID NO: 580, b. CDR-H2, comprising the amino acid sequence SEQ ID NO: 1122, and c. CDR-H3, comprising the amino acid sequence SEQ ID NO: 1664.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 309. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 309. In some embodiments, the substitutions, insertions, or deletions occur in regions outside the CDRs (e.g., in the FRs). Optionally, the antibody or antigen-binding fragment thereof comprises the VL sequence SEQ ID NO: 309, including one or more post-translational modifications of that sequence. In a particular embodiment, the VL comprises one, two or three CDRs selected from: a. CDR-L1, comprising the amino acid sequence SEQ ID NO: 851, b. CDR-L2, comprising the amino acid sequence SEQ ID NO: 1393, and c. CDR-L3, comprising the amino acid sequence SEQ ID NO: 1935.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 38, and the VL amino acid sequence of SEQ ID NO: 309, optionally including post-translational modifications of those sequences.

TBRE1026

In one aspect, the present disclosure provides an antibody or antigen-binding fragment thereof comprising at least one or both variable regions selected from: a. VH comprising the amino acid sequence of SEQ ID NO: 39 and b. VL comprising the amino acid sequence of SEQ ID NO: 310.

In one aspect, the present disclosure provides an antibody or antigen-binding fragment thereof comprising at least one, two, three, four, five, or six CDRs selected from: a. CDR-H1 comprising the amino acid sequence of SEQ ID NO: 581, b. CDR-H2 comprising the amino acid sequence of SEQ ID NO: 1123, c. CDR-H3 comprising the amino acid sequence of SEQ ID NO: 1665, d. CDR-L1 comprising the amino acid sequence of SEQ ID NO: 852, e. CDR-L2 comprising the amino acid sequence of SEQ ID NO: 1394, and f. CDR-L3 comprising the amino acid sequence of SEQ ID NO: 1936.

In one aspect, the present disclosure provides an antibody or antigen-binding fragment thereof comprising a. CDR-H1 comprising the amino acid sequence of SEQ ID NO: 581, b. CDR-H2 comprising the amino acid sequence of SEQ ID NO: 1123, c. CDR-H3 comprising the amino acid sequence of SEQ ID NO: 1665, d. CDR-L1 comprising the amino acid sequence of SEQ ID NO: 852, e. CDR-L2 comprising the amino acid sequence of SEQ ID NO: 1394, and f. CDR-L3 comprising the amino acid sequence of SEQ ID NO: 1936. In one aspect, the present disclosure provides an antibody or antigen-binding fragment thereof comprising a CDR-H3 comprising the amino acid sequence of SEQ ID NO: 1665, and a CDR-L3 comprising the amino acid sequence of SEQ ID NO: 1936.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 581, b. CDR-H2 comprising the amino acid sequence of SEQ ID NO: 1123, c. CDR-H3 comprising the amino acid sequence of SEQ ID NO: 1665, and a VL comprising the amino acid sequence of SEQ ID NO: 310.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 852, b. CDR-L2 comprising the amino acid sequence of SEQ ID NO: 1394, c. CDR-L3 comprising the amino acid sequence of SEQ ID NO: 1936, and a VH comprising the amino acid sequence of SEQ ID NO: 39.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 39. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 39. In some embodiments, substitutions, insertions, or deletions occur in regions outside the CDRs (e.g., in the FRs). Optionally, the antibody or antigen-binding fragment thereof comprises the VH sequence SEQ ID NO: 39, including one or more post-translational modifications of that sequence. In a particular embodiment, the VH comprises one, two or three CDRs selected from: a. CDR-H1, comprising the amino acid sequence SEQ ID NO: 581, b. CDR-H2, comprising the amino acid sequence SEQ ID NO: 1123, and c. CDR-H3, comprising the amino acid sequence SEQ ID NO: 1665.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 310. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 310. In some embodiments, the substitutions, insertions, or deletions occur in regions outside the CDRs (e.g., in the FRs). Optionally, the antibody or antigen-binding fragment thereof comprises the VL sequence SEQ ID NO: 310, including one or more post-translational modifications of that sequence. In a particular embodiment, the VL comprises one, two or three CDRs selected from: a. CDR-L1, comprising the amino acid sequence SEQ ID NO: 852, b. CDR-L2, comprising the amino acid sequence SEQ ID NO: 1394, and c. CDR-L3, comprising the amino acid sequence SEQ ID NO: 1936.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 39, and the VL amino acid sequence of SEQ ID NO: 310, optionally including post-translational modifications of those sequences.
TBRE1027

In one aspect, the present disclosure provides an antibody or antigen-binding fragment thereof comprising at least one or both variable regions selected from: a. VH comprising the amino acid sequence of SEQ ID NO: 40 and b. VL comprising the amino acid sequence of SEQ ID NO: 311.

In one aspect, the present disclosure provides an antibody or antigen-binding fragment thereof comprising at least one, two, three, four, five, or six CDRs selected from: a. CDR-H1 comprising the amino acid sequence of SEQ ID NO: 582, b. CDR-H2 comprising the amino acid sequence of SEQ ID NO: 1124, c. CDR-H3 comprising the amino acid sequence of SEQ ID NO: 1666, d. CDR-L1 comprising the amino acid sequence of SEQ ID NO: 853, e. CDR-L2 comprising the amino acid sequence of SEQ ID NO: 1395, and f. CDR-L3 comprising the amino acid sequence of SEQ ID NO: 1937.

In one aspect, the present disclosure provides an antibody or antigen-binding fragment thereof comprising: a. CDR-H1 comprising the amino acid sequence of SEQ ID NO: 582, b. CDR-H2 comprising the amino acid sequence of SEQ ID NO: 1124, c. CDR-H3 comprising the amino acid sequence of SEQ ID NO: 1666, d. CDR-L1 comprising the amino acid sequence of SEQ ID NO: 853, e. CDR-L2 comprising the amino acid sequence of SEQ ID NO: 1395, and f. CDR-L3 comprising the amino acid sequence of SEQ ID NO: 1937. In one aspect, the present disclosure provides an antibody or antigen-binding fragment thereof comprising a CDR-H3 comprising the amino acid sequence of SEQ ID NO: 1666, and a CDR-L3 comprising the amino acid sequence of SEQ ID NO: 1937.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 582, b. CDR-H2 comprising the amino acid sequence of SEQ ID NO: 1124, c. CDR-H3 comprising the amino acid sequence of SEQ ID NO: 1666, and a. VL comprising the amino acid sequence of SEQ ID NO: 311.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 853, b. CDR-L2 comprising the amino acid sequence of SEQ ID NO: 1395, c. CDR-L3 comprising the amino acid sequence of SEQ ID NO: 1937, and a VH comprising the amino acid sequence of SEQ ID NO: 40.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 40. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 40. In some embodiments, substitutions, insertions, or deletions occur in regions outside the CDRs (e.g., in the FRs). Optionally, the antibody or antigen-binding fragment thereof comprises the VH sequence SEQ ID NO: 40, including one or more post-translational modifications of that sequence. In a particular embodiment, the VH comprises one, two or three CDRs selected from: a. CDR-H1, comprising the amino acid sequence SEQ ID NO: 582, b. CDR-H2, comprising the amino acid sequence SEQ ID NO: 1124, and c. CDR-H3, comprising the amino acid sequence SEQ ID NO: 1666.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 311. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 311. In some embodiments, the substitutions, insertions, or deletions occur in regions outside the CDRs (e.g., in the FRs). Optionally, the antibody or antigen-binding fragment thereof comprises the VL sequence SEQ ID NO: 311, including one or more post-translational modifications of that sequence. In a particular embodiment, the VL comprises one, two or three CDRs selected from: a. CDR-L1, comprising the amino acid sequence SEQ ID NO: 853, b. CDR-L2, comprising the amino acid sequence SEQ ID NO: 1395, and c. CDR-L3, comprising the amino acid sequence SEQ ID NO: 1937.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 40, and the VL amino acid sequence of SEQ ID NO: 311, optionally including post-translational modifications of those sequences.

TBRE1028

In one aspect, the present disclosure provides an antibody or antigen-binding fragment thereof comprising at least one or both variable regions selected from: a. VH comprising the amino acid sequence of SEQ ID NO: 41 and b. VL comprising the amino acid sequence of SEQ ID NO: 312.

In one aspect, the present disclosure provides an antibody or antigen-binding fragment thereof comprising at least one, two, three, four, five, or six CDRs selected from: a. CDR-H1 comprising the amino acid sequence of SEQ ID NO: 583, b. CDR-H2 comprising the amino acid sequence of SEQ ID NO: 1125, c. CDR-H3 comprising the amino acid sequence of SEQ ID NO: 1667, d. CDR-L1 comprising the amino acid sequence of SEQ ID NO: 854, e. CDR-L2 comprising the amino acid sequence of SEQ ID NO: 1396, and f. CDR-L3 comprising the amino acid sequence of SEQ ID NO: 1938.

In one aspect, the present disclosure provides an antibody or antigen-binding fragment thereof comprising: a. CDR-H1 comprising the amino acid sequence of SEQ ID NO: 583, b. CDR-H2 comprising the amino acid sequence of SEQ ID NO: 1125, c. CDR-H3 comprising the amino acid sequence of SEQ ID NO: 1667, d. CDR-L1 comprising the amino acid sequence of SEQ ID NO: 854, e. CDR-L2 comprising the amino acid sequence of SEQ ID NO: 1396, and f. CDR-L3 comprising the amino acid sequence of SEQ ID NO: 1938.

In one aspect, the present disclosure provides an antibody or antigen-binding fragment thereof comprising a CDR-H3 comprising the amino acid sequence of SEQ ID NO: 1667, and a CDR-L3 comprising the amino acid sequence of SEQ ID NO: 1938.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 583, b. CDR-H2 comprising the amino acid sequence of SEQ ID NO: 1125, c. CDR-H3 comprising the amino acid sequence of SEQ ID NO: 1667, and a VL comprising the amino acid sequence of SEQ ID NO: 312.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 854, b. CDR-L2 comprising the amino acid sequence of SEQ ID NO: 1396, c. CDR-L3 comprising the amino acid sequence of SEQ ID NO: 1938, and a VH comprising the amino acid sequence of SEQ ID NO: 41.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 41. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 41. In some embodiments, substitutions, insertions, or deletions occur in regions outside the CDRs (e.g., in the FRs). Optionally, the antibody or antigen-binding fragment thereof comprises the VH sequence SEQ ID NO: 41, including one or more post-translational modifications of that sequence. In a particular embodiment, the VH comprises one, two or three CDRs selected from: a. CDR-H1, comprising the amino acid sequence SEQ ID NO: 583, b. CDR-H2, comprising the amino acid sequence SEQ ID NO: 1125, and c. CDR-H3, comprising the amino acid sequence SEQ ID NO: 1667.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 312. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 312. In some embodiments, the substitutions, insertions, or deletions occur in regions outside the CDRs (e.g., in the FRs). Optionally, the antibody or antigen-binding fragment thereof comprises the VL sequence SEQ ID NO: 312, including one or more post-translational modifications of that sequence. In a particular embodiment, the VL comprises one, two or three CDRs selected from: a. CDR-L1, comprising the amino acid sequence SEQ ID NO: 854, b. CDR-L2, comprising the amino acid sequence SEQ ID NO: 1396, and c. CDR-L3, comprising the amino acid sequence SEQ ID NO: 1938.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 41, and the VL amino acid sequence of SEQ ID NO: 312, optionally including post-translational modifications of those sequences.

TBRE1029

In one aspect, the present disclosure provides an antibody or antigen-binding fragment thereof comprising at least one or both variable regions selected from: a. VH comprising the amino acid sequence of SEQ ID NO: 42 and b. VL comprising the amino acid sequence of SEQ ID NO: 313.

In one aspect, the present disclosure provides an antibody or antigen-binding fragment thereof comprising at least one, two, three, four, five, or six CDRs selected from: a. CDR-H1 comprising the amino acid sequence of SEQ ID NO: 584, b. CDR-H2 comprising the amino acid sequence of SEQ ID NO: 1126, c. CDR-H3 comprising the amino acid sequence of SEQ ID NO: 1668, d. CDR-L1 comprising the amino acid sequence of SEQ ID NO: 855, e. CDR-L2 comprising the amino acid sequence of SEQ ID NO: 1397, and f. CDR-L3 comprising the amino acid sequence of SEQ ID NO: 1939.

In one aspect, the present disclosure provides an antibody or antigen-binding fragment thereof comprising: a. CDR-H1 comprising the amino acid sequence of SEQ ID NO: 584, b. CDR-H2 comprising the amino acid sequence of SEQ ID NO: 1126, c. CDR-H3 comprising the amino acid sequence of SEQ ID NO: 1668, d. CDR-L1 comprising the amino acid sequence of SEQ ID NO: 855, e. CDR-L2 comprising the amino acid sequence of SEQ ID NO: 1397, and f. CDR-L3 comprising the amino acid sequence of SEQ ID NO: 1939. In one aspect, the present disclosure provides an antibody or antigen-binding fragment thereof comprising a CDR-H3 comprising the amino acid sequence of SEQ ID NO: 1668, and a CDR-L3 comprising the amino acid sequence of SEQ ID NO: 1939.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 584, b. CDR-H2 comprising the amino acid sequence of SEQ ID NO: 1126, c. CDR-H3 comprising the amino acid sequence of SEQ ID NO: 1668, and a VL comprising the amino acid sequence of SEQ ID NO: 313.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 855, b. CDR-L2 comprising the amino acid sequence of SEQ ID NO: 1397, c. CDR-L3 comprising the amino acid sequence of SEQ ID NO: 1939, and a VH comprising the amino acid sequence of SEQ ID NO: 42.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 42. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 42. In some embodiments, substitutions, insertions, or deletions occur in regions outside the CDRs (e.g., in the FRs). Optionally, the antibody or antigen-binding fragment thereof comprises the VH sequence SEQ ID NO: 42, including one or more post-translational modifications of that sequence. In a particular embodiment, the VH comprises one, two or three CDRs selected from: a. CDR-H1, comprising the amino acid sequence SEQ ID NO: 584, b. CDR-H2, comprising the amino acid sequence SEQ ID NO: 1126, and c. CDR-H3, comprising the amino acid sequence SEQ ID NO: 1668.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 313. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 313. In some embodiments, the substitutions, insertions, or deletions occur in regions outside the CDRs (e.g., in the FRs). Optionally, the antibody or antigen-binding fragment thereof comprises the VL sequence SEQ ID NO: 313, including one or more post-translational modifications of that sequence. In a particular embodiment, the VL comprises one, two or three CDRs selected from: a. CDR-L1, comprising the amino acid sequence SEQ ID NO: 855, b. CDR-L2, comprising the amino acid sequence SEQ ID NO: 1397, and c. CDR-L3, comprising the amino acid sequence SEQ ID NO: 1939.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 42, and the VL amino acid sequence of SEQ ID NO: 313, optionally including post-translational modifications of those sequences.
TBRE1030

In one aspect, the present disclosure provides an antibody or antigen-binding fragment thereof comprising at least one or both variable regions selected from: a. VH comprising the amino acid sequence of SEQ ID NO: 43 and b. VL comprising the amino acid sequence of SEQ ID NO: 314.

In one aspect, the present disclosure provides an antibody or antigen-binding fragment thereof comprising at least one, two, three, four, five, or six CDRs selected from: a. CDR-H1 comprising the amino acid sequence of SEQ ID NO: 585, b. CDR-H2 comprising the amino acid sequence of SEQ ID NO: 1127, c. CDR-H3 comprising the amino acid sequence of SEQ ID NO: 1669, d. CDR-L1 comprising the amino acid sequence of SEQ ID NO: 856, e. CDR-L2 comprising the amino acid sequence of SEQ ID NO: 1398, and f. CDR-L3 comprising the amino acid sequence of SEQ ID NO: 1940.

In one aspect, the present disclosure provides an antibody or antigen-binding fragment thereof comprising: a. CDR-H1 comprising the amino acid sequence of SEQ ID NO: 585, b. CDR-H2 comprising the amino acid sequence of SEQ ID NO: 1127, c. CDR-H3 comprising the amino acid sequence of SEQ ID NO: 1669, d. CDR-L1 comprising the amino acid sequence of SEQ ID NO: 856, e. CDR-L2 comprising the amino acid sequence of SEQ ID NO: 1398, and f. CDR-L3 comprising the amino acid sequence of SEQ ID NO: 1940. In one aspect, the present disclosure provides an antibody or antigen-binding fragment thereof comprising a CDR-H3 comprising the amino acid sequence of SEQ ID NO: 1669, and a CDR-L3 comprising the amino acid sequence of SEQ ID NO: 1940.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 585, b. CDR-H2 comprising the amino acid sequence of SEQ ID NO: 1127, c. CDR-H3 comprising the amino acid sequence of SEQ ID NO: 1669, and a VL comprising the amino acid sequence of SEQ ID NO: 314.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 856, b. CDR-L2 comprising the amino acid sequence of SEQ ID NO: 1398, c. CDR-L3 comprising the amino acid sequence of SEQ ID NO: 1940, and a VH comprising the amino acid sequence of SEQ ID NO: 43.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 43. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 43. In some embodiments, substitutions, insertions, or deletions occur in regions outside the CDRs (e.g., in the FRs). Optionally, the antibody or antigen-binding fragment thereof comprises the VH sequence SEQ ID NO: 43, including one or more post-translational modifications of that sequence. In a particular embodiment, the VH comprises one, two or three CDRs selected from: a. CDR-H1, comprising the amino acid sequence SEQ ID NO: 585, b. CDR-H2, comprising the amino acid sequence SEQ ID NO: 1127, and a CDR-H3, comprising the amino acid sequence SEQ ID NO: 1669.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 314. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 314. In some embodiments, the substitutions, insertions, or deletions occur in regions outside the CDRs (e.g., in the FRs). Optionally, the antibody or antigen-binding fragment thereof comprises the VL sequence SEQ ID NO: 314, including one or more post-translational modifications of that sequence. In a particular embodiment, the VL comprises one, two or three CDRs selected from: a. CDR-L1, comprising the amino acid sequence SEQ ID NO: 856, b. CDR-L2, comprising the amino acid sequence SEQ ID NO: 1398, and c. CDR-L3, comprising the amino acid sequence SEQ ID NO: 1940.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 43, and the VL amino acid sequence of SEQ ID NO: 314, optionally including post-translational modifications of those sequences.
TBRE1031

In one aspect, the present disclosure provides an antibody or antigen-binding fragment thereof comprising at least one or both variable regions selected from: a. VH comprising the amino acid sequence of SEQ ID NO: 44 and b. VL comprising the amino acid sequence of SEQ ID NO: 315.

In one aspect, the present disclosure provides an antibody or antigen-binding fragment thereof comprising at least one, two, three, four, five, or six CDRs selected from: a. CDR-H1 comprising the amino acid sequence of SEQ ID NO: 586, b. CDR-H2 comprising the amino acid sequence of SEQ ID NO: 1128, c. CDR-H3 comprising the amino acid sequence of SEQ ID NO: 1670, d. CDR-L1 comprising the amino acid sequence of SEQ ID NO: 857, e. CDR-L2 comprising the amino acid sequence of SEQ ID NO: 1399, and f. CDR-L3 comprising the amino acid sequence of SEQ ID NO: 1941.

In one aspect, the present disclosure provides an antibody or antigen-binding fragment thereof comprising: a. CDR-H1 comprising the amino acid sequence of SEQ ID NO: 586, b. CDR-H2 comprising the amino acid sequence of SEQ ID NO: 1128, c. CDR-H3 comprising the amino acid sequence of SEQ ID NO: 1670, d. CDR-L1 comprising the amino acid sequence of SEQ ID NO: 857, e. CDR-L2 comprising the amino acid sequence of SEQ ID NO: 1399, and f. CDR-L3 comprising the amino acid sequence of SEQ ID NO: 1941. In one aspect, the present disclosure provides an antibody or antigen-binding fragment thereof comprising a CDR-H3 comprising the amino acid sequence of SEQ ID NO: 1670, and a CDR-L3 comprising the amino acid sequence of SEQ ID NO: 1941.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 586, b. CDR-H2 comprising the amino acid sequence of SEQ ID NO: 1128, c. CDR-H3 comprising the amino acid sequence of SEQ ID NO: 1670, and a VL comprising the amino acid sequence of SEQ ID NO: 315.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 857, b. CDR-L2 comprising the amino acid sequence of SEQ ID NO: 1399, c. CDR-L3 comprising the amino acid sequence of SEQ ID NO: 1941, and a VH comprising the amino acid sequence of SEQ ID NO: 44.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 44. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 44. In some embodiments, substitutions, insertions, or deletions occur in regions outside the CDRs (e.g., in the FRs). Optionally, the antibody or antigen-binding fragment thereof comprises the VH sequence SEQ ID NO: 44, including one or more post-translational modifications of that sequence. In a particular embodiment, the VH comprises one, two or three CDRs selected from: a. CDR-H1, comprising the amino acid sequence SEQ ID NO: 586, b. CDR-H2, comprising the amino acid sequence SEQ ID NO: 1128, and c. CDR-H3, comprising the amino acid sequence SEQ ID NO: 1670.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 315. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 315. In some embodiments, the substitutions, insertions, or deletions occur in regions outside the CDRs (e.g., in the FRs). Optionally, the antibody or antigen-binding fragment thereof comprises the VL sequence SEQ ID NO: 315, including one or more post-translational modifications of that sequence. In a particular embodiment, the VL comprises one, two or three CDRs selected from: a. CDR-L1, comprising the amino acid sequence SEQ ID NO: 857, b. CDR-L2, comprising the amino acid sequence SEQ ID NO: 1399, and c. CDR-L3, comprising the amino acid sequence SEQ ID NO: 1941.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 44, and the VL amino acid sequence of SEQ ID NO: 315, optionally including post-translational modifications of those sequences.

TBRE1032

In one aspect, the present disclosure provides an antibody or antigen-binding fragment thereof comprising at least one or both variable regions selected from: a. VH comprising the amino acid sequence of SEQ ID NO: 45 and b. VL comprising the amino acid sequence of SEQ ID NO: 316.

In one aspect, the present disclosure provides an antibody or antigen-binding fragment thereof comprising at least one, two, three, four, five, or six CDRs selected from: a. CDR-H1 comprising the amino acid sequence of SEQ ID NO: 587, b. CDR-H2 comprising the amino acid sequence of SEQ ID NO: 1129, c. CDR-H3 comprising the amino acid sequence of SEQ ID NO: 1671, d. CDR-L1 comprising the amino acid sequence of SEQ ID NO: 858, e. CDR-L2 comprising the amino acid sequence of SEQ ID NO: 1400, and f. CDR-L3 comprising the amino acid sequence of SEQ ID NO: 1942.

In one aspect, the present disclosure provides an antibody or antigen-binding fragment thereof comprising: a. CDR-H1 comprising the amino acid sequence of SEQ ID NO: 587, b. CDR-H2 comprising the amino acid sequence of SEQ ID NO: 1129, c. CDR-H3 comprising the amino acid sequence of SEQ ID NO: 1671, d. CDR-L1 comprising the amino acid sequence of SEQ ID NO: 858, e. CDR-L2 comprising the amino acid sequence of SEQ ID NO: 1400, and f. CDR-L3 comprising the amino acid sequence of SEQ ID NO: 1942.

In one aspect, the present disclosure provides an antibody or antigen-binding fragment thereof comprising a CDR-H3 comprising the amino acid sequence of SEQ ID NO: 1671, and a CDR-L3 comprising the amino acid sequence of SEQ ID NO: 1942.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 587, b. CDR-H2 comprising the amino acid sequence of SEQ ID NO: 1129, c. CDR-H3 comprising the amino acid sequence of SEQ ID NO: 1671, and a VL comprising the amino acid sequence of SEQ ID NO: 316.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 858, b. CDR-L2 comprising the amino acid sequence of SEQ ID NO: 1400, c. CDR-L3 comprising the amino acid sequence of SEQ ID NO: 1942, and VH comprising the amino acid sequence of SEQ ID NO: 45.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 45. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 45. In some embodiments, substitutions, insertions, or deletions occur in regions outside the CDRs (e.g., in the FRs). Optionally, the antibody or antigen-binding fragment thereof comprises the VH sequence SEQ ID NO: 45, including one or more post-translational modifications of that sequence. In a particular embodiment, the VH comprises one, two or three CDRs selected from: a. CDR-H1, comprising the amino acid sequence SEQ ID NO: 587, b. CDR-H2, comprising the amino acid sequence SEQ ID NO: 1129, and c. CDR-H3, comprising the amino acid sequence SEQ ID NO: 1671.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 316. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 316. In some embodiments, the substitutions, insertions, or deletions occur in regions outside the CDRs (e.g., in the FRs). Optionally, the antibody or antigen-binding fragment thereof comprises the VL sequence SEQ ID NO: 316, including one or more post-translational modifications of that sequence. In a particular embodiment, the VL comprises one, two or three CDRs selected from: a. CDR-L1, comprising the amino acid sequence SEQ ID NO: 858, b. CDR-L2, comprising the amino acid sequence SEQ ID NO: 1400, and c. CDR-L3, comprising the amino acid sequence SEQ ID NO: 1942.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 45, and the VL amino acid sequence of SEQ ID NO: 316, optionally including post-translational modifications of those sequences.

TBRE1033

In one aspect, the present disclosure provides an antibody or antigen-binding fragment thereof comprising at least one or both variable regions selected from: a. VH comprising the amino acid sequence of SEQ ID NO: 46 and b. VL comprising the amino acid sequence of SEQ ID NO: 317.

In one aspect, the present disclosure provides an antibody or antigen-binding fragment thereof comprising at least one, two, three, four, five, or six CDRs selected from: a. CDR-H1 comprising the amino acid sequence of SEQ ID NO: 588, b. CDR-H2 comprising the amino acid sequence of SEQ ID NO: 1130, c. CDR-H3 comprising the amino acid sequence of SEQ ID NO: 1672, d. CDR-L1 comprising the amino acid sequence of SEQ ID NO: 859, e. CDR-L2 comprising the amino acid sequence of SEQ ID NO: 1401, and f. CDR-L3 comprising the amino acid sequence of SEQ ID NO: 1943.

In one aspect, the present disclosure provides an antibody or antigen-binding fragment thereof comprising: a. CDR-H1 comprising the amino acid sequence of SEQ ID NO: 588, b. CDR-H2 comprising the amino acid sequence of SEQ ID NO: 1130, c. CDR-H3 comprising the amino acid sequence of SEQ ID NO: 1672, d. CDR-L1 comprising the amino acid sequence of SEQ ID NO: 859, e. CDR-L2 comprising the amino acid sequence of SEQ ID NO: 1401, and f. CDR-L3 comprising the amino acid sequence of SEQ ID NO: 1943.

In one aspect, the present disclosure provides an antibody or antigen-binding fragment thereof comprising a CDR-H3 comprising the amino acid sequence of SEQ ID NO: 1672, and a CDR-L3 comprising the amino acid sequence of SEQ ID NO: 1943.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 588, b. CDR-H2 comprising the amino acid sequence of SEQ ID NO: 1130, c. CDR-H3 comprising the amino acid sequence of SEQ ID NO: 1672, and a VL comprising the amino acid sequence of SEQ ID NO: 317.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 859, b. CDR-L2 comprising the amino acid sequence of SEQ ID NO: 1401, c. CDR-L3 comprising the amino acid sequence of SEQ ID NO: 1943, and a VH comprising the amino acid sequence of SEQ ID NO: 46.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 46. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 46. In some embodiments, substitutions, insertions, or deletions occur in regions outside the CDRs (e.g., in the FRs). Optionally, the antibody or antigen-binding fragment thereof comprises the VH sequence SEQ ID NO: 46, including one or more post-translational modifications of that sequence. In a particular embodiment, the VH comprises one, two or three CDRs selected from: a. CDR-H1, comprising the amino acid sequence SEQ ID NO: 588, b. CDR-H2, comprising the amino acid sequence SEQ ID NO: 1130, and c. CDR-H3, comprising the amino acid sequence SEQ ID NO: 1672.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 317. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 317. In some embodiments, the substitutions, insertions, or deletions occur in regions outside the CDRs (e.g., in the FRs). Optionally, the antibody or antigen-binding fragment thereof comprises the VL sequence SEQ ID NO: 317, including one or more post-translational modifications of that sequence. In a particular embodiment, the VL comprises one, two or three CDRs selected from: a. CDR-L1, comprising the amino acid sequence SEQ ID NO: 859, b. CDR-L2, comprising the amino acid sequence SEQ ID NO: 1401, and c. CDR-L3, comprising the amino acid sequence SEQ ID NO: 1943.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 46, and the VL amino acid sequence of SEQ ID NO: 317, optionally including post-translational modifications of those sequences.

TBRE1034

In one aspect, the present disclosure provides an antibody or antigen-binding fragment thereof comprising at least one or both variable regions selected from: a. VH comprising the amino acid sequence of SEQ ID NO: 47 and b. VL comprising the amino acid sequence of SEQ ID NO: 318.

In one aspect, the present disclosure provides an antibody or antigen-binding fragment thereof comprising at least one, two, three, four, five, or six CDRs selected from: a. CDR-H1 comprising the amino acid sequence of SEQ ID NO: 589, b. CDR-H2 comprising the amino acid sequence of SEQ ID NO: 1131, c. CDR-H3 comprising the amino acid sequence of SEQ ID NO: 1673, d. CDR-L1 comprising the amino acid sequence of SEQ ID NO: 860, e. CDR-L2 comprising the amino acid sequence of SEQ ID NO: 1402, and f. CDR-L3 comprising the amino acid sequence of SEQ ID NO: 1944.

In one aspect, the present disclosure provides an antibody or antigen-binding fragment thereof comprising: a. CDR-H1 comprising the amino acid sequence of SEQ ID NO: 589, b. CDR-H2 comprising the amino acid sequence of SEQ ID NO: 1131, c. CDR-H3 comprising the amino acid sequence of SEQ ID NO: 1673, d. CDR-L1 comprising the amino acid sequence of SEQ ID NO: 860, e. CDR-L2 comprising the amino acid sequence of SEQ ID NO: 1402, and f. CDR-L3 comprising the amino acid sequence of SEQ ID NO: 1944. In one aspect, the present disclosure provides an antibody or antigen-binding fragment thereof comprising a CDR-H3 comprising the amino acid sequence of SEQ ID NO: 1673, and a CDR-L3 comprising the amino acid sequence of SEQ ID NO: 1944.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 589, b. CDR-H2 comprising the amino acid sequence of SEQ ID NO: 1131, c. CDR-H3 comprising the amino acid sequence of SEQ ID NO: 1673, and a VL comprising the amino acid sequence of SEQ ID NO: 318.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 860, b. CDR-L2 comprising the amino acid sequence of SEQ ID NO: 1402, c. CDR-L3 comprising the amino acid sequence of SEQ ID NO: 1944, and a VH comprising the amino acid sequence of SEQ ID NO: 47.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 47. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 47. In some embodiments, substitutions, insertions, or deletions occur in regions outside the CDRs (e.g., in the FRs). Optionally, the antibody or antigen-binding fragment thereof comprises the VH sequence SEQ ID NO: 47, including one or more post-translational modifications of that sequence. In a particular embodiment, the VH comprises one, two or three CDRs selected from: a. CDR-H1, comprising the amino acid sequence SEQ ID NO: 589, b. CDR-H2, comprising the amino acid sequence SEQ ID NO: 1131, and c. CDR-H3, comprising the amino acid sequence SEQ ID NO: 1673.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 318. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 318. In some embodiments, the substitutions, insertions, or deletions occur in regions outside the CDRs (e.g., in the FRs). Optionally, the antibody or antigen-binding fragment thereof comprises the VL sequence SEQ ID NO: 318, including one or more post-translational modifications of that sequence. In a particular embodiment, the VL comprises one, two or three CDRs selected from: a. CDR-L1, comprising the amino acid sequence SEQ ID NO: 860, b. CDR-L2, comprising the amino acid sequence SEQ ID NO: 1402, and c. CDR-L3, comprising the amino acid sequence SEQ ID NO: 1944.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 47, and the VL amino acid sequence of SEQ ID NO: 318, optionally including post-translational modifications of those sequences.

TBRE1035

In one aspect, the present disclosure provides an antibody or antigen-binding fragment thereof comprising at least one or both variable regions selected from: a. VH comprising the amino acid sequence of SEQ ID NO: 48 and b. VL comprising the amino acid sequence of SEQ ID NO: 319.

In one aspect, the present disclosure provides an antibody or antigen-binding fragment thereof comprising at least one, two, three, four, five, or six CDRs selected from: a. CDR-H1 comprising the amino acid sequence of SEQ ID NO: 590, b. CDR-H2 comprising the amino acid sequence of SEQ ID NO: 1132, c. CDR-H3 comprising the amino acid sequence of SEQ ID NO: 1674, d. CDR-L1 comprising the amino acid sequence of SEQ ID NO: 861, e. CDR-L2 comprising the amino acid sequence of SEQ ID NO: 1403, and f. CDR-L3 comprising the amino acid sequence of SEQ ID NO: 1945.

In one aspect, the present disclosure provides an antibody or antigen-binding fragment thereof comprising: a. CDR-H1 comprising the amino acid sequence of SEQ ID NO: 590, b. CDR-H2 comprising the amino acid sequence of SEQ ID NO: 1132, c. CDR-H3 comprising the amino acid sequence of SEQ ID NO: 1674, d. CDR-L1 comprising the amino acid sequence of SEQ ID NO: 861, e. CDR-L2 comprising the amino acid sequence of SEQ ID NO: 1403, and f. CDR-L3 comprising the amino acid sequence of SEQ ID NO: 1945. In one aspect, the present disclosure provides an antibody or antigen-binding fragment thereof comprising a CDR-H3 comprising the amino acid sequence of SEQ ID NO: 1674, and a CDR-L3 comprising the amino acid sequence of SEQ ID NO: 1945.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 590, b. CDR-H2 comprising the amino acid sequence of SEQ ID NO: 1132, c. CDR-H3 comprising the amino acid sequence of SEQ ID NO: 1674, and a VL comprising the amino acid sequence of SEQ ID NO: 319.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 861, b. CDR-L2 comprising the amino acid sequence of SEQ ID NO: 1403, c. CDR-L3 comprising the amino acid sequence of SEQ ID NO: 1945, and a VH comprising the amino acid sequence of SEQ ID NO: 48.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 48. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 48. In some embodiments, substitutions, insertions, or deletions occur in regions outside the CDRs (e.g., in the FRs). Optionally, the antibody or antigen-binding fragment thereof comprises the VH sequence SEQ ID NO: 48, including one or more post-translational modifications of that sequence. In a particular embodiment, the VH comprises one, two or three CDRs selected from: a. CDR-H1, comprising the amino acid sequence SEQ ID NO: 590, b. CDR-H2, comprising the amino acid sequence SEQ ID NO: 1132, and c. CDR-H3, comprising the amino acid sequence SEQ ID NO: 1674.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 319. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 319. In some embodiments, the substitutions, insertions, or deletions occur in regions outside the CDRs (e.g., in the FRs). Optionally, the antibody or antigen-binding fragment thereof comprises the VL sequence SEQ ID NO: 319, including one or more post-translational modifications of that sequence. In a particular embodiment, the VL comprises one, two or three CDRs selected from: a. CDR-L1, comprising the amino acid sequence SEQ ID NO: 861, b. CDR-L2, comprising the amino acid sequence SEQ ID NO: 1403, and c. CDR-L3, comprising the amino acid sequence SEQ ID NO: 1945.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 48, and the VL amino acid sequence of SEQ ID NO: 319, optionally including post-translational modifications of those sequences.
TBRE1036

In one aspect, the present disclosure provides an antibody or antigen-binding fragment thereof comprising at least one or both variable regions selected from: a. VH comprising the amino acid sequence of SEQ ID NO: 49 and b. VL comprising the amino acid sequence of SEQ ID NO: 320.

In one aspect, the present disclosure provides an antibody or antigen-binding fragment thereof comprising at least one, two, three, four, five, or six CDRs selected from: a. CDR-H1 comprising the amino acid sequence of SEQ ID NO: 591, b. CDR-H2 comprising the amino acid sequence of SEQ ID NO: 1133, c. CDR-H3 comprising the amino acid sequence of SEQ ID NO: 1675, d. CDR-L1 comprising the amino acid sequence of SEQ ID NO: 862, e. CDR-L2 comprising the amino acid sequence of SEQ ID NO: 1404, and f. CDR-L3 comprising the amino acid sequence of SEQ ID NO: 1946.

In one aspect, the present disclosure provides an antibody or antigen-binding fragment thereof comprising: a. CDR-H1 comprising the amino acid sequence of SEQ ID NO: 591, b. CDR-H2 comprising the amino acid sequence of SEQ ID NO: 1133, c. CDR-H3 comprising the amino acid sequence of SEQ ID NO: 1675, d. CDR-L1 comprising the amino acid sequence of SEQ ID NO: 862, e. CDR-L2 comprising the amino acid sequence of SEQ ID NO: 1404, and f. CDR-L3 comprising the amino acid sequence of SEQ ID NO: 1946. In one aspect, the present disclosure provides an antibody or antigen-binding fragment thereof comprising a CDR-H3 comprising the amino acid sequence of SEQ ID NO: 1675, and a CDR-L3 comprising the amino acid sequence of SEQ ID NO: 1946.

In one aspect, the present disclosure provides an antibody or antigen-binding fragment thereof comprising at least one, at least two, or all three VH CDR sequences selected from:

a. CDR-H1 comprising the amino acid sequence of SEQ ID NO: 591, b. CDR-H2 comprising the amino acid sequence of SEQ ID NO: 1133, c. CDR-H3 comprising the amino acid sequence of SEQ ID NO: 1675, and a VL comprising the amino acid sequence of SEQ ID NO: 320.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 862, b. CDR-L2 comprising the amino acid sequence of SEQ ID NO: 1404, c. CDR-L3 comprising the amino acid sequence of SEQ ID NO: 1946, and a VH comprising the amino acid sequence of SEQ ID NO: 49.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 49. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 49. In some embodiments, substitutions, insertions, or deletions occur in regions outside the CDRs (e.g., in the FRs). Optionally, the antibody or antigen-binding fragment thereof comprises the VH sequence SEQ ID NO: 49, including one or more post-translational modifications of that sequence. In a particular embodiment, the VH comprises one, two or three CDRs selected from: a. CDR-H1, comprising the amino acid sequence SEQ ID NO: 591, b. CDR-H2, comprising the amino acid sequence SEQ ID NO: 1133, and c. CDR-H3, comprising the amino acid sequence SEQ ID NO: 1675.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 320. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 320. In some embodiments, the substitutions, insertions, or deletions occur in regions outside the CDRs (e.g., in the FRs). Optionally, the antibody or antigen-binding fragment thereof comprises the VL sequence SEQ ID NO: 320, including one or more post-translational modifications of that sequence. In a particular embodiment, the VL comprises one, two or three CDRs selected from: a. CDR-L1, comprising the amino acid sequence SEQ ID NO: 862, b. CDR-L2, comprising the amino acid sequence SEQ ID NO: 1404, and c. CDR-L3, comprising the amino acid sequence SEQ ID NO: 1946.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 49, and the VL amino acid sequence of SEQ ID NO: 320, optionally including post-translational modifications of those sequences.

TBRE1037

In one aspect, the present disclosure provides an antibody or antigen-binding fragment thereof comprising at least one or both variable regions selected from: a. VH comprising the amino acid sequence of SEQ ID NO: 50 and b. VL comprising the amino acid sequence of SEQ ID NO: 321.

In one aspect, the present disclosure provides an antibody or antigen-binding fragment thereof comprising at least one, two, three, four, five, or six CDRs selected from: a. CDR-H1 comprising the amino acid sequence of SEQ ID NO: 592, b. CDR-H2 comprising the amino acid sequence of SEQ ID NO: 1134, c. CDR-H3 comprising the amino acid sequence of SEQ ID NO: 1676, d. CDR-L1 comprising the amino acid sequence of SEQ ID NO: 863, e. CDR-L2 comprising the amino acid sequence of SEQ ID NO: 1405, and f. CDR-L3 comprising the amino acid sequence of SEQ ID NO: 1947.

In one aspect, the present disclosure provides an antibody or antigen-binding fragment thereof comprising: a. CDR-H1 comprising the amino acid sequence of SEQ ID NO: 592, b. CDR-H2 comprising the amino acid sequence of SEQ ID NO: 1134, c. CDR-H3 comprising the amino acid sequence of SEQ ID NO: 1676, d. CDR-L1 comprising the amino acid sequence of SEQ ID NO: 863, e. CDR-L2 comprising the amino acid sequence of SEQ ID NO: 1405, and f. CDR-L3 comprising the amino acid sequence of SEQ ID NO: 1947. In one aspect, the present disclosure provides an antibody or antigen-binding fragment thereof comprising a CDR-H3 comprising the amino acid sequence of SEQ ID NO: 1676, and a CDR-L3 comprising the amino acid sequence of SEQ ID NO: 1947.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 592, b. CDR-H2 comprising the amino acid sequence of SEQ ID NO: 1134, c. CDR-H3 comprising the amino acid sequence of SEQ ID NO: 1676, and a VL comprising the amino acid sequence of SEQ ID NO: 321.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 863, b. CDR-L2 comprising the amino acid sequence of SEQ ID NO: 1405, c. CDR-L3 comprising the amino acid sequence of SEQ ID NO: 1947, and a VH comprising the amino acid sequence of SEQ ID NO: 50.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 50. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 50. In some embodiments, substitutions, insertions, or deletions occur in regions outside the CDRs (e.g., in the FRs). Optionally, the antibody or antigen-binding fragment thereof comprises the VH sequence SEQ ID NO: 50, including one or more post-translational modifications of that sequence. In a particular embodiment, the VH comprises one, two or three CDRs selected from: a. CDR-H1, comprising the amino acid sequence SEQ ID NO: 592, b. CDR-H2, comprising the amino acid sequence SEQ ID NO: 1134, and c. CDR-H3, comprising the amino acid sequence SEQ ID NO: 1676.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 321. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 321. In some embodiments, the substitutions, insertions, or deletions occur in regions outside the CDRs (e.g., in the FRs). Optionally, the antibody or antigen-binding fragment thereof comprises the VL sequence SEQ ID NO: 321, including one or more post-translational modifications of that sequence. In a particular embodiment, the VL comprises one, two or three CDRs selected from: a. CDR-L1, comprising the amino acid sequence SEQ ID NO: 863, b. CDR-L2, comprising the amino acid sequence SEQ ID NO: 1405, and c. CDR-L3, comprising the amino acid sequence SEQ ID NO: 1947.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 50, and the VL amino acid sequence of SEQ ID NO: 321, optionally including post-translational modifications of those sequences.
TBRE1038

In one aspect, the present disclosure provides an antibody or antigen-binding fragment thereof comprising at least one or both variable regions selected from: a. VH comprising the amino acid sequence of SEQ ID NO: 51 and b. VL comprising the amino acid sequence of SEQ ID NO: 322.

In one aspect, the present disclosure provides an antibody or antigen-binding fragment thereof comprising at least one, two, three, four, five, or six CDRs selected from: a. CDR-H1 comprising the amino acid sequence of SEQ ID NO: 593, b. CDR-H2 comprising the amino acid sequence of SEQ ID NO: 1135, c. CDR-H3 comprising the amino acid sequence of SEQ ID NO: 1677, d. CDR-L1 comprising the amino acid sequence of SEQ ID NO: 864, e. CDR-L2 comprising the amino acid sequence of SEQ ID NO: 1406, and f. CDR-L3 comprising the amino acid sequence of SEQ ID NO: 1948.

In one aspect, the present disclosure provides an antibody or antigen-binding fragment thereof comprising: a. CDR-H1 comprising the amino acid sequence of SEQ ID NO: 593, b. CDR-H2 comprising the amino acid sequence of SEQ ID NO: 1135, c. CDR-H3 comprising the amino acid sequence of SEQ ID NO: 1677, d. CDR-L1 comprising the amino acid sequence of SEQ ID NO: 864, e. CDR-L2 comprising the amino acid sequence of SEQ ID NO: 1406, and f. CDR-L3 comprising the amino acid sequence of SEQ ID NO: 1948.

In one aspect, the present disclosure provides an antibody or antigen-binding fragment thereof comprising a CDR-H3 comprising the amino acid sequence of SEQ ID NO: 1677, and a CDR-L3 comprising the amino acid sequence of SEQ ID NO: 1948.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 593, b. CDR-H2 comprising the amino acid sequence of SEQ ID NO: 1135, c. CDR-H3 comprising the amino acid sequence of SEQ ID NO: 1677, and a VL comprising the amino acid sequence of SEQ ID NO: 322.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 864, b. CDR-L2 comprising the amino acid sequence of SEQ ID NO: 1406, c. CDR-L3 comprising the amino acid sequence of SEQ ID NO: 1948, and a VH comprising the amino acid sequence of SEQ ID NO: 51.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 51. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 51. In some embodiments, substitutions, insertions, or deletions occur in regions outside the CDRs (e.g., in the FRs). Optionally, the antibody or antigen-binding fragment thereof comprises the VH sequence SEQ ID NO: 51, including one or more post-translational modifications of that sequence. In a particular embodiment, the VH comprises one, two or three CDRs selected from: a. CDR-H1, comprising the amino acid sequence SEQ ID NO: 593, b. CDR-H2, comprising the amino acid sequence SEQ ID NO: 1135, and c. CDR-H3, comprising the amino acid sequence SEQ ID NO: 1677.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 322. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 322. In some embodiments, the substitutions, insertions, or deletions occur in regions outside the CDRs (e.g., in the FRs). Optionally, the antibody or antigen-binding fragment thereof comprises the VL sequence SEQ ID NO: 322, including one or more post-translational modifications of that sequence. In a particular embodiment, the VL comprises one, two or three CDRs selected from: a. CDR-L1, comprising the amino acid sequence SEQ ID NO: 864, b. CDR-L2, comprising the amino acid sequence SEQ ID NO: 1406, and c. CDR-L3, comprising the amino acid sequence SEQ ID NO: 1948.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 51, and the VL amino acid sequence of SEQ ID NO: 322, optionally including post-translational modifications of those sequences.
TBRE1039

In one aspect, the present disclosure provides an antibody or antigen-binding fragment thereof comprising at least one or both variable regions selected from: a. VH comprising the amino acid sequence of SEQ ID NO: 52 and b. VL comprising the amino acid sequence of SEQ ID NO: 323.

In one aspect, the present disclosure provides an antibody or antigen-binding fragment thereof comprising at least one, two, three, four, five, or six CDRs selected from: a. CDR-H1 comprising the amino acid sequence of SEQ ID NO: 594, b. CDR-H2 comprising the amino acid sequence of SEQ ID NO: 1136, c. CDR-H3 comprising the amino acid sequence of SEQ ID NO: 1678, d. CDR-L1 comprising the amino acid sequence of SEQ ID NO: 865, e. CDR-L2 comprising the amino acid sequence of SEQ ID NO: 1407, and f. CDR-L3 comprising the amino acid sequence of SEQ ID NO: 1949. In one aspect, the present disclosure provides an antibody or antigen-binding fragment thereof comprising: a. CDR-H1 comprising the amino acid sequence of SEQ ID NO: 594, b. CDR-H2 comprising the amino acid sequence of SEQ ID NO: 1136, c. CDR-H3 comprising the amino acid sequence of SEQ ID NO: 1678, d. CDR-L1 comprising the amino acid sequence of SEQ ID NO: 865, e. CDR-L2 comprising the amino acid sequence of SEQ ID NO: 1407, and f. CDR-L3 comprising the amino acid sequence of SEQ ID NO: 1949. In one aspect, the present disclosure provides an antibody or antigen-binding fragment thereof comprising a CDR-H3 comprising the amino acid sequence of SEQ ID NO: 1678 and a f. CDR-L3 comprising the amino acid sequence of SEQ ID NO: 1949.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 594, b. CDR-H2 comprising the amino acid sequence of SEQ ID NO: 1136, c. CDR-H3 comprising the amino acid sequence of SEQ ID NO: 1678, and a VL comprising the amino acid sequence of SEQ ID NO: 323.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 865, b. CDR-L2 comprising the amino acid sequence of SEQ ID NO: 1407, c. CDR-L3 comprising the amino acid sequence of SEQ ID NO: 1949, and a VH comprising the amino acid sequence of SEQ ID NO: 52.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 52. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 52. In some embodiments, substitutions, insertions, or deletions occur in regions outside the CDRs (e.g., in the FRs). Optionally, the antibody or antigen-binding fragment thereof comprises the VH sequence SEQ ID NO: 52, including one or more post-translational modifications of that sequence. In a particular embodiment, the VH comprises one, two or three CDRs selected from: a. CDR-H1, comprising the amino acid sequence SEQ ID NO: 594, b. CDR-H2, comprising the amino acid sequence SEQ ID NO: 1136, and c. CDR-H3, comprising the amino acid sequence SEQ ID NO: 1678.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 323. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 323. In some embodiments, the substitutions, insertions, or deletions occur in regions outside the CDRs (e.g., in the FRs). Optionally, the antibody or antigen-binding fragment thereof comprises the VL sequence SEQ ID NO: 323, including one or more post-translational modifications of that sequence. In a particular embodiment, the VL comprises one, two or three CDRs selected from: a. CDR-L1, comprising the amino acid sequence SEQ ID NO: 865, b. CDR-L2, comprising the amino acid sequence SEQ ID NO: 1407, and c. CDR-L3, comprising the amino acid sequence SEQ ID NO: 1949.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 52, and the VL amino acid sequence of SEQ ID NO: 323, optionally including post-translational modifications of those sequences.
TBRE1040

In one aspect, the present disclosure provides an antibody or antigen-binding fragment thereof comprising at least one or both variable regions selected from: a. VH comprising the amino acid sequence of SEQ ID NO: 53 and b. VL comprising the amino acid sequence of SEQ ID NO: 324.

In one aspect, the present disclosure provides an antibody or antigen-binding fragment thereof comprising at least one, two, three, four, five, or six CDRs selected from: a. CDR-H1 comprising the amino acid sequence of SEQ ID NO: 595, b. CDR-H2 comprising the amino acid sequence of SEQ ID NO: 1137, c. CDR-H3 comprising the amino acid sequence of SEQ ID NO: 1679, d. CDR-L1 comprising the amino acid sequence of SEQ ID NO: 866, e. CDR-L2 comprising the amino acid sequence of SEQ ID NO: 1408, and f. CDR-L3 comprising the amino acid sequence of SEQ ID NO: 1950.

In one aspect, the present disclosure provides an antibody or antigen-binding fragment thereof comprising: a. CDR-H1 comprising the amino acid sequence of SEQ ID NO: 595, b. CDR-H2 comprising the amino acid sequence of SEQ ID NO: 1137, c. CDR-H3 comprising the amino acid sequence of SEQ ID NO: 1679, d. CDR-L1 comprising the amino acid sequence of SEQ ID NO: 866, e. CDR-L2 comprising the amino acid sequence of SEQ ID NO: 1408, and f. CDR-L3 comprising the amino acid sequence of SEQ ID NO: 1950. In one aspect, the present disclosure provides an antibody or antigen-binding fragment thereof comprising a CDR-H3 comprising the amino acid sequence of SEQ ID NO: 1679, and a CDR-L3 comprising the amino acid sequence of SEQ ID NO: 1950.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 595, b. CDR-H2 comprising the amino acid sequence of SEQ ID NO: 1137, c. CDR-H3 comprising the amino acid sequence of SEQ ID NO: 1679, and a VL comprising the amino acid sequence of SEQ ID NO: 324.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 866, b. CDR-L2 comprising the amino acid sequence of SEQ ID NO: 1408, c. CDR-L3 comprising the amino acid sequence of SEQ ID NO: 1950, and a VH comprising the amino acid sequence of SEQ ID NO: 53.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 53. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 53. In some embodiments, substitutions, insertions, or deletions occur in regions outside the CDRs (e.g., in the FRs). Optionally, the antibody or antigen-binding fragment thereof comprises the VH sequence SEQ ID NO: 53, including one or more post-translational modifications of that sequence. In a particular embodiment, the VH comprises one, two or three CDRs selected from: a. CDR-H1, comprising the amino acid sequence SEQ ID NO: 595, b. CDR-H2, comprising the amino acid sequence SEQ ID NO: 1137, and a CDR-H3, comprising the amino acid sequence SEQ ID NO: 1679.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 324. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 324. In some embodiments, the substitutions, insertions, or deletions occur in regions outside the CDRs (e.g., in the FRs). Optionally, the antibody or antigen-binding fragment thereof comprises the VL sequence SEQ ID NO: 324, including one or more post-translational modifications of that sequence. In a particular embodiment, the VL comprises one, two or three CDRs selected from: a. CDR-L1, comprising the amino acid sequence SEQ ID NO: 866, b. CDR-L2, comprising the amino acid sequence SEQ ID NO: 1408, and c. CDR-L3, comprising the amino acid sequence SEQ ID NO: 1950.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 53, and the VL amino acid sequence of SEQ ID NO: 324, optionally including post-translational modifications of those sequences.

TBRE1041

In one aspect, the present disclosure provides an antibody or antigen-binding fragment thereof comprising at least one or both variable regions selected from: a. VH comprising the amino acid sequence of SEQ ID NO: 54 and b. VL comprising the amino acid sequence of SEQ ID NO: 325.

In one aspect, the present disclosure provides an antibody or antigen-binding fragment thereof comprising at least one, two, three, four, five, or six CDRs selected from: a. CDR-H1 comprising the amino acid sequence of SEQ ID NO: 596, b. CDR-H2 comprising the amino acid sequence of SEQ ID NO: 1138, c. CDR-H3 comprising the amino acid sequence of SEQ ID NO: 1680, d. CDR-L1 comprising the amino acid sequence of SEQ ID NO: 867, e. CDR-L2 comprising the amino acid sequence of SEQ ID NO: 1409, and f. CDR-L3 comprising the amino acid sequence of SEQ ID NO: 1951.

In one aspect, the present disclosure provides an antibody or antigen-binding fragment thereof comprising: a. CDR-H1 comprising the amino acid sequence of SEQ ID NO: 596, b. CDR-H2 comprising the amino acid sequence of SEQ ID NO: 1138, c. CDR-H3 comprising the amino acid sequence of SEQ ID NO: 1680, d. CDR-L1 comprising the amino acid sequence of SEQ ID NO: 867, e. CDR-L2 comprising the amino acid sequence of SEQ ID NO: 1409, and f. CDR-L3 comprising the amino acid sequence of SEQ ID NO: 1951. In one aspect, the present disclosure provides an antibody or antigen-binding fragment thereof comprising a CDR-H3 comprising the amino acid sequence of SEQ ID NO: 1680, and a CDR-L3 comprising the amino acid sequence of SEQ ID NO: 1951.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 596, b. CDR-H2 comprising the amino acid sequence of SEQ ID NO: 1138, c. CDR-H3 comprising the amino acid sequence of SEQ ID NO: 1680, and a VL comprising the amino acid sequence of SEQ ID NO: 325.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 867, b. CDR-L2 comprising the amino acid sequence of SEQ ID NO: 1409, c. CDR-L3 comprising the amino acid sequence of SEQ ID NO: 1951, and a VH comprising the amino acid sequence of SEQ ID NO: 54.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 54. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 54. In some embodiments, substitutions, insertions, or deletions occur in regions outside the CDRs (e.g., in the FRs). Optionally, the antibody or antigen-binding fragment thereof comprises the VH sequence SEQ ID NO: 54, including one or more post-translational modifications of that sequence. In a particular embodiment, the VH comprises one, two or three CDRs selected from: a CDR-H1, comprising the amino acid sequence SEQ ID NO: 596, b. CDR-H2, comprising the amino acid sequence SEQ ID NO: 1138, and c. CDR-H3, comprising the amino acid sequence SEQ ID NO: 1680.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 325. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 325. In some embodiments, the substitutions, insertions, or deletions occur in regions outside the CDRs (e.g., in the FRs). Optionally, the antibody or antigen-binding fragment thereof comprises the VL sequence SEQ ID NO: 325, including one or more post-translational modifications of that sequence. In a particular embodiment, the VL comprises one, two or three CDRs selected from: a. CDR-L1, comprising the amino acid sequence SEQ ID NO: 867, b. CDR-L2, comprising the amino acid sequence SEQ ID NO: 1409, and c. CDR-L3, comprising the amino acid sequence SEQ ID NO: 1951.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 54, and the VL amino acid sequence of SEQ ID NO: 325, optionally including post-translational modifications of those sequences.
TBRE1042

In one aspect, the present disclosure provides an antibody or antigen-binding fragment thereof comprising at least one or both variable regions selected from: a. VH comprising the amino acid sequence of SEQ ID NO: 55 and b. VL comprising the amino acid sequence of SEQ ID NO: 326.

In one aspect, the present disclosure provides an antibody or antigen-binding fragment thereof comprising at least one, two, three, four, five, or six CDRs selected from: a. CDR-H1 comprising the amino acid sequence of SEQ ID NO: 597, b. CDR-H2 comprising the amino acid sequence of SEQ ID NO: 1139, c. CDR-H3 comprising the amino acid sequence of SEQ ID NO: 1681, d. CDR-L1 comprising the amino acid sequence of SEQ ID NO: 868, e. CDR-L2 comprising the amino acid sequence of SEQ ID NO: 1410, and f. CDR-L3 comprising the amino acid sequence of SEQ ID NO: 1952.

In one aspect, the present disclosure provides an antibody or antigen-binding fragment thereof comprising: a. CDR-H1 comprising the amino acid sequence of SEQ ID NO: 597, b. CDR-H2 comprising the amino acid sequence of SEQ ID NO: 1139, c. CDR-H3 comprising the amino acid sequence of SEQ ID NO: 1681, d. CDR-L1 comprising the amino acid sequence of SEQ ID NO: 868, e. CDR-L2 comprising the amino acid sequence of SEQ ID NO: 1410, and f. CDR-L3 comprising the amino acid sequence of SEQ ID NO: 1952.

In one aspect, the present disclosure provides an antibody or antigen-binding fragment thereof comprising a CDR-H3 comprising the amino acid sequence of SEQ ID NO: 1681, and a CDR-L3 comprising the amino acid sequence of SEQ ID NO: 1952.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 597, b. CDR-H2 comprising the amino acid sequence of SEQ ID NO: 1139, c. CDR-H3 comprising the amino acid sequence of SEQ ID NO: 1681, and a VL comprising the amino acid sequence of SEQ ID NO: 326.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 868, b. CDR-L2 comprising the amino acid sequence of SEQ ID NO: 1410, c. CDR-L3 comprising the amino acid sequence of SEQ ID NO: 1952, and a VH comprising the amino acid sequence of SEQ ID NO: 55.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 55. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 55. In some embodiments, substitutions, insertions, or deletions occur in regions outside the CDRs (e.g., in the FRs). Optionally, the antibody or antigen-binding fragment thereof comprises the VH sequence SEQ ID NO: 55, including one or more post-translational modifications of that sequence. In a particular embodiment, the VH comprises one, two or three CDRs selected from: a. CDR-H1, comprising the amino acid sequence SEQ ID NO: 597, b. CDR-H2, comprising the amino acid sequence SEQ ID NO: 1139, and c. CDR-H3, comprising the amino acid sequence SEQ ID NO: 1681.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 326. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 326. In some embodiments, the substitutions, insertions, or deletions occur in regions outside the CDRs (e.g., in the FRs). Optionally, the antibody or antigen-binding fragment thereof comprises the VL sequence SEQ ID NO: 326, including one or more post-translational modifications of that sequence. In a particular embodiment, the VL comprises one, two or three CDRs selected from: a. CDR-L1, comprising the amino acid sequence SEQ ID NO: 868, b. CDR-L2, comprising the amino acid sequence SEQ ID NO: 1410, and c. CDR-L3, comprising the amino acid sequence SEQ ID NO: 1952.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 55, and the VL amino acid sequence of SEQ ID NO: 326, optionally including post-translational modifications of those sequences.

TBRE1043

In one aspect, the present disclosure provides an antibody or antigen-binding fragment thereof comprising at least one or both variable regions selected from: a. VH comprising the amino acid sequence of SEQ ID NO: 56 and b. VL comprising the amino acid sequence of SEQ ID NO: 327.

In one aspect, the present disclosure provides an antibody or antigen-binding fragment thereof comprising at least one, two, three, four, five, or six CDRs selected from: a. CDR-H1 comprising the amino acid sequence of SEQ ID NO: 598, b. CDR-H2 comprising the amino acid sequence of SEQ ID NO: 1140, c. CDR-H3 comprising the amino acid sequence of SEQ ID NO: 1682, d. CDR-L1 comprising the amino acid sequence of SEQ ID NO: 869, e. CDR-L2 comprising the amino acid sequence of SEQ ID NO: 1411, and f. CDR-L3 comprising the amino acid sequence of SEQ ID NO: 1953.

In one aspect, the present disclosure provides an antibody or antigen-binding fragment thereof comprising: a. CDR-H1 comprising the amino acid sequence of SEQ ID NO: 598, b. CDR-H2 comprising the amino acid sequence of SEQ ID NO: 1140, c. CDR-H3 comprising the amino acid sequence of SEQ ID NO: 1682, d. CDR-L1 comprising the amino acid sequence of SEQ ID NO: 869, e. CDR-L2 comprising the amino acid sequence of SEQ ID NO: 1411, and f. CDR-L3 comprising the amino acid sequence of SEQ ID NO: 1953.

In one aspect, the present disclosure provides an antibody or antigen-binding fragment thereof comprising a CDR-H3 comprising the amino acid sequence of SEQ ID NO: 1682 and a CDR-L3 comprising the amino acid sequence of SEQ ID NO: 1953.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 598, b. CDR-H2 comprising the amino acid sequence of SEQ ID NO: 1140, c. CDR-H3 comprising the amino acid sequence of SEQ ID NO: 1682, and a VL comprising the amino acid sequence of SEQ ID NO: 327.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 869, b. CDR-L2 comprising the amino acid sequence of SEQ ID NO: 1411, c. CDR-L3 comprising the amino acid sequence of SEQ ID NO: 1953, and a VH comprising the amino acid sequence of SEQ ID NO: 56.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 56. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 56. In some embodiments, substitutions, insertions, or deletions occur in regions outside the CDRs (e.g., in the FRs). Optionally, the antibody or antigen-binding fragment thereof comprises the VH sequence SEQ ID NO: 56, including one or more post-translational modifications of that sequence. In a particular embodiment, the VH comprises one, two or three CDRs selected from: a. CDR-H1, comprising the amino acid sequence SEQ ID NO: 598, b. CDR-H2, comprising the amino acid sequence SEQ ID NO: 1140, and c. CDR-H3, comprising the amino acid sequence SEQ ID NO: 1682.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 327. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 327. In some embodiments, the substitutions, insertions, or deletions occur in regions outside the CDRs (e.g., in the FRs). Optionally, the antibody or antigen-binding fragment thereof comprises the VL sequence SEQ ID NO: 327, including one or more post-translational modifications of that sequence. In a particular embodiment, the VL comprises one, two or three CDRs selected from: a. CDR-L1, comprising the amino acid sequence SEQ ID NO: 869, b. CDR-L2, comprising the amino acid sequence SEQ ID NO: 1411, and c. CDR-L3, comprising the amino acid sequence SEQ ID NO: 1953.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 56, and the VL amino acid sequence of SEQ ID NO: 327, optionally including post-translational modifications of those sequences.
TBRE1044

In one aspect, the present disclosure provides an antibody or antigen-binding fragment thereof comprising at least one or both variable regions selected from: a. VH comprising the amino acid sequence of SEQ ID NO: 57 and b. VL comprising the amino acid sequence of SEQ ID NO: 328.

In one aspect, the present disclosure provides an antibody or antigen-binding fragment thereof comprising at least one, two, three, four, five, or six CDRs selected from: a. CDR-H1 comprising the amino acid sequence of SEQ ID NO: 599, b. CDR-H2 comprising the amino acid sequence of SEQ ID NO: 1141, c. CDR-H3 comprising the amino acid sequence of SEQ ID NO: 1683, c. CDR-L1 comprising the amino acid sequence of SEQ ID NO: 870, e. CDR-L2 comprising the amino acid sequence of SEQ ID NO: 1412, and f. CDR-L3 comprising the amino acid sequence of SEQ ID NO: 1954. In one aspect, the present disclosure provides an antibody or antigen-binding fragment thereof comprising: a. CDR-H1 comprising the amino acid sequence of SEQ ID NO: 599, b. CDR-H2 comprising the amino acid sequence of SEQ ID NO: 1141, c. CDR-H3 comprising the amino acid sequence of SEQ ID NO: 1683, c. CDR-L1 comprising the amino acid sequence of SEQ ID NO: 870, e. CDR-L2 comprising the amino acid sequence of SEQ ID NO: 1412, and f. CDR-L3 comprising the amino acid sequence of SEQ ID NO: 1954. In one aspect, the present disclosure provides an antibody or antigen-binding fragment thereof comprising a CDR-H3 comprising the amino acid sequence of SEQ ID NO: 1683, and a CDR-L3 comprising the amino acid sequence of SEQ ID NO: 1954.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 599, b. CDR-H2 comprising the amino acid sequence of SEQ ID NO: 1141, c. CDR-H3 comprising the amino acid sequence of SEQ ID NO: 1683, and a VL comprising the amino acid sequence of SEQ ID NO: 328.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 870, b. CDR-L2 comprising the amino acid sequence of SEQ ID NO: 1412, c. CDR-L3 comprising the amino acid sequence of SEQ ID NO: 1954, and a VH comprising the amino acid sequence of SEQ ID NO: 57.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 57. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 57. In some embodiments, substitutions, insertions, or deletions occur in regions outside the CDRs (e.g., in the FRs). Optionally, the antibody or antigen-binding fragment thereof comprises the VH sequence SEQ ID NO: 57, including one or more post-translational modifications of that sequence. In a particular embodiment, the VH comprises one, two or three CDRs selected from: a. CDR-H1, comprising the amino acid sequence SEQ ID NO: 599, b. CDR-H2, comprising the amino acid sequence SEQ ID NO: 1141, and c. CDR-H3, comprising the amino acid sequence SEQ ID NO: 1683.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 328. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 328. In some embodiments, the substitutions, insertions, or deletions occur in regions outside the CDRs (e.g., in the FRs). Optionally, the antibody or antigen-binding fragment thereof comprises the VL sequence SEQ ID NO: 328, including one or more post-translational modifications of that sequence. In a particular embodiment, the VL comprises one, two or three CDRs selected from: a. CDR-L1, comprising the amino acid sequence SEQ ID NO: 870, b. CDR-L2, comprising the amino acid sequence SEQ ID NO: 1412, and c. CDR-L3, comprising the amino acid sequence SEQ ID NO: 1954.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 57, and the VL amino acid sequence of SEQ ID NO: 328, optionally including post-translational modifications of those sequences.
TBRE1045

In one aspect, the present disclosure provides an antibody or antigen-binding fragment thereof comprising at least one or both variable regions selected from: a. VH comprising the amino acid sequence of SEQ ID NO: 58 and b. VL comprising the amino acid sequence of SEQ ID NO: 329.

In one aspect, the present disclosure provides an antibody or antigen-binding fragment thereof comprising at least one, two, three, four, five, or six CDRs selected from: a. CDR-H1 comprising the amino acid sequence of SEQ ID NO: 600, b. CDR-H2 comprising the amino acid sequence of SEQ ID NO: 1142, c. CDR-H3 comprising the amino acid sequence of SEQ ID NO: 1684, d. CDR-L1 comprising the amino acid sequence of SEQ ID NO: 871, e. CDR-L2 comprising the amino acid sequence of SEQ ID NO: 1413, and f. CDR-L3 comprising the amino acid sequence of SEQ ID NO: 1955.

In one aspect, the present disclosure provides an antibody or antigen-binding fragment thereof comprising: a. CDR-H1 comprising the amino acid sequence of SEQ ID NO: 600, b. CDR-H2 comprising the amino acid sequence of SEQ ID NO: 1142, c. CDR-H3 comprising the amino acid sequence of SEQ ID NO: 1684, d. CDR-L1 comprising the amino acid sequence of SEQ ID NO: 871, e. CDR-L2 comprising the amino acid sequence of SEQ ID NO: 1413, and f. CDR-L3 comprising the amino acid sequence of SEQ ID NO: 1955. In one aspect, the present disclosure provides an antibody or antigen-binding fragment thereof comprising a CDR-H3 comprising the amino acid sequence of SEQ ID NO: 1684, and a CDR-L3 comprising the amino acid sequence of SEQ ID NO: 1955.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 600, b. CDR-H2 comprising the amino acid sequence of SEQ ID NO: 1142, c. CDR-H3 comprising the amino acid sequence of SEQ ID NO: 1684, and a VL comprising the amino acid sequence of SEQ ID NO: 329.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 871, b. CDR-L2 comprising the amino acid sequence of SEQ ID NO: 1413, c. CDR-L3 comprising the amino acid sequence of SEQ ID NO: 1955, and a VH comprising the amino acid sequence of SEQ ID NO: 58.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 58. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 58. In some embodiments, substitutions, insertions, or deletions occur in regions outside the CDRs (e.g., in the FRs). Optionally, the antibody or antigen-binding fragment thereof comprises the VH sequence SEQ ID NO: 58, including one or more post-translational modifications of that sequence. In a particular embodiment, the VH comprises one, two or three CDRs selected from: a. CDR-H1, comprising the amino acid sequence SEQ ID NO: 600, b. CDR-H2, comprising the amino acid sequence SEQ ID NO: 1142, and c. CDR-H3, comprising the amino acid sequence SEQ ID NO: 1684.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 329. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 329. In some embodiments, the substitutions, insertions, or deletions occur in regions outside the CDRs (e.g., in the FRs). Optionally, the antibody or antigen-binding fragment thereof comprises the VL sequence SEQ ID NO: 329, including one or more post-translational modifications of that sequence. In a particular embodiment, the VL comprises one, two or three CDRs selected from: a. CDR-L1, comprising the amino acid sequence SEQ ID NO: 871, b. CDR-L2, comprising the amino acid sequence SEQ ID NO: 1413, and c. CDR-L3, comprising the amino acid sequence SEQ ID NO: 1955.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 58, and the VL amino acid sequence of SEQ ID NO: 329, optionally including post-translational modifications of those sequences.

TBRE1046

In one aspect, the present disclosure provides an antibody or antigen-binding fragment thereof comprising at least one or both variable regions selected from: a. VH comprising the amino acid sequence of SEQ ID NO: 59 and b. VL comprising the amino acid sequence of SEQ ID NO: 330.

In one aspect, the present disclosure provides an antibody or antigen-binding fragment thereof comprising at least one, two, three, four, five, or six CDRs selected from: a. CDR-H1 comprising the amino acid sequence of SEQ ID NO: 601, b. CDR-H2 comprising the amino acid sequence of SEQ ID NO: 1143, c. CDR-H3 comprising the amino acid sequence of SEQ ID NO: 1685, d. CDR-L1 comprising the amino acid sequence of SEQ ID NO: 872, e. CDR-L2 comprising the amino acid sequence of SEQ ID NO: 1414, and f. CDR-L3 comprising the amino acid sequence of SEQ ID NO: 1956.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 601, b. CDR-H2 comprising the amino acid sequence of SEQ ID NO: 1143, c. CDR-H3 comprising the amino acid sequence of SEQ ID NO: 1685, and a VL comprising the amino acid sequence of SEQ ID NO: 330.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 872, b. CDR-L2 comprising the amino acid sequence of SEQ ID NO: 1414, c. CDR-L3 comprising the amino acid sequence of SEQ ID NO: 1956, and a VH comprising the amino acid sequence of SEQ ID NO: 59.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 59. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 59. In some embodiments, substitutions, insertions, or deletions occur in regions outside the CDRs (e.g., in the FRs). Optionally, the antibody or antigen-binding fragment thereof comprises the VH sequence SEQ ID NO: 59, including one or more post-translational modifications of that sequence. In a particular embodiment, the VH comprises one, two or three CDRs selected from: a. CDR-H1, comprising the amino acid sequence SEQ ID NO: 601, b. CDR-H2, comprising the amino acid sequence SEQ ID NO: 1143, and c. CDR-H3, comprising the amino acid sequence SEQ ID NO: 1685.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 330. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 330. In some embodiments, the substitutions, insertions, or deletions occur in regions outside the CDRs (e.g., in the FRs). Optionally, the antibody or antigen-binding fragment thereof comprises the VL sequence SEQ ID NO: 330, including one or more post-translational modifications of that sequence. In a particular embodiment, the VL comprises one, two or three CDRs selected from: a. CDR-L1, comprising the amino acid sequence SEQ ID NO: 872, b. CDR-L2, comprising the amino acid sequence SEQ ID NO: 1414, and c. CDR-L3, comprising the amino acid sequence SEQ ID NO: 1956.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 59, and the VL amino acid sequence of SEQ ID NO: 330, optionally including post-translational modifications of those sequences. TBRE1047

In one aspect, the present disclosure provides an antibody or antigen-binding fragment thereof comprising at least one or both variable regions selected from: a. VH comprising the amino acid sequence of SEQ ID NO: 60 and b. VL comprising the amino acid sequence of SEQ ID NO: 331.

In one aspect, the present disclosure provides an antibody or antigen-binding fragment thereof comprising at least one, two, three, four, five, or six CDRs selected from: a. CDR-H1 comprising the amino acid sequence of SEQ ID NO: 602, b. CDR-H2 comprising the amino acid sequence of SEQ ID NO: 1144, c. CDR-H3 comprising the amino acid sequence of SEQ ID NO: 1686, d. CDR-L1 comprising the amino acid sequence of SEQ ID NO: 873, e. CDR-L2 comprising the amino acid sequence of SEQ ID NO: 1415, and f. CDR-L3 comprising the amino acid sequence of SEQ ID NO: 1957.

In one aspect, the present disclosure provides an antibody or antigen-binding fragment thereof comprising a CDR-H3 comprising the amino acid sequence of SEQ ID NO: 1686, and a CDR-L3 comprising the amino acid sequence of SEQ ID NO: 1957.

In one aspect, the present disclosure provides an antibody or antigen-binding fragment thereof comprising a CDR-H3 comprising the amino acid sequence of SEQ ID NO: 1686, and a CDR-L3 comprising the amino acid sequence of SEQ ID NO: 1957.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 602, b. CDR-H2 comprising the amino acid sequence of SEQ ID NO: 1144, c. CDR-H3 comprising the amino acid sequence of SEQ ID NO: 1686, and a VL comprising the amino acid sequence of SEQ ID NO: 331.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 873, b. CDR-L2 comprising the amino acid sequence of SEQ ID NO: 1415, c. CDR-L3 comprising the amino acid sequence of SEQ ID NO: 1957, and a VH comprising the amino acid sequence of SEQ ID NO: 60.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 60. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 60. In some embodiments, substitutions, insertions, or deletions occur in regions outside the CDRs (e.g., in the FRs). Optionally, the antibody or antigen-binding fragment thereof comprises the VH sequence SEQ ID NO: 60, including one or more post-translational modifications of that sequence. In a particular embodiment, the VH comprises one, two or three CDRs selected from: a. CDR-H1, comprising the amino acid sequence SEQ ID NO: 602, b. CDR-H2, comprising the amino acid sequence SEQ ID NO: 1144, and c. CDR-H3, comprising the amino acid sequence SEQ ID NO: 1686.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 331. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 331. In some embodiments, the substitutions, insertions, or deletions occur in regions outside the CDRs (e.g., in the FRs). Optionally, the antibody or antigen-binding fragment thereof comprises the VL sequence SEQ ID NO: 331, including one or more post-translational modifications of that sequence. In a particular embodiment, the VL comprises one, two or three CDRs selected from: a. CDR-L1, comprising the amino acid sequence SEQ ID NO: 873, b. CDR-L2, comprising the amino acid sequence SEQ ID NO: 1415, and c. CDR-L3, comprising the amino acid sequence SEQ ID NO: 1957.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 60, and the VL amino acid sequence of SEQ ID NO: 331, optionally including post-translational modifications of those sequences.

TBRE1048

In one aspect, the present disclosure provides an antibody or antigen-binding fragment thereof comprising at least one or both variable regions selected from: a. VH comprising the amino acid sequence of SEQ ID NO: 61 and b. VL comprising the amino acid sequence of SEQ ID NO: 332.

In one aspect, the present disclosure provides an antibody or antigen-binding fragment thereof comprising at least one, two, three, four, five, or six CDRs selected from: a. CDR-H1 comprising the amino acid sequence of SEQ ID NO: 603, b. CDR-H2 comprising the amino acid sequence of SEQ ID NO: 1145, c. CDR-H3 comprising the amino acid sequence of SEQ ID NO: 1687, d. CDR-L1 comprising the amino acid sequence of SEQ ID NO: 874, e. CDR-L2 comprising the amino acid sequence of SEQ ID NO: 1416, and f. CDR-L3 comprising the amino acid sequence of SEQ ID NO: 1958.

In one aspect, the present disclosure provides an antibody or antigen-binding fragment thereof comprising a CDR-H3 comprising the amino acid sequence of SEQ ID NO: 1687, and a CDR-L3 comprising the amino acid sequence of SEQ ID NO: 1958.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 603, b. CDR-H2 comprising the amino acid sequence of SEQ ID NO: 1145, c. CDR-H3 comprising the amino acid sequence of SEQ ID NO: 1687, and a VL comprising the amino acid sequence of SEQ ID NO: 332.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 874, b. CDR-L2 comprising the amino acid sequence of SEQ ID NO: 1416, c. CDR-L3 comprising the amino acid sequence of SEQ ID NO: 1958, and a VH comprising the amino acid sequence of SEQ ID NO: 61.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 61. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 61. In some embodiments, substitutions, insertions, or deletions occur in regions outside the CDRs (e.g., in the FRs). Optionally, the antibody or antigen-binding fragment thereof comprises the VH sequence SEQ ID NO: 61, including one or more post-translational modifications of that sequence. In a particular embodiment, the VH comprises one, two or three CDRs selected from: a. CDR-H1, comprising the amino acid sequence SEQ ID NO: 603, b. CDR-H2, comprising the amino acid sequence SEQ ID NO: 1145, and c. CDR-H3, comprising the amino acid sequence SEQ ID NO: 1687.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 332. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 332. In some embodiments, the substitutions, insertions, or deletions occur in regions outside the CDRs (e.g., in the FRs). Optionally, the antibody or antigen-binding fragment thereof comprises the VL sequence SEQ ID NO: 332, including one or more post-translational modifications of that sequence. In a particular embodiment, the VL comprises one, two or three CDRs selected from: a. CDR-L1, comprising the amino acid sequence SEQ ID NO: 874, b. CDR-L2, comprising the amino acid sequence SEQ ID NO: 1416, and c. CDR-L3, comprising the amino acid sequence SEQ ID NO: 1958.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 61, and the VL amino acid sequence of SEQ ID NO: 332, optionally including post-translational modifications of those sequences.

TBRE1049

In one aspect, the present disclosure provides an antibody or antigen-binding fragment thereof comprising at least one or both variable regions selected from: a. VH comprising the amino acid sequence of SEQ ID NO: 62 and b. VL comprising the amino acid sequence of SEQ ID NO: 333.

In one aspect, the present disclosure provides an antibody or antigen-binding fragment thereof comprising at least one, two, three, four, five, or six CDRs selected from: a. CDR-H1 comprising the amino acid sequence of SEQ ID NO: 604, b. CDR-H2 comprising the amino acid sequence of SEQ ID NO: 1146, c. CDR-H3 comprising the amino acid sequence of SEQ ID NO: 1688, d. CDR-L1 comprising the amino acid sequence of SEQ ID NO: 875, e. CDR-L2 comprising the amino acid sequence of SEQ ID NO: 1417, and f. CDR-L3 comprising the amino acid sequence of SEQ ID NO: 1959.

In one aspect, the present disclosure provides an antibody or antigen-binding fragment thereof comprising: a. CDR-H1 comprising the amino acid sequence of SEQ ID NO: 604, b. CDR-H2 comprising the amino acid sequence of SEQ ID NO: 1146, c. CDR-H3 comprising the amino acid sequence of SEQ ID NO: 1688, d. CDR-L1 comprising the amino acid sequence of SEQ ID NO: 875, e. CDR-L2 comprising the amino acid sequence of SEQ ID NO: 1417, and f. CDR-L3 comprising the amino acid sequence of SEQ ID NO: 1959.

In one aspect, the present disclosure provides an antibody or antigen-binding fragment thereof comprising a CDR-H3 comprising the amino acid sequence of SEQ ID NO: 1688, and a CDR-L3 comprising the amino acid sequence of SEQ ID NO: 1959.

In one aspect, the present disclosure provides an antibody or antigen-binding fragment thereof comprising at least one, at least two, or all three VH CDR sequences selected from:

a. CDR-H1 comprising the amino acid sequence of SEQ ID NO: 604, b. CDR-H2 comprising the amino acid sequence of SEQ ID NO: 1146, c. CDR-H3 comprising the amino acid sequence of SEQ ID NO: 1688, and a VL comprising the amino acid sequence of SEQ ID NO: 333.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 875, b. CDR-L2 comprising the amino acid sequence of SEQ ID NO: 1417, c. CDR-L3 comprising the amino acid sequence of SEQ ID NO: 1959, and a VH comprising the amino acid sequence of SEQ ID NO: 62.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 62. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 62. In some embodiments, substitutions, insertions, or deletions occur in regions outside the CDRs (e.g., in the FRs). Optionally, the antibody or antigen-binding fragment thereof comprises the VH sequence SEQ ID NO: 62, including one or more post-translational modifications of that sequence. In a particular embodiment, the VH comprises one, two or three CDRs selected from: a. CDR-H1, comprising the amino acid sequence SEQ ID NO: 604, b. CDR-H2, comprising the amino acid sequence SEQ ID NO: 1146, and c. CDR-H3, comprising the amino acid sequence SEQ ID NO: 1688.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 333. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 333. In some embodiments, the substitutions, insertions, or deletions occur in regions outside the CDRs (e.g., in the FRs). Optionally, the antibody or antigen-binding fragment thereof comprises the VL sequence SEQ ID NO: 333, including one or more post-translational modifications of that sequence. In a particular embodiment, the VL comprises one, two or three CDRs selected from: a. CDR-L1, comprising the amino acid sequence SEQ ID NO: 875, b. CDR-L2, comprising the amino acid sequence SEQ ID NO: 1417, and c. CDR-L3, comprising the amino acid sequence SEQ ID NO: 1959.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 62, and the VL amino acid sequence of SEQ ID NO: 333, optionally including post-translational modifications of those sequences.

TBRE1050

In one aspect, the present disclosure provides an antibody or antigen-binding fragment thereof comprising at least one or both variable regions selected from: a. VH comprising the amino acid sequence of SEQ ID NO: 63 and b. VL comprising the amino acid sequence of SEQ ID NO: 334.

In one aspect, the present disclosure provides an antibody or antigen-binding fragment thereof comprising at least one, two, three, four, five, or six CDRs selected from: a. CDR-H1 comprising the amino acid sequence of SEQ ID NO: 605, b. CDR-H2 comprising the amino acid sequence of SEQ ID NO: 1147, c. CDR-H3 comprising the amino acid sequence of SEQ ID NO: 1689, d. CDR-L1 comprising the amino acid sequence of SEQ ID NO: 876, e. CDR-L2 comprising the amino acid sequence of SEQ ID NO: 1418, and f. CDR-L3 comprising the amino acid sequence of SEQ ID NO: 1960.

In one aspect, the present disclosure provides an antibody or antigen-binding fragment thereof comprising: a. CDR-H1 comprising the amino acid sequence of SEQ ID NO: 605, b. CDR-H2 comprising the amino acid sequence of SEQ ID NO: 1147, c. CDR-H3 comprising the amino acid sequence of SEQ ID NO: 1689, d. CDR-L1 comprising the amino acid sequence of SEQ ID NO: 876, e. CDR-L2 comprising the amino acid sequence of SEQ ID NO: 1418, and f. CDR-L3 comprising the amino acid sequence of SEQ ID NO: 1960. In one aspect, the present disclosure provides an antibody or antigen-binding fragment thereof comprising a CDR-H3 comprising the amino acid sequence of SEQ ID NO: 1689, and a CDR-L3 comprising the amino acid sequence of SEQ ID NO: 1960.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 605, b. CDR-H2 comprising the amino acid sequence of SEQ ID NO: 1147, c. CDR-H3 comprising the amino acid sequence of SEQ ID NO: 1689, and a VL comprising the amino acid sequence of SEQ ID NO: 334.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 876, b. CDR-L2 comprising the amino acid sequence of SEQ ID NO: 1418, c. CDR-L3 comprising the amino acid sequence of SEQ ID NO: 1960, and a VH comprising the amino acid sequence of SEQ ID NO: 63.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 63. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 63. In some embodiments, substitutions, insertions, or deletions occur in regions outside the CDRs (e.g., in the FRs). Optionally, the antibody or antigen-binding fragment thereof comprises the VH sequence SEQ ID NO: 63, including one or more post-translational modifications of that sequence. In a particular embodiment, the VH comprises one, two or three CDRs selected from: a. CDR-H1, comprising the amino acid sequence SEQ ID NO: 605, b. CDR-H2, comprising the amino acid sequence SEQ ID NO: 1147, and c. CDR-H3, comprising the amino acid sequence SEQ ID NO: 1689.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 334. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 334. In some embodiments, the substitutions, insertions, or deletions occur in regions outside the CDRs (e.g., in the FRs). Optionally, the antibody or antigen-binding fragment thereof comprises the VL sequence SEQ ID NO: 334, including one or more post-translational modifications of that sequence. In a particular embodiment, the VL comprises one, two or three CDRs selected from: a. CDR-L1, comprising the amino acid sequence SEQ ID NO: 876, b. CDR-L2, comprising the amino acid sequence SEQ ID NO: 1418, and c. CDR-L3, comprising the amino acid sequence SEQ ID NO: 1960.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 63, and the VL amino acid sequence of SEQ ID NO: 334, optionally including post-translational modifications of those sequences.
TBRE1051

In one aspect, the present disclosure provides an antibody or antigen-binding fragment thereof comprising at least one or both variable regions selected from: a. VH comprising the amino acid sequence of SEQ ID NO: 64 and b. VL comprising the amino acid sequence of SEQ ID NO: 335.

In one aspect, the present disclosure provides an antibody or antigen-binding fragment thereof comprising at least one, two, three, four, five, or six CDRs selected from: a. CDR-H1 comprising the amino acid sequence of SEQ ID NO: 606, b. CDR-H2 comprising the amino acid sequence of SEQ ID NO: 1148, c. CDR-H3 comprising the amino acid sequence of SEQ ID NO: 1690, d. CDR-L1 comprising the amino acid sequence of SEQ ID NO: 877, e. CDR-L2 comprising the amino acid sequence of SEQ ID NO: 1419, and f. CDR-L3 comprising the amino acid sequence of SEQ ID NO: 1961.

In one aspect, the present disclosure provides an antibody or antigen-binding fragment thereof comprising a CDR-H3 comprising the amino acid sequence of SEQ ID NO: 1690 and a CDR-L3 comprising the amino acid sequence of SEQ ID NO: 1961. In one aspect, the present disclosure provides an antibody or antigen-binding fragment thereof comprising: a. CDR-H1 comprising the amino acid sequence of SEQ ID NO: 606, b. CDR-H2 comprising the amino acid sequence of SEQ ID NO: 1148, c. CDR-H3 comprising the amino acid sequence of SEQ ID NO: 1690, d. CDR-L1 comprising the amino acid sequence of SEQ ID NO: 877, e. CDR-L2 comprising the amino acid sequence of SEQ ID NO: 1419, and f. CDR-L3 comprising the amino acid sequence of SEQ ID NO: 1961.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 606, b. CDR-H2 comprising the amino acid sequence of SEQ ID NO: 1148, c. CDR-H3 comprising the amino acid sequence of SEQ ID NO: 1690, and a VL comprising the amino acid sequence of SEQ ID NO: 335.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 877, b. CDR-L2 comprising the amino acid sequence of SEQ ID NO: 1419, c. CDR-L3 comprising the amino acid sequence of SEQ ID NO: 1961, and a VH comprising the amino acid sequence of SEQ ID NO: 64.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 64. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 64. In some embodiments, substitutions, insertions, or deletions occur in regions outside the CDRs (e.g., in the FRs). Optionally, the antibody or antigen-binding fragment thereof comprises the VH sequence SEQ ID NO: 64, including one or more post-translational modifications of that sequence. In a particular embodiment, the VH comprises one, two or three CDRs selected from: a. CDR-H1, comprising the amino acid sequence SEQ ID NO: 606, b. CDR-H2, comprising the amino acid sequence SEQ ID NO: 1148, and c. CDR-H3, comprising the amino acid sequence SEQ ID NO: 1690.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 335. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 335. In some embodiments, the substitutions, insertions, or deletions occur in regions outside the CDRs (e.g., in the FRs). Optionally, the antibody or antigen-binding fragment thereof comprises the VL sequence SEQ ID NO: 335, including one or more post-translational modifications of that sequence. In a particular embodiment, the VL comprises one, two or three CDRs selected from: a. CDR-L1, comprising the amino acid sequence SEQ ID NO: 877, b. CDR-L2, comprising the amino acid sequence SEQ ID NO: 1419, and c. CDR-L3, comprising the amino acid sequence SEQ ID NO: 1961.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 64, and the VL amino acid sequence of SEQ ID NO: 335, optionally including post-translational modifications of those sequences.
TBRE1052

In one aspect, the present disclosure provides an antibody or antigen-binding fragment thereof comprising at least one or both variable regions selected from: a. VH comprising the amino acid sequence of SEQ ID NO: 65 and b. VL comprising the amino acid sequence of SEQ ID NO: 336.

In one aspect, the present disclosure provides an antibody or antigen-binding fragment thereof comprising at least one, two, three, four, five, or six CDRs selected from: a. CDR-H1 comprising the amino acid sequence of SEQ ID NO: 607, b. CDR-H2 comprising the amino acid sequence of SEQ ID NO: 1149, c. CDR-H3 comprising the amino acid sequence of SEQ ID NO: 1691, d. CDR-L1 comprising the amino acid sequence of SEQ ID NO: 878, e. CDR-L2 comprising the amino acid sequence of SEQ ID NO: 1420, and f. CDR-L3 comprising the amino acid sequence of SEQ ID NO: 1962.

In one aspect, the present disclosure provides an antibody or antigen-binding fragment thereof comprising a CDR-H3 comprising the amino acid sequence of SEQ ID NO: 1691, and a CDR-L3 comprising the amino acid sequence of SEQ ID NO: 1962.

In one aspect, the present disclosure provides an antibody or antigen-binding fragment thereof comprising: a. CDR-H1 comprising the amino acid sequence of SEQ ID NO: 607, b. CDR-H2 comprising the amino acid sequence of SEQ ID NO: 1149, c. CDR-H3 comprising the amino acid sequence of SEQ ID NO: 1691, d. CDR-L1 comprising the amino acid sequence of SEQ ID NO: 878, e. CDR-L2 comprising the amino acid sequence of SEQ ID NO: 1420, and f. CDR-L3 comprising the amino acid sequence of SEQ ID NO: 1962.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 607, b. CDR-H2 comprising the amino acid sequence of SEQ ID NO: 1149, c. CDR-H3 comprising the amino acid sequence of SEQ ID NO: 1691, and a VL comprising the amino acid sequence of SEQ ID NO: 336.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 878, b. CDR-L2 comprising the amino acid sequence of SEQ ID NO: 1420, c. CDR-L3 comprising the amino acid sequence of SEQ ID NO: 1962, and a VH comprising the amino acid sequence of SEQ ID NO: 65.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 65. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 65. In some embodiments, substitutions, insertions, or deletions occur in regions outside the CDRs (e.g., in the FRs). Optionally, the antibody or antigen-binding fragment thereof comprises the VH sequence SEQ ID NO: 65, including one or more post-translational modifications of that sequence. In a particular embodiment, the VH comprises one, two or three CDRs selected from: a. CDR-H1, comprising the amino acid sequence SEQ ID NO: 607, b. CDR-H2, comprising the amino acid sequence SEQ ID NO: 1149, and c. CDR-H3, comprising the amino acid sequence SEQ ID NO: 1691.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 336. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 336. In some embodiments, the substitutions, insertions, or deletions occur in regions outside the CDRs (e.g., in the FRs). Optionally, the antibody or antigen-binding fragment thereof comprises the VL sequence SEQ ID NO: 336, including one or more post-translational modifications of that sequence. In a particular embodiment, the VL comprises one, two or three CDRs selected from: a. CDR-L1, comprising the amino acid sequence SEQ ID NO: 878, b. CDR-L2, comprising the amino acid sequence SEQ ID NO: 1420, and c. CDR-L3, comprising the amino acid sequence SEQ ID NO: 1962.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 65, and the VL amino acid sequence of SEQ ID NO: 336, optionally including post-translational modifications of those sequences.
TBRE1053

In one aspect, the present disclosure provides an antibody or antigen-binding fragment thereof comprising at least one or both variable regions selected from: a. VH comprising the amino acid sequence of SEQ ID NO: 66 and b. VL comprising the amino acid sequence of SEQ ID NO: 337.

In one aspect, the present disclosure provides an antibody or antigen-binding fragment thereof comprising at least one, two, three, four, five, or six CDRs selected from: a. CDR-H1 comprising the amino acid sequence of SEQ ID NO: 608, b. CDR-H2 comprising the amino acid sequence of SEQ ID NO: 1150, c. CDR-H3 comprising the amino acid sequence of SEQ ID NO: 1692, d. CDR-L1 comprising the amino acid sequence of SEQ ID NO: 879, e. CDR-L2 comprising the amino acid sequence of SEQ ID NO: 1421, and f. CDR-L3 comprising the amino acid sequence of SEQ ID NO: 1963.

In one aspect, the present disclosure provides an antibody or antigen-binding fragment thereof comprising a CDR-H3 comprising the amino acid sequence of SEQ ID NO: 1692, and a CDR-L3 comprising the amino acid sequence of SEQ ID NO: 1963.

In one aspect, the present disclosure provides an antibody or antigen-binding fragment thereof comprising: a. CDR-H1 comprising the amino acid sequence of SEQ ID NO: 608, b. CDR-H2 comprising the amino acid sequence of SEQ ID NO: 1150, c. CDR-H3 comprising the amino acid sequence of SEQ ID NO: 1692, d. CDR-L1 comprising the amino acid sequence of SEQ ID NO: 879, e. CDR-L2 comprising the amino acid sequence of SEQ ID NO: 1421, and f. CDR-L3 comprising the amino acid sequence of SEQ ID NO: 1963.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 608, b. CDR-H2 comprising the amino acid sequence of SEQ ID NO: 1150, c. CDR-H3 comprising the amino acid sequence of SEQ ID NO: 1692, and a VL comprising the amino acid sequence of SEQ ID NO: 337.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 879, b. CDR-L2 comprising the amino acid sequence of SEQ ID NO: 1421, c. CDR-L3 comprising the amino acid sequence of SEQ ID NO: 1963, and a VH comprising the amino acid sequence of SEQ ID NO: 66.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 66. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 66. In some embodiments, substitutions, insertions, or deletions occur in regions outside the CDRs (e.g., in the FRs). Optionally, the antibody or antigen-binding fragment thereof comprises the VH sequence SEQ ID NO: 66, including one or more post-translational modifications of that sequence. In a particular embodiment, the VH comprises one, two or three CDRs selected from: a. CDR-H1, comprising the amino acid sequence SEQ ID NO: 608, b. CDR-H2, comprising the amino acid sequence SEQ ID NO: 1150, and a. CDR-H3, comprising the amino acid sequence SEQ ID NO: 1692.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 337. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 337. In some embodiments, the substitutions, insertions, or deletions occur in regions outside the CDRs (e.g., in the FRs). Optionally, the antibody or antigen-binding fragment thereof comprises the VL sequence SEQ ID NO: 337, including one or more post-translational modifications of that sequence. In a particular embodiment, the VL comprises one, two or three CDRs selected from: a. CDR-L1, comprising the amino acid sequence SEQ ID NO: 879, b. CDR-L2, comprising the amino acid sequence SEQ ID NO: 1421, and c. CDR-L3, comprising the amino acid sequence SEQ ID NO: 1963.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 66, and the VL amino acid sequence of SEQ ID NO: 337, optionally including post-translational modifications of those sequences.

TBRE1054

In one aspect, the present disclosure provides an antibody or antigen-binding fragment thereof comprising at least one or both variable regions selected from: a. VH comprising the amino acid sequence of SEQ ID NO: 67 and b. VL comprising the amino acid sequence of SEQ ID NO: 338.

In one aspect, the present disclosure provides an antibody or antigen-binding fragment thereof comprising at least one, two, three, four, five, or six CDRs selected from: a. CDR-H1 comprising the amino acid sequence of SEQ ID NO: 609, b. CDR-H2 comprising the amino acid sequence of SEQ ID NO: 1151, c. CDR-H3 comprising the amino acid sequence of SEQ ID NO: 1693, d. CDR-L1 comprising the amino acid sequence of SEQ ID NO: 880, e. CDR-L2 comprising the amino acid sequence of SEQ ID NO: 1422, and f. CDR-L3 comprising the amino acid sequence of SEQ ID NO: 1964.

In one aspect, the present disclosure provides an antibody or antigen-binding fragment thereof comprising a CDR-H3 comprising the amino acid sequence of SEQ ID NO: 1693, and a CDR-L3 comprising the amino acid sequence of SEQ ID NO: 1964.

In one aspect, the present disclosure provides an antibody or antigen-binding fragment thereof comprising: a. CDR-H1 comprising the amino acid sequence of SEQ ID NO: 609, b. CDR-H2 comprising the amino acid sequence of SEQ ID NO: 1151, c. CDR-H3 comprising the amino acid sequence of SEQ ID NO: 1693, d. CDR-L1 comprising the amino acid sequence of SEQ ID NO: 880, e. CDR-L2 comprising the amino acid sequence of SEQ ID NO: 1422, and f. CDR-L3 comprising the amino acid sequence of SEQ ID NO: 1964.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 609, b. CDR-H2 comprising the amino acid sequence of SEQ ID NO: 1151, c. CDR-H3 comprising the amino acid sequence of SEQ ID NO: 1693, and a VL comprising the amino acid sequence of SEQ ID NO: 338.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 880, b. CDR-L2 comprising the amino acid sequence of SEQ ID NO: 1422, c. CDR-L3 comprising the amino acid sequence of SEQ ID NO: 1964, and a VH comprising the amino acid sequence of SEQ ID NO: 67.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 67. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 67. In some embodiments, substitutions, insertions, or deletions occur in regions outside the CDRs (e.g., in the FRs). Optionally, the antibody or antigen-binding fragment thereof comprises the VH sequence SEQ ID NO: 67, including one or more post-translational modifications of that sequence. In a particular embodiment, the VH comprises one, two or three CDRs selected from: a. CDR-H1, comprising the amino acid sequence SEQ ID NO: 609, b. CDR-H2, comprising the amino acid sequence SEQ ID NO: 1151, and c. CDR-H3, comprising the amino acid sequence SEQ ID NO: 1693.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 338. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 338. In some embodiments, the substitutions, insertions, or deletions occur in regions outside the CDRs (e.g., in the FRs). Optionally, the antibody or antigen-binding fragment thereof comprises the VL sequence SEQ ID NO: 338, including one or more post-translational modifications of that sequence. In a particular embodiment, the VL comprises one, two or three CDRs selected from: a. CDR-L1, comprising the amino acid sequence SEQ ID NO: 880, b. CDR-L2, comprising the amino acid sequence SEQ ID NO: 1422, and c. CDR-L3, comprising the amino acid sequence SEQ ID NO: 1964.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 67, and the VL amino acid sequence of SEQ ID NO: 338, optionally including post-translational modifications of those sequences.
TBRE1055

In one aspect, the present disclosure provides an antibody or antigen-binding fragment thereof comprising at least one or both variable regions selected from: a. VH comprising the amino acid sequence of SEQ ID NO: 68 and b. VL comprising the amino acid sequence of SEQ ID NO: 339.

In one aspect, the present disclosure provides an antibody or antigen-binding fragment thereof comprising at least one, two, three, four, five, or six CDRs selected from: a. CDR-H1 comprising the amino acid sequence of SEQ ID NO: 610, b. CDR-H2 comprising the amino acid sequence of SEQ ID NO: 1152, c. CDR-H3 comprising the amino acid sequence of SEQ ID NO: 1694, d. CDR-L1 comprising the amino acid sequence of SEQ ID NO: 881, e. CDR-L2 comprising the amino acid sequence of SEQ ID NO: 1423, and f. CDR-L3 comprising the amino acid sequence of SEQ ID NO: 1965.

In one aspect, the present disclosure provides an antibody or antigen-binding fragment thereof comprising a CDR-H3 comprising the amino acid sequence of SEQ ID NO: 1694, and a CDR-L3 comprising the amino acid sequence of SEQ ID NO: 1965.

In one aspect, the present disclosure provides an antibody or antigen-binding fragment thereof comprising: a. CDR-H1 comprising the amino acid sequence of SEQ ID NO: 610, b. CDR-H2 comprising the amino acid sequence of SEQ ID NO: 1152, c. CDR-H3 comprising the amino acid sequence of SEQ ID NO: 1694, d. CDR-L1 comprising the amino acid sequence of SEQ ID NO: 881, e. CDR-L2 comprising the amino acid sequence of SEQ ID NO: 1423, and f. CDR-L3 comprising the amino acid sequence of SEQ ID NO: 1965.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 610, b. CDR-H2 comprising the amino acid sequence of SEQ ID NO: 1152, c. CDR-H3 comprising the amino acid sequence of SEQ ID NO: 1694, and a VL comprising the amino acid sequence of SEQ ID NO: 339.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 881, b. CDR-L2 comprising the amino acid sequence of SEQ ID NO: 1423, c. CDR-L3 comprising the amino acid sequence of SEQ ID NO: 1965, and a VH comprising the amino acid sequence of SEQ ID NO: 68.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 68. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 68. In some embodiments, substitutions, insertions, or deletions occur in regions outside the CDRs (e.g., in the FRs). Optionally, the antibody or antigen-binding fragment thereof comprises the VH sequence SEQ ID NO: 68, including one or more post-translational modifications of that sequence. In a particular embodiment, the VH comprises one, two or three CDRs selected from: a. CDR-H1, comprising the amino acid sequence SEQ ID NO: 610, b. CDR-H2, comprising the amino acid sequence SEQ ID NO: 1152, and c. CDR-H3, comprising the amino acid sequence SEQ ID NO: 1694.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 339. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 339. In some embodiments, the substitutions, insertions, or deletions occur in regions outside the CDRs (e.g., in the FRs). Optionally, the antibody or antigen-binding fragment thereof comprises the VL sequence SEQ ID NO: 339, including one or more post-translational modifications of that sequence. In a particular embodiment, the VL comprises one, two or three CDRs selected from: a. CDR-L1, comprising the amino acid sequence SEQ ID NO: 881, b. CDR-L2, comprising the amino acid sequence SEQ ID NO: 1423, and c. CDR-L3, comprising the amino acid sequence SEQ ID NO: 1965.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 68, and the VL amino acid sequence of SEQ ID NO: 339, optionally including post-translational modifications of those sequences.
TBRE1056

In one aspect, the present disclosure provides an antibody or antigen-binding fragment thereof comprising at least one or both variable regions selected from: a. VH comprising the amino acid sequence of SEQ ID NO: 69 and b. VL comprising the amino acid sequence of SEQ ID NO: 340.

In one aspect, the present disclosure provides an antibody or antigen-binding fragment thereof comprising a CDR-H3 comprising the amino acid sequence of SEQ ID NO: 1695 and a CDR-L3 comprising the amino acid sequence of SEQ ID NO: 1966.

In one aspect, the present disclosure provides an antibody or antigen-binding fragment thereof comprising: a. CDR-H1 comprising the amino acid sequence of SEQ ID NO: 611, b. CDR-H2 comprising the amino acid sequence of SEQ ID NO: 1153, c. CDR-H3 comprising the amino acid sequence of SEQ ID NO: 1695, d. CDR-L1 comprising the amino acid sequence of SEQ ID NO: 882, e. CDR-L2 comprising the amino acid sequence of SEQ ID NO: 1424, and f. CDR-L3 comprising the amino acid sequence of SEQ ID NO: 1966.

In one aspect, the present disclosure provides an antibody or antigen-binding fragment thereof comprising at least one, two, three, four, five, or six CDRs selected from: a. CDR-H1 comprising the amino acid sequence of SEQ ID NO: 611, b. CDR-H2 comprising the amino acid sequence of SEQ ID NO: 1153, c. CDR-H3 comprising the amino acid sequence of SEQ ID NO: 1695, d. CDR-L1 comprising the amino acid sequence of SEQ ID NO: 882, e. CDR-L2 comprising the amino acid sequence of SEQ ID NO: 1424, and f. CDR-L3 comprising the amino acid sequence of SEQ ID NO: 1966.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 611, b. CDR-H2 comprising the amino acid sequence of SEQ ID NO: 1153, c. CDR-H3 comprising the amino acid sequence of SEQ ID NO: 1695, and a VL comprising the amino acid sequence of SEQ ID NO: 340.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 882, b. CDR-L2 comprising the amino acid sequence of SEQ ID NO: 1424, c. CDR-L3 comprising the amino acid sequence of SEQ ID NO: 1966, and a VH comprising the amino acid sequence of SEQ ID NO: 69.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 69. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 69. In some embodiments, substitutions, insertions, or deletions occur in regions outside the CDRs (e.g., in the FRs). Optionally, the antibody or antigen-binding fragment thereof comprises the VH sequence SEQ ID NO: 69, including one or more post-translational modifications of that sequence. In a particular embodiment, the VH comprises one, two or three CDRs selected from: a. CDR-H1, comprising the amino acid sequence SEQ ID NO: 611, b. CDR-H2, comprising the amino acid sequence SEQ ID NO: 1153, and c. CDR-H3, comprising the amino acid sequence SEQ ID NO: 1695.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 340. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 340. In some embodiments, the substitutions, insertions, or deletions occur in regions outside the CDRs (e.g., in the FRs). Optionally, the antibody or antigen-binding fragment thereof comprises the VL sequence SEQ ID NO: 340, including one or more post-translational modifications of that sequence. In a particular embodiment, the VL comprises one, two or three CDRs selected from: a. CDR-L1, comprising the amino acid sequence SEQ ID NO: 882, b. CDR-L2, comprising the amino acid sequence SEQ ID NO: 1424, and c. CDR-L3, comprising the amino acid sequence SEQ ID NO: 1966.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 69, and the VL amino acid sequence of SEQ ID NO: 340, optionally including post-translational modifications of those sequences.
TBRE1057

In one aspect, the present disclosure provides an antibody or antigen-binding fragment thereof comprising at least one or both variable regions selected from: a. $V_H$ comprising the amino acid sequence of SEQ ID NO: 70 and b. $V_L$ comprising the amino acid sequence of SEQ ID NO: 341.

In one aspect, the present disclosure provides an antibody or antigen-binding fragment thereof comprising at least one, two, three, four, five, or six CDRs selected from: a. CDR-H1 comprising the amino acid sequence of SEQ ID NO: 612, b. CDR-H2 comprising the amino acid sequence of SEQ ID NO: 1154, c. CDR-H3 comprising the amino acid sequence of SEQ ID NO: 1696, d. CDR-L1 comprising the amino acid sequence of SEQ ID NO: 883, e. CDR-L2 comprising the amino acid sequence of SEQ ID NO: 1425, and f. CDR-L3 comprising the amino acid sequence of SEQ ID NO: 1967.

In one aspect, the present disclosure provides an antibody or antigen-binding fragment thereof comprising a CDR-H3 comprising the amino acid sequence of SEQ ID NO: 1696, and a CDR-L3 comprising the amino acid sequence of SEQ ID NO: 1967.

In one aspect, the present disclosure provides an antibody or antigen-binding fragment thereof comprising a CDR-H3 comprising the amino acid sequence of SEQ ID NO: 1696, and a CDR-L3 comprising the amino acid sequence of SEQ ID NO: 1967.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 612, b. CDR-H2 comprising the amino acid sequence of SEQ ID NO: 1154, c. CDR-H3 comprising the amino acid sequence of SEQ ID NO: 1696, and a VL comprising the amino acid sequence of SEQ ID NO: 341.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 883, b. CDR-L2 comprising the amino acid sequence of SEQ ID NO: 1425, c. CDR-L3 comprising the amino acid sequence of SEQ ID NO: 1967, and a VH comprising the amino acid sequence of SEQ ID NO: 70.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 70. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 70. In some embodiments, substitutions, insertions, or deletions occur in regions outside the CDRs (e.g., in the FRs). Optionally, the antibody or antigen-binding fragment thereof comprises the VH sequence SEQ ID NO: 70, including one or more post-translational modifications of that sequence. In a particular embodiment, the VH comprises one, two or three CDRs selected from: a. CDR-H1, comprising the amino acid sequence SEQ ID NO: 612, b. CDR-H2, comprising the amino acid sequence SEQ ID NO: 1154, and c. CDR-H3, comprising the amino acid sequence SEQ ID NO: 1696.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 341. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 341. In some embodiments, the substitutions, insertions, or deletions occur in regions outside the CDRs (e.g., in the FRs). Optionally, the antibody or antigen-binding fragment thereof comprises the VL sequence SEQ ID NO: 341, including one or more post-translational modifications of that sequence. In a particular embodiment, the VL comprises one, two or three CDRs selected from: a. CDR-L1, comprising the amino acid sequence SEQ ID NO: 883, b. CDR-L2, comprising the amino acid sequence SEQ ID NO: 1425, and c. CDR-L3, comprising the amino acid sequence SEQ ID NO: 1967.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 70, and the VL amino acid sequence of SEQ ID NO: 341, optionally including post-translational modifications of those sequences.
TBRE1058

In one aspect, the present disclosure provides an antibody or antigen-binding fragment thereof comprising at least one or both variable regions selected from: a. VH comprising the amino acid sequence of SEQ ID NO: 71 and b. VL comprising the amino acid sequence of SEQ ID NO: 342.

In one aspect, the present disclosure provides an antibody or antigen-binding fragment thereof comprising at least one, two, three, four, five, or six CDRs selected from: a. CDR-H1 comprising the amino acid sequence of SEQ ID NO: 613, b. CDR-H2 comprising the amino acid sequence of SEQ ID NO: 1155, c. CDR-H3 comprising the amino acid sequence of SEQ ID NO: 1697, d. CDR-L1 comprising the amino acid sequence of SEQ ID NO: 884, e. CDR-L2 comprising the amino acid sequence of SEQ ID NO: 1426, and f. CDR-L3 comprising the amino acid sequence of SEQ ID NO: 1968.

In one aspect, the present disclosure provides an antibody or antigen-binding fragment thereof comprising a CDR-H3 comprising the amino acid sequence of SEQ ID NO: 1697, and a CDR-L3 comprising the amino acid sequence of SEQ ID NO: 1968.

In one aspect, the present disclosure provides an antibody or antigen-binding fragment thereof comprising: a. CDR-H1 comprising the amino acid sequence of SEQ ID NO: 613, b. CDR-H2 comprising the amino acid sequence of SEQ ID NO: 1155, c. CDR-H3 comprising the amino acid sequence of SEQ ID NO: 1697, d. CDR-L1 comprising the amino acid sequence of SEQ ID NO: 884, e. CDR-L2 comprising the amino acid sequence of SEQ ID NO: 1426, and f. CDR-L3 comprising the amino acid sequence of SEQ ID NO: 1968.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 613, b. CDR-H2 comprising the amino acid sequence of SEQ ID NO: 1155, c. CDR-H3 comprising the amino acid sequence of SEQ ID NO: 1697, and a VL comprising the amino acid sequence of SEQ ID NO: 342.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 884, b. CDR-L2 comprising the amino acid sequence of SEQ ID NO: 1426, c. CDR-L3 comprising the amino acid sequence of SEQ ID NO: 1968, and a VH comprising the amino acid sequence of SEQ ID NO: 71.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 71. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 71. In some embodiments, substitutions, insertions, or deletions occur in regions outside the CDRs (e.g., in the FRs). Optionally, the antibody or antigen-binding fragment thereof comprises the VH sequence SEQ ID NO: 71, including one or more post-translational modifications of that sequence. In a particular embodiment, the VH comprises one, two or three CDRs selected from: a. CDR-H1, comprising the amino acid sequence SEQ ID NO: 613, b. CDR-H2, comprising the amino acid sequence SEQ ID NO: 1155, and c. CDR-H3, comprising the amino acid sequence SEQ ID NO: 1697.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 342. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 342. In some embodiments, the substitutions, insertions, or deletions occur in regions outside the CDRs (e.g., in the FRs). Optionally, the antibody or antigen-binding fragment thereof comprises the VL sequence SEQ ID NO: 342, including one or more post-translational modifications of that sequence. In a particular embodiment, the VL comprises one, two or three CDRs selected from: a. CDR-L1, comprising the amino acid sequence SEQ ID NO: 884, b. CDR-L2, comprising the amino acid sequence SEQ ID NO: 1426, and c. CDR-L3, comprising the amino acid sequence SEQ ID NO: 1968.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 71, and the VL amino acid sequence of SEQ ID NO: 342, optionally including post-translational modifications of those sequences.
TCER1001

In one aspect, the present disclosure provides an antibody or antigen-binding fragment thereof comprising at least one or both variable regions selected from: a VH comprising the amino acid sequence of SEQ ID NO: 72 and b. VL comprising the amino acid sequence of SEQ ID NO: 343.

In one aspect, the present disclosure provides an antibody or antigen-binding fragment thereof comprising at least one, two, three, four, five, or six CDRs selected from: a. CDR-H1 comprising the amino acid sequence of SEQ ID NO: 614, b. CDR-H2 comprising the amino acid sequence of SEQ ID NO: 1156, c. CDR-H3 comprising the amino acid sequence of SEQ ID NO: 1698, d. CDR-L1 comprising the amino acid sequence of SEQ ID NO: 885, e. CDR-L2 comprising the amino acid sequence of SEQ ID NO: 1427, and f. CDR-L3 comprising the amino acid sequence of SEQ ID NO: 1969.

In one aspect, the present disclosure provides an antibody or antigen-binding fragment thereof comprising a CDR-H3 comprising the amino acid sequence of SEQ ID NO: 1698, and a CDR-L3 comprising the amino acid sequence of SEQ ID NO: 1969.

In one aspect, the present disclosure provides an antibody or antigen-binding fragment thereof comprising: a. CDR-H1 comprising the amino acid sequence of SEQ ID NO: 614, b. CDR-H2 comprising the amino acid sequence of SEQ ID NO: 1156, c. CDR-H3 comprising the amino acid sequence of SEQ ID NO: 1698, d. CDR-L1 comprising the amino acid sequence of SEQ ID NO: 885, e. CDR-L2 comprising the amino acid sequence of SEQ ID NO: 1427, and f. CDR-L3 comprising the amino acid sequence of SEQ ID NO: 1969.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 614, b. CDR-H2 comprising the amino acid sequence of SEQ ID NO: 1156, c. CDR-H3 comprising the amino acid sequence of SEQ ID NO: 1698, and a VL comprising the amino acid sequence of SEQ ID NO: 343.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 885, b. CDR-L2 comprising the amino acid sequence of SEQ ID NO: 1427, c. CDR-L3 comprising the amino acid sequence of SEQ ID NO: 1969, and a VH comprising the amino acid sequence of SEQ ID NO: 72.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 72. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 72. In some embodiments, substitutions, insertions, or deletions occur in regions outside the CDRs (e.g., in the FRs). Optionally, the antibody or antigen-binding fragment thereof comprises the VH sequence SEQ ID NO: 72, including one or more post-translational modifications of that sequence. In a particular embodiment, the VH comprises one, two or three CDRs selected from: a. CDR-H1, comprising the amino acid sequence SEQ ID NO: 614, b. CDR-H2, comprising the amino acid sequence SEQ ID NO: 1156, and c. CDR-H3, comprising the amino acid sequence SEQ ID NO: 1698.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 343. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 343. In some embodiments, the substitutions, insertions, or deletions occur in regions outside the CDRs (e.g., in the FRs). Optionally, the antibody or antigen-binding fragment thereof comprises the VL sequence SEQ ID NO: 343, including one or more post-translational modifications of that sequence. In a particular embodiment, the VL comprises one, two or three CDRs selected from: a. CDR-L1, comprising the amino acid sequence SEQ ID NO: 885, b. CDR-L2, comprising the amino acid sequence SEQ ID NO: 1427, and c. CDR-L3, comprising the amino acid sequence SEQ ID NO: 1969.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 72, and the VL amino acid sequence of SEQ ID NO: 343, optionally including post-translational modifications of those sequences.

TCER1002

In one aspect, the present disclosure provides an antibody or antigen-binding fragment thereof comprising at least one or both variable regions selected from: a. VH comprising the amino acid sequence of SEQ ID NO: 73 and b. VL comprising the amino acid sequence of SEQ ID NO: 344.

In one aspect, the present disclosure provides an antibody or antigen-binding fragment thereof comprising at least one, two, three, four, five, or six CDRs selected from: a. CDR-H1 comprising the amino acid sequence of SEQ ID NO: 615, b. CDR-H2 comprising the amino acid sequence of SEQ ID NO: 1157, c. CDR-H3 comprising the amino acid sequence of SEQ ID NO: 1699, d. CDR-L1 comprising the amino acid sequence of SEQ ID NO: 886, e. CDR-L2 comprising the amino acid sequence of SEQ ID NO: 1428, and f. CDR-L3 comprising the amino acid sequence of SEQ ID NO: 1970.

In one aspect, the present disclosure provides an antibody or antigen-binding fragment thereof comprising a CDR-H3 comprising the amino acid sequence of SEQ ID NO: 1699, and a CDR-L3 comprising the amino acid sequence of SEQ ID NO: 1970.

In one aspect, the present disclosure provides an antibody or antigen-binding fragment thereof comprising: a. CDR-H1 comprising the amino acid sequence of SEQ ID NO: 615, b. CDR-H2 comprising the amino acid sequence of SEQ ID NO: 1157, c. CDR-H3 comprising the amino acid sequence of SEQ ID NO: 1699, d. CDR-L1 comprising the amino acid sequence of SEQ ID NO: 886, e. CDR-L2 comprising the amino acid sequence of SEQ ID NO: 1428, and f. CDR-L3 comprising the amino acid sequence of SEQ ID NO: 1970.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 615, b. CDR-H2 comprising the amino acid sequence of SEQ ID NO: 1157, c. CDR-H3 comprising the amino acid sequence of SEQ ID NO: 1699, and a VL comprising the amino acid sequence of SEQ ID NO: 344.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 886, b. CDR-L2 comprising the amino acid sequence of SEQ ID NO: 1428, c. CDR-L3 comprising the amino acid sequence of SEQ ID NO: 1970, and a VH comprising the amino acid sequence of SEQ ID NO: 73.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 73. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 73. In some embodiments, substitutions, insertions, or deletions occur in regions outside the CDRs (e.g., in the FRs). Optionally, the antibody or antigen-binding fragment thereof comprises the VH sequence SEQ ID NO: 73, including one or more post-translational modifications of that sequence. In a particular embodiment, the VH comprises one, two or three CDRs selected from: a. CDR-H1, comprising the amino acid sequence SEQ ID NO: 615, b. CDR-H2, comprising the amino acid sequence SEQ ID NO: 1157, and c. CDR-H3, comprising the amino acid sequence SEQ ID NO: 1699.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 344. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 344. In some embodiments, the substitutions, insertions, or deletions occur in regions outside the CDRs (e.g., in the FRs). Optionally, the antibody or antigen-binding fragment thereof comprises the VL sequence SEQ ID NO: 344, including one or more post-translational modifications of that sequence. In a particular embodiment, the VL comprises one, two or three CDRs selected from: a. CDR-L1, comprising the amino acid sequence SEQ ID NO: 886, b. CDR-L2, comprising the amino acid sequence SEQ ID NO: 1428, and c. CDR-L3, comprising the amino acid sequence SEQ ID NO: 1970.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 73, and the VL amino acid sequence of SEQ ID NO: 344, optionally including post-translational modifications of those sequences.

TCER1003

In one aspect, the present disclosure provides an antibody or antigen-binding fragment thereof comprising at least one or both variable regions selected from: a. VH comprising the amino acid sequence of SEQ ID NO: 74 and b. VL comprising the amino acid sequence of SEQ ID NO: 345.

In one aspect, the present disclosure provides an antibody or antigen-binding fragment thereof comprising at least one, two, three, four, five, or six CDRs selected from: a. CDR-H1 comprising the amino acid sequence of SEQ ID NO: 616, b. CDR-H2 comprising the amino acid sequence of SEQ ID NO: 1158, c. CDR-H3 comprising the amino acid sequence of SEQ ID NO: 1700, d. CDR-L1 comprising the amino acid sequence of SEQ ID NO: 887, e. CDR-L2 comprising the amino acid sequence of SEQ ID NO: 1429, and f. CDR-L3 comprising the amino acid sequence of SEQ ID NO: 1971.

In one aspect, the present disclosure provides an antibody or antigen-binding fragment thereof comprising a CDR-H3 comprising the amino acid sequence of SEQ ID NO: 1700, and a CDR-L3 comprising the amino acid sequence of SEQ ID NO: 1971.

In one aspect, the present disclosure provides an antibody or antigen-binding fragment thereof comprising: a. CDR-H1 comprising the amino acid sequence of SEQ ID NO: 616, b. CDR-H2 comprising the amino acid sequence of SEQ ID NO: 1158, c. CDR-H3 comprising the amino acid sequence of SEQ ID NO: 1700, d. CDR-L1 comprising the amino acid sequence of SEQ ID NO: 887, e. CDR-L2 comprising the amino acid sequence of SEQ ID NO: 1429, and f. CDR-L3 comprising the amino acid sequence of SEQ ID NO: 1971.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 616, b. CDR-H2 comprising the amino acid sequence of SEQ ID NO: 1158, c. CDR-H3 comprising the amino acid sequence of SEQ ID NO: 1700, and a VL comprising the amino acid sequence of SEQ ID NO: 345.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 887, b. CDR-L2 comprising the amino acid sequence of SEQ ID NO: 1429, c. CDR-L3 comprising the amino acid sequence of SEQ ID NO: 1971, and a VH comprising the amino acid sequence of SEQ ID NO: 74.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 74. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 74. In some embodiments, substitutions, insertions, or deletions occur in regions outside the CDRs (e.g., in the FRs). Optionally, the antibody or antigen-binding fragment thereof comprises the VH sequence SEQ ID NO: 74, including one or more post-translational modifications of that sequence. In a particular embodiment, the VH comprises one, two or three CDRs selected from: a. CDR-H1, comprising the amino acid sequence SEQ ID NO: 616, b. CDR-H2, comprising the amino acid sequence SEQ ID NO: 1158, and c. CDR-H3, comprising the amino acid sequence SEQ ID NO: 1700.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 345. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 345. In some embodiments, the substitutions, insertions, or deletions occur in regions outside the CDRs (e.g., in the FRs). Optionally, the antibody or antigen-binding fragment thereof comprises the VL sequence SEQ ID NO: 345, including one or more post-translational modifications of that sequence. In a particular embodiment, the VL comprises one, two or three CDRs selected from: a. CDR-L1, comprising the amino acid sequence SEQ ID NO: 887, b. CDR-L2, comprising the amino acid sequence SEQ ID NO: 1429, and c. CDR-L3, comprising the amino acid sequence SEQ ID NO: 1971.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 74, and the VL amino acid sequence of SEQ ID NO: 345, optionally including post-translational modifications of those sequences.

TCER1004

In one aspect, the present disclosure provides an antibody or antigen-binding fragment thereof comprising at least one or both variable regions selected from: a. VH comprising the amino acid sequence of SEQ ID NO: 75 and b. VL comprising the amino acid sequence of SEQ ID NO: 346.

In one aspect, the present disclosure provides an antibody or antigen-binding fragment thereof comprising at least one, two, three, four, five, or six CDRs selected from: a. CDR-H1 comprising the amino acid sequence of SEQ ID NO: 617, b. CDR-H2 comprising the amino acid sequence of SEQ ID NO: 1159, c. CDR-H3 comprising the amino acid sequence of SEQ ID NO: 1701, d. CDR-L1 comprising the amino acid sequence of SEQ ID NO: 888, e. CDR-L2 comprising the amino acid sequence of SEQ ID NO: 1430, and f. CDR-L3 comprising the amino acid sequence of SEQ ID NO: 1972.

In one aspect, the present disclosure provides an antibody or antigen-binding fragment thereof comprising a CDR-H3 comprising the amino acid sequence of SEQ ID NO: 1701, and a CDR-L3 comprising the amino acid sequence of SEQ ID NO: 1972.

In one aspect, the present disclosure provides an antibody or antigen-binding fragment thereof comprising: a. CDR-H1 comprising the amino acid sequence of SEQ ID NO: 617, b. CDR-H2 comprising the amino acid sequence of SEQ ID NO: 1159, c. CDR-H3 comprising the amino acid sequence of SEQ ID NO: 1701, d. CDR-L1 comprising the amino acid sequence of SEQ ID NO: 888, e. CDR-L2 comprising the amino acid sequence of SEQ ID NO: 1430, and f. CDR-L3 comprising the amino acid sequence of SEQ ID NO: 1972.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 617, b. CDR-H2 comprising the amino acid sequence of SEQ ID NO: 1159, c. CDR-H3 comprising the amino acid sequence of SEQ ID NO: 1701, and a VL comprising the amino acid sequence of SEQ ID NO: 346.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 888, b. CDR-L2 comprising the amino acid sequence of SEQ ID NO: 1430, c. CDR-L3 comprising the amino acid sequence of SEQ ID NO: 1972, and a VH comprising the amino acid sequence of SEQ ID NO: 75.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 75. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 75. In some embodiments, substitutions, insertions, or deletions occur in regions outside the CDRs (e.g., in the FRs). Optionally, the antibody or antigen-binding fragment thereof comprises the VH sequence SEQ ID NO: 75, including one or more post-translational modifications of that sequence. In a particular embodiment, the VH comprises one, two or three CDRs selected from: a. CDR-H1, comprising the amino acid sequence SEQ ID NO: 617, b. CDR-H2, comprising the amino acid sequence SEQ ID NO: 1159, and c. CDR-H3, comprising the amino acid sequence SEQ ID NO: 1701.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 346. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 346. In some embodiments, the substitutions, insertions, or deletions occur in regions outside the CDRs (e.g., in the FRs). Optionally, the antibody or antigen-binding fragment thereof comprises the VL sequence SEQ ID NO: 346, including one or more post-translational modifications of that sequence. In a particular embodiment, the VL comprises one, two or three CDRs selected from: a CDR-L1, comprising the amino acid sequence SEQ ID NO: 888, b. CDR-L2, comprising the amino acid sequence SEQ ID NO: 1430, and c. CDR-L3, comprising the amino acid sequence SEQ ID NO: 1972.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 75, and the VL amino acid sequence of SEQ ID NO: 346, optionally including post-translational modifications of those sequences.
TCER1005

In one aspect, the present disclosure provides an antibody or antigen-binding fragment thereof comprising at least one or both variable regions selected from: a. VH comprising the amino acid sequence of SEQ ID NO: 76 and b. VL comprising the amino acid sequence of SEQ ID NO: 347.

In one aspect, the present disclosure provides an antibody or antigen-binding fragment thereof comprising at least one, two, three, four, five, or six CDRs selected from: a. CDR-H1 comprising the amino acid sequence of SEQ ID NO: 618, b. CDR-H2 comprising the amino acid sequence of SEQ ID NO: 1160, c. CDR-H3 comprising the amino acid sequence of SEQ ID NO: 1702, d. CDR-L1 comprising the amino acid sequence of SEQ ID NO: 889, e. CDR-L2 comprising the amino acid sequence of SEQ ID NO: 1431, f. CDR-L3 comprising the amino acid sequence of SEQ ID NO: 1973.

In one aspect, the present disclosure provides an antibody or antigen-binding fragment thereof comprising a CDR-H3 comprising the amino acid sequence of SEQ ID NO: 1702, and a CDR-L3 comprising the amino acid sequence of SEQ ID NO: 1973.

In one aspect, the present disclosure provides an antibody or antigen-binding fragment thereof comprising: a. CDR-H1 comprising the amino acid sequence of SEQ ID NO: 618, b. CDR-H2 comprising the amino acid sequence of SEQ ID NO: 1160, c. CDR-H3 comprising the amino acid sequence of SEQ ID NO: 1702, d. CDR-L1 comprising the amino acid sequence of SEQ ID NO: 889, e. CDR-L2 comprising the amino acid sequence of SEQ ID NO: 1431, f. CDR-L3 comprising the amino acid sequence of SEQ ID NO: 1973.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 618, b. CDR-H2 comprising the amino acid sequence of SEQ ID NO: 1160, c. CDR-H3 comprising the amino acid sequence of SEQ ID NO: 1702, and a VL comprising the amino acid sequence of SEQ ID NO: 347.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 889, b. CDR-L2 comprising the amino acid sequence of SEQ ID NO: 1431, c. CDR-L3 comprising the amino acid sequence of SEQ ID NO: 1973, and a VH comprising the amino acid sequence of SEQ ID NO: 76.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 76. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 76. In some embodiments, substitutions, insertions, or deletions occur in regions outside the CDRs (e.g., in the FRs). Optionally, the antibody or antigen-binding fragment thereof comprises the VH sequence SEQ ID NO: 76, including one or more post-translational modifications of that sequence. In a particular embodiment, the VH comprises one, two or three CDRs selected from: a. CDR-H1, comprising the amino acid sequence SEQ ID NO: 618, b. CDR-H2, comprising the amino acid sequence SEQ ID NO: 1160, and c. CDR-H3, comprising the amino acid sequence SEQ ID NO: 1702.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 347. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 347. In some embodiments, the substitutions, insertions, or deletions occur in regions outside the CDRs (e.g., in the FRs). Optionally, the antibody or antigen-binding fragment thereof comprises the VL sequence SEQ ID NO: 347, including one or more post-translational modifications of that sequence. In a particular embodiment, the VL comprises one, two or three CDRs selected from: a. CDR-L1, comprising the amino acid sequence SEQ ID NO: 889, b. CDR-L2, comprising the amino acid sequence SEQ ID NO: 1431, and c. CDR-L3, comprising the amino acid sequence SEQ ID NO: 1973.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 76, and the VL amino acid sequence of SEQ ID NO: 347, optionally including post-translational modifications of those sequences.

TCER1006

In one aspect, the present disclosure provides an antibody or antigen-binding fragment thereof comprising at least one or both variable regions selected from: a. VH comprising the amino acid sequence of SEQ ID NO: 77 and b. VL comprising the amino acid sequence of SEQ ID NO: 348.

In one aspect, the present disclosure provides an antibody or antigen-binding fragment thereof comprising at least one, two, three, four, five, or six CDRs selected from: a. CDR-H1 comprising the amino acid sequence of SEQ ID NO: 619, b. CDR-H2 comprising the amino acid sequence of SEQ ID NO: 1161, c. CDR-H3 comprising the amino acid sequence of SEQ ID NO: 1703, d. CDR-L1 comprising the amino acid sequence of SEQ ID NO: 890, e. CDR-L2 comprising the amino acid sequence of SEQ ID NO: 1432, and f. CDR-L3 comprising the amino acid sequence of SEQ ID NO: 1974.

In one aspect, the present disclosure provides an antibody or antigen-binding fragment thereof comprising a CDR-H3 comprising the amino acid sequence of SEQ ID NO: 1703, and a CDR-L3 comprising the amino acid sequence of SEQ ID NO: 1974.

In one aspect, the present disclosure provides an antibody or antigen-binding fragment thereof comprising: a. CDR-H1 comprising the amino acid sequence of SEQ ID NO: 619, b. CDR-H2 comprising the amino acid sequence of SEQ ID NO: 1161, c. CDR-H3 comprising the amino acid sequence of SEQ ID NO: 1703, d. CDR-L1 comprising the amino acid sequence of SEQ ID NO: 890, e. CDR-L2 comprising the amino acid sequence of SEQ ID NO: 1432, and f. CDR-L3 comprising the amino acid sequence of SEQ ID NO: 1974.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 619, b. CDR-H2 comprising the amino acid sequence of SEQ ID NO: 1161, c. CDR-H3 comprising the amino acid sequence of SEQ ID NO: 1703, and a VL comprising the amino acid sequence of SEQ ID NO: 348.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 890, b. CDR-L2 comprising the amino acid sequence of SEQ ID NO: 1432, c. CDR-L3 comprising the amino acid sequence of SEQ ID NO: 1974, and a VH comprising the amino acid sequence of SEQ ID NO: 77.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 77. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 77. In some embodiments, substitutions, insertions, or deletions occur in regions outside the CDRs (e.g., in the FRs). Optionally, the antibody or antigen-binding fragment thereof comprises the VH sequence SEQ ID NO: 77, including one or more post-translational modifications of that sequence. In a particular embodiment, the VH comprises one, two or three CDRs selected from: a. CDR-H1, comprising the amino acid sequence SEQ ID NO: 619, b. CDR-H2, comprising the amino acid sequence SEQ ID NO: 1161, and c. CDR-H3, comprising the amino acid sequence SEQ ID NO: 1703.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 348. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 348. In some embodiments, the substitutions, insertions, or deletions occur in regions outside the CDRs (e.g., in the FRs). Optionally, the antibody or antigen-binding fragment thereof comprises the VL sequence SEQ ID NO: 348, including one or more post-translational modifications of that sequence. In a particular embodiment, the VL comprises one, two or three CDRs selected from: a. CDR-L1, comprising the amino acid sequence SEQ ID NO: 890, b. CDR-L2, comprising the amino acid sequence SEQ ID NO: 1432, and c. CDR-L3, comprising the amino acid sequence SEQ ID NO: 1974.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 77, and the VL amino acid sequence of SEQ ID NO: 348, optionally including post-translational modifications of those sequences.

TCER1007

In one aspect, the present disclosure provides an antibody or antigen-binding fragment thereof comprising at least one or both variable regions selected from: a. VH comprising the amino acid sequence of SEQ ID NO: 78 and b. VL comprising the amino acid sequence of SEQ ID NO: 349.

In one aspect, the present disclosure provides an antibody or antigen-binding fragment thereof comprising at least one, two, three, four, five, or six CDRs selected from: a. CDR-H1 comprising the amino acid sequence of SEQ ID NO: 620, b. CDR-H2 comprising the amino acid sequence of SEQ ID NO: 1162, c. CDR-H3 comprising the amino acid sequence of SEQ ID NO: 1704, d. CDR-L1 comprising the amino acid sequence of SEQ ID NO: 891, e. CDR-L2 comprising the amino acid sequence of SEQ ID NO: 1433, and f. CDR-L3 comprising the amino acid sequence of SEQ ID NO: 1975.

In one aspect, the present disclosure provides an antibody or antigen-binding fragment thereof comprising a CDR-H3 comprising the amino acid sequence of SEQ ID NO: 1704, and a CDR-L3 comprising the amino acid sequence of SEQ ID NO: 1975.

In one aspect, the present disclosure provides an antibody or antigen-binding fragment thereof comprising: a. CDR-H1 comprising the amino acid sequence of SEQ ID NO: 620, b. CDR-H2 comprising the amino acid sequence of SEQ ID NO: 1162, c. CDR-H3 comprising the amino acid sequence of SEQ ID NO: 1704, d. CDR-L1 comprising the amino acid sequence of SEQ ID NO: 891, e. CDR-L2 comprising the amino acid sequence of SEQ ID NO: 1433, and f. CDR-L3 comprising the amino acid sequence of SEQ ID NO: 1975.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 620, b. CDR-H2 comprising the amino acid sequence of SEQ ID NO: 1162, c. CDR-H3 comprising the amino acid sequence of SEQ ID NO: 1704, and a VL comprising the amino acid sequence of SEQ ID NO: 349.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 891, b. CDR-L2 comprising the amino acid sequence of SEQ ID NO: 1433, c. CDR-L3 comprising the amino acid sequence of SEQ ID NO: 1975, and a VH comprising the amino acid sequence of SEQ ID NO: 78.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 78. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 78. In some embodiments, substitutions, insertions, or deletions occur in regions outside the CDRs (e.g., in the FRs). Optionally, the antibody or antigen-binding fragment thereof comprises the VH sequence SEQ ID NO: 78, including one or more post-translational modifications of that sequence. In a particular embodiment, the VH comprises one, two or three CDRs selected from: a. CDR-H1, comprising the amino acid sequence SEQ ID NO: 620, b. CDR-H2, comprising the amino acid sequence SEQ ID NO: 1162, and c. CDR-H3, comprising the amino acid sequence SEQ ID NO: 1704.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 349. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 349. In some embodiments, the substitutions, insertions, or deletions occur in regions outside the CDRs (e.g., in the FRs). Optionally, the antibody or antigen-binding fragment thereof comprises the VL sequence SEQ ID NO: 349, including one or more post-translational modifications of that sequence. In a particular embodiment, the VL comprises one, two or three CDRs selected from: a. CDR-L1, comprising the amino acid sequence SEQ ID NO: 891, b. CDR-L2, comprising the amino acid sequence SEQ ID NO: 1433, and c. CDR-L3, comprising the amino acid sequence SEQ ID NO: 1975.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 78, and the VL amino acid sequence of SEQ ID NO: 349, optionally including post-translational modifications of those sequences.

TCHO1001

In one aspect, the present disclosure provides an antibody or antigen-binding fragment thereof comprising at least one or both variable regions selected from: a. VH comprising the amino acid sequence of SEQ ID NO: 79 and b. VL comprising the amino acid sequence of SEQ ID NO: 350.

In one aspect, the present disclosure provides an antibody or antigen-binding fragment thereof comprising at least one, two, three, four, five, or six CDRs selected from: a. CDR-H1 comprising the amino acid sequence of SEQ ID NO: 621, b. CDR-H2 comprising the amino acid sequence of SEQ ID NO: 1163, c. CDR-H3 comprising the amino acid sequence of SEQ ID NO: 1705, d. CDR-L1 comprising the amino acid sequence of SEQ ID NO: 892, e. CDR-L2 comprising the amino acid sequence of SEQ ID NO: 1434, and f. CDR-L3 comprising the amino acid sequence of SEQ ID NO: 1976.

In one aspect, the present disclosure provides an antibody or antigen-binding fragment thereof comprising a CDR-H3 comprising the amino acid sequence of SEQ ID NO: 1705, and a CDR-L3 comprising the amino acid sequence of SEQ ID NO: 1976.

In one aspect, the present disclosure provides an antibody or antigen-binding fragment thereof comprising: a. CDR-H1 comprising the amino acid sequence of SEQ ID NO: 621, b. CDR-H2 comprising the amino acid sequence of SEQ ID NO: 1163, c. CDR-H3 comprising the amino acid sequence of SEQ ID NO: 1705, d. CDR-L1 comprising the amino acid sequence of SEQ ID NO: 892, e. CDR-L2 comprising the amino acid sequence of SEQ ID NO: 1434, and f. CDR-L3 comprising the amino acid sequence of SEQ ID NO: 1976.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 621, b. CDR-H2 comprising the amino acid sequence of SEQ ID NO: 1163, c. CDR-H3 comprising the amino acid sequence of SEQ ID NO: 1705, and a VL comprising the amino acid sequence of SEQ ID NO: 350.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 892, b. CDR-L2 comprising the amino acid sequence of SEQ ID NO: 1434, c. CDR-L3 comprising the amino acid sequence of SEQ ID NO: 1976, and a VH comprising the amino acid sequence of SEQ ID NO: 79.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 79. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 79. In some embodiments, substitutions, insertions, or deletions occur in regions outside the CDRs (e.g., in the FRs). Optionally, the antibody or antigen-binding fragment thereof comprises the VH sequence SEQ ID NO: 79, including one or more post-translational modifications of that sequence. In a particular embodiment, the VH comprises one, two or three CDRs selected from: a. CDR-H1, comprising the amino acid sequence SEQ ID NO: 621, b. CDR-H2, comprising the amino acid sequence SEQ ID NO: 1163, and c. CDR-H3, comprising the amino acid sequence SEQ ID NO: 1705.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 350. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 350. In some embodiments, the substitutions, insertions, or deletions occur in regions outside the CDRs (e.g., in the FRs). Optionally, the antibody or antigen-binding fragment thereof comprises the VL sequence SEQ ID NO: 350, including one or more post-translational modifications of that sequence. In a particular embodiment, the VL comprises one, two or three CDRs selected from: a. CDR-L1, comprising the amino acid sequence SEQ ID NO: 892, b. CDR-L2, comprising the amino acid sequence SEQ ID NO: 1434, and c. CDR-L3, comprising the amino acid sequence SEQ ID NO: 1976.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 79, and the VL amino acid sequence of SEQ ID NO: 350, optionally including post-translational modifications of those sequences.

TCOL1001

In one aspect, the present disclosure provides an antibody or antigen-binding fragment thereof comprising at least one or both variable regions selected from: a. VH comprising the amino acid sequence of SEQ ID NO: 80 and b. VL comprising the amino acid sequence of SEQ ID NO: 351.

In one aspect, the present disclosure provides an antibody or antigen-binding fragment thereof comprising at least one, two, three, four, five, or six CDRs selected from: a. CDR-H1 comprising the amino acid sequence of SEQ ID NO: 622, b. CDR-H2 comprising the amino acid sequence of SEQ ID NO: 1164, c. CDR-H3 comprising the amino acid sequence of SEQ ID NO: 1706, d. CDR-L1 comprising the amino acid sequence of SEQ ID NO: 893, e. CDR-L2 comprising the amino acid sequence of SEQ ID NO: 1435, and f. CDR-L3 comprising the amino acid sequence of SEQ ID NO: 1977.

In one aspect, the present disclosure provides an antibody or antigen-binding fragment thereof comprising a CDR-H3 comprising the amino acid sequence of SEQ ID NO: 1706, and a CDR-L3 comprising the amino acid sequence of SEQ ID NO: 1977.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 622, b. CDR-H2 comprising the amino acid sequence of SEQ ID NO: 1164, c. CDR-H3 comprising the amino acid sequence of SEQ ID NO: 1706, and a VL comprising the amino acid sequence of SEQ ID NO: 351.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 893, b. CDR-L2 comprising the amino acid sequence of SEQ ID NO: 1435, c. CDR-L3 comprising the amino acid sequence of SEQ ID NO: 1977, and a VH comprising the amino acid sequence of SEQ ID NO: 80.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 80. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 80. In some embodiments, substitutions, insertions, or deletions occur in regions outside the CDRs (e.g., in the FRs). Optionally, the antibody or antigen-binding fragment thereof comprises the VH sequence SEQ ID NO: 80, including one or more post-translational modifications of that sequence. In a particular embodiment, the VH comprises one, two or three CDRs selected from: a CDR-H1, comprising the amino acid sequence SEQ ID NO: 622, b. CDR-H2, comprising the amino acid sequence SEQ ID NO: 1164, and c. CDR-H3, comprising the amino acid sequence SEQ ID NO: 1706.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 351. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 351. In some embodiments, the substitutions, insertions, or deletions occur in regions outside the CDRs (e.g., in the FRs). Optionally, the antibody or antigen-binding fragment thereof comprises the VL sequence SEQ ID NO: 351, including one or more post-translational modifications of that sequence. In a particular embodiment, the VL comprises one, two or three CDRs selected from: a. CDR-L1, comprising the amino acid sequence SEQ ID NO: 893, b. CDR-L2, comprising the amino acid sequence SEQ ID NO: 1435, and c. CDR-L3, comprising the amino acid sequence SEQ ID NO: 1977.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 80, and the VL amino acid sequence of SEQ ID NO: 351, optionally including post-translational modifications of those sequences.
TCOL1002

In one aspect, the present disclosure provides an antibody or antigen-binding fragment thereof comprising at least one or both variable regions selected from: a. VH comprising the amino acid sequence of SEQ ID NO: 81 and b. VL comprising the amino acid sequence of SEQ ID NO: 352.

In one aspect, the present disclosure provides an antibody or antigen-binding fragment thereof comprising at least one, two, three, four, five, or six CDRs selected from: a. CDR-H1 comprising the amino acid sequence of SEQ ID NO: 623, b. CDR-H2 comprising the amino acid sequence of SEQ ID NO: 1165, c. CDR-H3 comprising the amino acid sequence of SEQ ID NO: 1707, d. CDR-L1 comprising the amino acid sequence of SEQ ID NO: 894, e. CDR-L2 comprising the amino acid sequence of SEQ ID NO: 1436, and f. CDR-L3 comprising the amino acid sequence of SEQ ID NO: 1978.

In one aspect, the present disclosure provides an antibody or antigen-binding fragment thereof comprising a CDR-H3 comprising the amino acid sequence of SEQ ID NO: 1707, and a CDR-L3 comprising the amino acid sequence of SEQ ID NO: 1978.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 623, b. CDR-H2 comprising the amino acid sequence of SEQ ID NO: 1165, c. CDR-H3 comprising the amino acid sequence of SEQ ID NO: 1707, and a VL comprising the amino acid sequence of SEQ ID NO: 352.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 894, b. CDR-L2 comprising the amino acid sequence of SEQ ID NO: 1436, c. CDR-L3 comprising the amino acid sequence of SEQ ID NO: 1978, and a VH comprising the amino acid sequence of SEQ ID NO: 81.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 81. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 81. In some embodiments, substitutions, insertions, or deletions occur in regions outside the CDRs (e.g., in the FRs). Optionally, the antibody or antigen-binding fragment thereof comprises the VH sequence SEQ ID NO: 81, including one or more post-translational modifications of that sequence. In a particular embodiment, the VH comprises one, two or three CDRs selected from: a. CDR-H1, comprising the amino acid sequence SEQ ID NO: 623, b. CDR-H2, comprising the amino acid sequence SEQ ID NO: 1165, and c. CDR-H3, comprising the amino acid sequence SEQ ID NO: 1707.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 352. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 352. In some embodiments, the substitutions, insertions, or deletions occur in regions outside the CDRs (e.g., in the FRs). Optionally, the antibody or antigen-binding fragment thereof comprises the VL sequence SEQ ID NO: 352, including one or more post-translational modifications of that sequence. In a particular embodiment, the VL comprises one, two or three CDRs selected from: a. CDR-L1, comprising the amino acid sequence SEQ ID NO: 894, b. CDR-L2, comprising the amino acid sequence SEQ ID NO: 1436, and c. CDR-L3, comprising the amino acid sequence SEQ ID NO: 1978.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 81, and the VL amino acid sequence of SEQ ID NO: 352, optionally including post-translational modifications of those sequences.

TCOL1003

In one aspect, the present disclosure provides an antibody or antigen-binding fragment thereof comprising at least one or both variable regions selected from: a. VH comprising the amino acid sequence of SEQ ID NO: 82 and b. VL comprising the amino acid sequence of SEQ ID NO: 353.

In one aspect, the present disclosure provides an antibody or antigen-binding fragment thereof comprising at least one, two, three, four, five, or six CDRs selected from: a. CDR-H1 comprising the amino acid sequence of SEQ ID NO: 624, b. CDR-H2 comprising the amino acid sequence of SEQ ID NO: 1166, c. CDR-H3 comprising the amino acid sequence of SEQ ID NO: 1708, d. CDR-L1 comprising the amino acid sequence of SEQ ID NO: 895, e. CDR-L2 comprising the amino acid sequence of SEQ ID NO: 1437, and f. CDR-L3 comprising the amino acid sequence of SEQ ID NO: 1979. In one aspect, the present disclosure provides an antibody or antigen-binding fragment thereof comprising a CDR-H3 comprising the amino acid sequence of SEQ ID NO: 1708, and a CDR-L3 comprising the amino acid sequence of SEQ ID NO: 1979.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 624, b. CDR-H2 comprising the amino acid sequence of SEQ ID NO: 1166, c. CDR-H3 comprising the amino acid sequence of SEQ ID NO: 1708, and a VL comprising the amino acid sequence of SEQ ID NO: 353.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 895, b. CDR-L2 comprising the amino acid sequence of SEQ ID NO: 1437, c. CDR-L3 comprising the amino acid sequence of SEQ ID NO: 1979, and a VH comprising the amino acid sequence of SEQ ID NO: 82.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 82. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 82. In some embodiments, substitutions, insertions, or deletions occur in regions outside the CDRs (e.g., in the FRs). Optionally, the antibody or antigen-binding fragment thereof comprises the VH sequence SEQ ID NO: 82, including one or more post-translational modifications of that sequence. In a particular embodiment, the VH comprises one, two or three CDRs selected from: a. CDR-H1, comprising the amino acid sequence SEQ ID NO: 624, b. CDR-H2, comprising the amino acid sequence SEQ ID NO: 1166, and c. CDR-H3, comprising the amino acid sequence SEQ ID NO: 1708.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 353. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 353. In some embodiments, the substitutions, insertions, or deletions occur in regions outside the CDRs (e.g., in the FRs). Optionally, the antibody or antigen-binding fragment thereof comprises the VL sequence SEQ ID NO: 353, including one or more post-translational modifications of that sequence. In a particular embodiment, the VL comprises one, two or three CDRs selected from: a. CDR-L1, comprising the amino acid sequence SEQ ID NO: 895, b. CDR-L2, comprising the amino acid sequence SEQ ID NO: 1437, and c. CDR-L3, comprising the amino acid sequence SEQ ID NO: 1979.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 82, and the VL amino acid sequence of SEQ ID NO: 353, optionally including post-translational modifications of those sequences.

TCOL1004

In one aspect, the present disclosure provides an antibody or antigen-binding fragment thereof comprising at least one or both variable regions selected from: a. VH comprising the amino acid sequence of SEQ ID NO: 83 and b. VL comprising the amino acid sequence of SEQ ID NO: 354.

In one aspect, the present disclosure provides an antibody or antigen-binding fragment thereof comprising at least one, two, three, four, five, or six CDRs selected from: a. CDR-H1 comprising the amino acid sequence of SEQ ID NO: 625, b. CDR-H2 comprising the amino acid sequence of SEQ ID NO: 1167, c. CDR-H3 comprising the amino acid sequence of SEQ ID NO: 1709, d. CDR-L1 comprising the amino acid sequence of SEQ ID NO: 896, e. CDR-L2 comprising the amino acid sequence of SEQ ID NO: 1438, and f. CDR-L3 comprising the amino acid sequence of SEQ ID NO: 1980. In one aspect, the present disclosure provides an antibody or antigen-binding fragment thereof comprising a CDR-H3 comprising the amino acid sequence of SEQ ID NO: 1709, and a CDR-L3 comprising the amino acid sequence of SEQ ID NO: 1980.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 625, b. CDR-H2 comprising the amino acid sequence of SEQ ID NO: 1167, c. CDR-H3 comprising the amino acid sequence of SEQ ID NO: 1709, and a VL comprising the amino acid sequence of SEQ ID NO: 354.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 896, b. CDR-L2 comprising the amino acid sequence of SEQ ID NO: 1438, c. CDR-L3 comprising the amino acid sequence of SEQ ID NO: 1980, and a VH comprising the amino acid sequence of SEQ ID NO: 83.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 83. In some embodiments, a VH sequence having at least 90%, 91%, 92%, 93%, 94%, 95%, 96%, 97%, 98%, or 99% identity contains substitutions (e.g., conservative substitutions), thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 83. In some embodiments, substitutions, insertions, or deletions occur in regions outside the CDRs (e.g., in the FRs). Optionally, the antibody or antigen-binding fragment thereof comprises the VH sequence SEQ ID NO: 83, including one or more post-translational modifications of that sequence. In a particular embodiment, the VH comprises one, two or three CDRs selected from: a. CDR-H1, comprising the amino acid sequence SEQ ID NO: 625, b. CDR-H2, comprising the amino acid sequence SEQ ID NO: 1167, and c. CDR-H3, comprising the amino acid sequence SEQ ID NO: 1709.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 354. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 354. In some embodiments, the substitutions, insertions, or deletions occur in regions outside the CDRs (e.g., in the FRs). Optionally, the antibody or antigen-binding fragment thereof comprises the VL sequence SEQ ID NO: 354, including one or more post-translational modifications of that sequence. In a particular embodiment, the VL comprises one, two or three CDRs selected from: a. CDR-L1, comprising the amino acid sequence SEQ ID NO: 896, b. CDR-L2, comprising the amino acid sequence SEQ ID NO: 1438, and c. CDR-L3, comprising the amino acid sequence SEQ ID NO: 1980.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 83, and the VL amino acid sequence of SEQ ID NO: 354, optionally including post-translational modifications of those sequences.

TCOL1005

In one aspect, the present disclosure provides an antibody or antigen-binding fragment thereof comprising at least one or both variable regions selected from: a. VH comprising the amino acid sequence of SEQ ID NO: 84 and b. VL comprising the amino acid sequence of SEQ ID NO: 355.

In one aspect, the present disclosure provides an antibody or antigen-binding fragment thereof comprising at least one, two, three, four, five, or six CDRs selected from: a. CDR-H1 comprising the amino acid sequence of SEQ ID NO: 626, b. CDR-H2 comprising the amino acid sequence of SEQ ID NO: 1168, c. CDR-H3 comprising the amino acid sequence of SEQ ID NO: 1710, d. CDR-L1 comprising the amino acid sequence of SEQ ID NO: 897, e. CDR-L2 comprising the amino acid sequence of SEQ ID NO: 1439, and f. CDR-L3 comprising the amino acid sequence of SEQ ID NO: 1981. In one aspect, the present disclosure provides an antibody or antigen-binding fragment thereof comprising a CDR-H3 comprising the amino acid sequence of SEQ ID NO: 1710, and a CDR-L3 comprising the amino acid sequence of SEQ ID NO: 1981.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 626, b. CDR-H2 comprising the amino acid sequence of SEQ ID NO: 1168, c. CDR-H3 comprising the amino acid sequence of SEQ ID NO: 1710, and a VL comprising the amino acid sequence of SEQ ID NO: 355.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 897, b. CDR-L2 comprising the amino acid sequence of SEQ ID NO: 1439, c. CDR-L3 comprising the amino acid sequence of SEQ ID NO: 1981, and a VH comprising the amino acid sequence of SEQ ID NO: 84.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 84. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 84. In some embodiments, substitutions, insertions, or deletions occur in regions outside the CDRs (e.g., in the FRs). Optionally, the antibody or antigen-binding fragment thereof comprises the VH sequence SEQ ID NO: 84, including one or more post-translational modifications of that sequence. In a particular embodiment, the VH comprises one, two or three CDRs selected from: a. CDR-H1, comprising the amino acid sequence SEQ ID NO: 626, b. CDR-H2, comprising the amino acid sequence SEQ ID NO: 1168, and c. CDR-H3, comprising the amino acid sequence SEQ ID NO: 1710.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 355. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 355. In some embodiments, the substitutions, insertions, or deletions occur in regions outside the CDRs (e.g., in the FRs). Optionally, the antibody or antigen-binding fragment thereof comprises the VL sequence SEQ ID NO: 355, including one or more post-translational modifications of that sequence. In a particular embodiment, the VL comprises one, two or three CDRs selected from: a. CDR-L1, comprising the amino acid sequence SEQ ID NO: 897, b. CDR-L2, comprising the amino acid sequence SEQ ID NO: 1439, and c. CDR-L3, comprising the amino acid sequence SEQ ID NO: 1981.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 84, and the VL amino acid sequence of SEQ ID NO: 355, optionally including post-translational modifications of those sequences.
TCOL1006

In one aspect, the present disclosure provides an antibody or antigen-binding fragment thereof comprising at least one or both variable regions selected from: a. VH comprising the amino acid sequence of SEQ ID NO: 85 and b. VL comprising the amino acid sequence of SEQ ID NO: 356.

In one aspect, the present disclosure provides an antibody or antigen-binding fragment thereof comprising at least one, two, three, four, five, or six CDRs selected from: a. CDR-H1 comprising the amino acid sequence of SEQ ID NO: 627, b. CDR-H2 comprising the amino acid sequence of SEQ ID NO: 1169, c. CDR-H3 comprising the amino acid sequence of SEQ ID NO: 1711, d. CDR-L1 comprising the amino acid sequence of SEQ ID NO: 898, e. CDR-L2 comprising the amino acid sequence of SEQ ID NO: 1440, and f. CDR-L3 comprising the amino acid sequence of SEQ ID NO: 1982.

In one aspect, the present disclosure provides an antibody or antigen-binding fragment thereof comprising a CDR-H3 comprising the amino acid sequence of SEQ ID NO: 1711, and a CDR-L3 comprising the amino acid sequence of SEQ ID NO: 1982.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 627, b. CDR-H2 comprising the amino acid sequence of SEQ ID NO: 1169, c. CDR-H3 comprising the amino acid sequence of SEQ ID NO: 1711, and a VL comprising the amino acid sequence of SEQ ID NO: 356.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 898, b. CDR-L2 comprising the amino acid sequence of SEQ ID NO: 1440, c. CDR-L3 comprising the amino acid sequence of SEQ ID NO: 1982, and a VH comprising the amino acid sequence of SEQ ID NO: 85.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 85. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 85. In some embodiments, substitutions, insertions, or deletions occur in regions outside the CDRs (e.g., in the FRs). Optionally, the antibody or antigen-binding fragment thereof comprises the VH sequence SEQ ID NO: 85, including one or more post-translational modifications of that sequence. In a particular embodiment, the VH comprises one, two or three CDRs selected from: a. CDR-H1, comprising the amino acid sequence SEQ ID NO: 627, b. CDR-H2, comprising the amino acid sequence SEQ ID NO: 1169, and c. CDR-H3, comprising the amino acid sequence SEQ ID NO: 1711.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 356. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 356. In some embodiments, the substitutions, insertions, or deletions occur in regions outside the CDRs (e.g., in the FRs). Optionally, the antibody or antigen-binding fragment thereof comprises the VL sequence SEQ ID NO: 356, including one or more post-translational modifications of that sequence. In a particular embodiment, the VL comprises one, two or three CDRs selected from: a. CDR-L1, comprising the amino acid sequence SEQ ID NO: 898, b. CDR-L2, comprising the amino acid sequence SEQ ID NO: 1440, and c. CDR-L3, comprising the amino acid sequence SEQ ID NO: 1982.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 85, and the VL amino acid sequence of SEQ ID NO: 356, optionally including post-translational modifications of those sequences.
TCOL1007

In one aspect, the present disclosure provides an antibody or antigen-binding fragment thereof comprising at least one or both variable regions selected from: a. VH comprising the amino acid sequence of SEQ ID NO: 86 and b. VL comprising the amino acid sequence of SEQ ID NO: 357.

In one aspect, the present disclosure provides an antibody or antigen-binding fragment thereof comprising at least one, two, three, four, five, or six CDRs selected from: a. CDR-H1 comprising the amino acid sequence of SEQ ID NO: 628, b. CDR-H2 comprising the amino acid sequence of SEQ ID NO: 1170, c. CDR-H3 comprising the amino acid sequence of SEQ ID NO: 1712, d. CDR-L1 comprising the amino acid sequence of SEQ ID NO: 899, e. CDR-L2 comprising the amino acid sequence of SEQ ID NO: 1441, and f. CDR-L3 comprising the amino acid sequence of SEQ ID NO: 1983.

In one aspect, the present disclosure provides an antibody or antigen-binding fragment thereof comprising a CDR-H3 comprising the amino acid sequence of SEQ ID NO: 1712, and a CDR-L3 comprising the amino acid sequence of SEQ ID NO: 1983.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 628, b. CDR-H2 comprising the amino acid sequence of SEQ ID NO: 1170, c. CDR-H3 comprising the amino acid sequence of SEQ ID NO: 1712, and a VL comprising the amino acid sequence of SEQ ID NO: 357.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 899, b. CDR-L2 comprising the amino acid sequence of SEQ ID NO: 1441, c. CDR-L3 comprising the amino acid sequence of SEQ ID NO: 1983, and a VH comprising the amino acid sequence of SEQ ID NO: 86.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 86. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 86. In some embodiments, substitutions, insertions, or deletions occur in regions outside the CDRs (e.g., in the FRs). Optionally, the antibody or antigen-binding fragment thereof comprises the VH sequence SEQ ID NO: 86, including one or more post-translational modifications of that sequence. In a particular embodiment, the VH comprises one, two or three CDRs selected from: a. CDR-H1, comprising the amino acid sequence SEQ ID NO: 628, b. CDR-H2, comprising the amino acid sequence SEQ ID NO: 1170, and c. CDR-H3, comprising the amino acid sequence SEQ ID NO: 1712.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 357. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 357. In some embodiments, the substitutions, insertions, or deletions occur in regions outside the CDRs (e.g., in the FRs). Optionally, the antibody or antigen-binding fragment thereof comprises the VL sequence SEQ ID NO: 357, including one or more post-translational modifications of that sequence. In a particular embodiment, the VL comprises one, two or three CDRs selected from: a. CDR-L1, comprising the amino acid sequence SEQ ID NO: 899, b. CDR-L2, comprising the amino acid sequence SEQ ID NO: 1441, and c. CDR-L3, comprising the amino acid sequence SEQ ID NO: 1983.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 86, and the VL amino acid sequence of SEQ ID NO: 357, optionally including post-translational modifications of those sequences.
TCOL1008

In one aspect, the present disclosure provides an antibody or antigen-binding fragment thereof comprising at least one or both variable regions selected from: a. VH comprising the amino acid sequence of SEQ ID NO: 87 and b. VL comprising the amino acid sequence of SEQ ID NO: 358.

In one aspect, the present disclosure provides an antibody or antigen-binding fragment thereof comprising at least one, two, three, four, five, or six CDRs selected from: a. CDR-H1 comprising the amino acid sequence of SEQ ID NO: 629, b. CDR-H2 comprising the amino acid sequence of SEQ ID NO: 1171, c. CDR-H3 comprising the amino acid sequence of SEQ ID NO: 1713, d. CDR-L1 comprising the amino acid sequence of SEQ ID NO: 900, e. CDR-L2 comprising the amino acid sequence of SEQ ID NO: 1442, and f. CDR-L3 comprising the amino acid sequence of SEQ ID NO: 1984.

In one aspect, the present disclosure provides an antibody or antigen-binding fragment thereof comprising a CDR-H3 comprising the amino acid sequence of SEQ ID NO: 1713, and a CDR-L3 comprising the amino acid sequence of SEQ ID NO: 1984.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 629, b. CDR-H2 comprising the amino acid sequence of SEQ ID NO: 1171, c. CDR-H3 comprising the amino acid sequence of SEQ ID NO: 1713, and a VL comprising the amino acid sequence of SEQ ID NO: 358.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 900, b. CDR-L2 comprising the amino acid sequence of SEQ ID NO: 1442, c. CDR-L3 comprising the amino acid sequence of SEQ ID NO: 1984, and a VH comprising the amino acid sequence of SEQ ID NO: 87.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 87. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 87. In some embodiments, substitutions, insertions, or deletions occur in regions outside the CDRs (e.g., in the FRs). Optionally, the antibody or antigen-binding fragment thereof comprises the VH sequence SEQ ID NO: 87, including one or more post-translational modifications of that sequence. In a particular embodiment, the VH comprises one, two or three CDRs selected from: a. CDR-H1, comprising the amino acid sequence SEQ ID NO: 629, b. CDR-H2, comprising the amino acid sequence SEQ ID NO: 1171, and c. CDR-H3, comprising the amino acid sequence SEQ ID NO: 1713.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 358. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 358. In some embodiments, the substitutions, insertions, or deletions occur in regions outside the CDRs (e.g., in the FRs). Optionally, the antibody or antigen-binding fragment thereof comprises the VL sequence SEQ ID NO: 358, including one or more post-translational modifications of that sequence. In a particular embodiment, the VL comprises one, two or three CDRs selected from: a. CDR-L1, comprising the amino acid sequence SEQ ID NO: 900, b. CDR-L2, comprising the amino acid sequence SEQ ID NO: 1442, and c. CDR-L3, comprising the amino acid sequence SEQ ID NO: 1984.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 87, and the VL amino acid sequence of SEQ ID NO: 358, optionally including post-translational modifications of those sequences.

TCOL1009

In one aspect, the present disclosure provides an antibody or antigen-binding fragment thereof comprising at least one or both variable regions selected from: a. VH comprising the amino acid sequence of SEQ ID NO: 88 and b. VL comprising the amino acid sequence of SEQ ID NO: 359.

In one aspect, the present disclosure provides an antibody or antigen-binding fragment thereof comprising at least one, two, three, four, five, or six CDRs selected from: a. CDR-H1 comprising the amino acid sequence of SEQ ID NO: 630, b. CDR-H2 comprising the amino acid sequence of SEQ ID NO: 1172, c. CDR-H3 comprising the amino acid sequence of SEQ ID NO: 1714, d. CDR-L1 comprising the amino acid sequence of SEQ ID NO: 901, e. CDR-L2 comprising the amino acid sequence of SEQ ID NO: 1443, and f. CDR-L3 comprising the amino acid sequence of SEQ ID NO: 1985.

In one aspect, the present disclosure provides an antibody or antigen-binding fragment thereof comprising a CDR-H3 comprising the amino acid sequence of SEQ ID NO: 1714, and a CDR-L3 comprising the amino acid sequence of SEQ ID NO: 1985.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 630, b. CDR-H2 comprising the amino acid sequence of SEQ ID NO: 1172, c. CDR-H3 comprising the amino acid sequence of SEQ ID NO: 1714, and a VL comprising the amino acid sequence of SEQ ID NO: 359.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 901, b. CDR-L2 comprising the amino acid sequence of SEQ ID NO: 1443, c. CDR-L3 comprising the amino acid sequence of SEQ ID NO: 1985, and a VH comprising the amino acid sequence of SEQ ID NO: 88.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 88. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 88. In some embodiments, substitutions, insertions, or deletions occur in regions outside the CDRs (e.g., in the FRs). Optionally, the antibody or antigen-binding fragment thereof comprises the VH sequence SEQ ID NO: 88, including one or more post-translational modifications of that sequence. In a particular embodiment, the VH comprises one, two or three CDRs selected from: a. CDR-H1, comprising the amino acid sequence SEQ ID NO: 630, b. CDR-H2, comprising the amino acid sequence SEQ ID NO: 1172, and c. CDR-H3, comprising the amino acid sequence SEQ ID NO: 1714.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 359. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 359. In some embodiments, the substitutions, insertions, or deletions occur in regions outside the CDRs (e.g., in the FRs). Optionally, the antibody or antigen-binding fragment thereof comprises the VL sequence SEQ ID NO: 359, including one or more post-translational modifications of that sequence. In a particular embodiment, the VL comprises one, two or three CDRs selected from: a. CDR-L1, comprising the amino acid sequence SEQ ID NO: 901, b. CDR-L2, comprising the amino acid sequence SEQ ID NO: 1443, and c. CDR-L3, comprising the amino acid sequence SEQ ID NO: 1985.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 88, and the VL amino acid sequence of SEQ ID NO: 359, optionally including post-translational modifications of those sequences.
TESO1001

In one aspect, the present disclosure provides an antibody or antigen-binding fragment thereof comprising at least one or both variable regions selected from: a. VH comprising the amino acid sequence of SEQ ID NO: 89 and b. VL comprising the amino acid sequence of SEQ ID NO: 360.

In one aspect, the present disclosure provides an antibody or antigen-binding fragment thereof comprising at least one, two, three, four, five, or six CDRs selected from: a. CDR-H1 comprising the amino acid sequence of SEQ ID NO: 631, b. CDR-H2 comprising the amino acid sequence of SEQ ID NO: 1173, c. CDR-H3 comprising the amino acid sequence of SEQ ID NO: 1715, d. CDR-L1 comprising the amino acid sequence of SEQ ID NO: 902, e. CDR-L2 comprising the amino acid sequence of SEQ ID NO: 1444, and f. CDR-L3 comprising the amino acid sequence of SEQ ID NO: 1986.

In one aspect, the present disclosure provides an antibody or antigen-binding fragment thereof comprising a CDR-H3 comprising the amino acid sequence of SEQ ID NO: 1715, and a CDR-L3 comprising the amino acid sequence of SEQ ID NO: 1986.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 631, b. CDR-H2 comprising the amino acid sequence of SEQ ID NO: 1173, c. CDR-H3 comprising the amino acid sequence of SEQ ID NO: 1715, and a VL comprising the amino acid sequence of SEQ ID NO: 360.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 902, b. CDR-L2 comprising the amino acid sequence of SEQ ID NO: 1444, c. CDR-L3 comprising the amino acid sequence of SEQ ID NO: 1986, and a VH comprising the amino acid sequence of SEQ ID NO: 89.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 89. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 89. In some embodiments, substitutions, insertions, or deletions occur in regions outside the CDRs (e.g., in the FRs). Optionally, the antibody or antigen-binding fragment thereof comprises the VH sequence SEQ ID NO: 89, including one or more post-translational modifications of that sequence. In a particular embodiment, the VH comprises one, two or three CDRs selected from: a. CDR-H1, comprising the amino acid sequence SEQ ID NO: 631, b. CDR-H2, comprising the amino acid sequence SEQ ID NO: 1173, and c. CDR-H3, comprising the amino acid sequence SEQ ID NO: 1715.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 360. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 360. In some embodiments, the substitutions, insertions, or deletions occur in regions outside the CDRs (e.g., in the FRs). Optionally, the antibody or antigen-binding fragment thereof comprises the VL sequence SEQ ID NO: 360, including one or more post-translational modifications of that sequence. In a particular embodiment, the VL comprises one, two or three CDRs selected from: a. CDR-L1, comprising the amino acid sequence SEQ ID NO: 902, b. CDR-L2, comprising the amino acid sequence SEQ ID NO: 1444, and c. CDR-L3, comprising the amino acid sequence SEQ ID NO: 1986.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 89, and the VL amino acid sequence of SEQ ID NO: 360, optionally including post-translational modifications of those sequences.

TESO1002

In one aspect, the present disclosure provides an antibody or antigen-binding fragment thereof comprising at least one or both variable regions selected from: a. VH comprising the amino acid sequence of SEQ ID NO: 90 and b. VL comprising the amino acid sequence of SEQ ID NO: 361.

In one aspect, the present disclosure provides an antibody or antigen-binding fragment thereof comprising at least one, two, three, four, five, or six CDRs selected from: a. CDR-H1 comprising the amino acid sequence of SEQ ID NO: 632, b. CDR-H2 comprising the amino acid sequence of SEQ ID NO: 1174, c. CDR-H3 comprising the amino acid sequence of SEQ ID NO: 1716, d. CDR-L1 comprising the amino acid sequence of SEQ ID NO: 903, e. CDR-L2 comprising the amino acid sequence of SEQ ID NO: 1445, and f. CDR-L3 comprising the amino acid sequence of SEQ ID NO: 1987.

In one aspect, the present disclosure provides an antibody or antigen-binding fragment thereof comprising a CDR-H3 comprising the amino acid sequence of SEQ ID NO: 1716, and a CDR-L3 comprising the amino acid sequence of SEQ ID NO: 1987.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 632, b. CDR-H2 comprising the amino acid sequence of SEQ ID NO: 1174, c. CDR-H3 comprising the amino acid sequence of SEQ ID NO: 1716, and a VL comprising the amino acid sequence of SEQ ID NO: 361.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 903, b. CDR-L2 comprising the amino acid sequence of SEQ ID NO: 1445, c. CDR-L3 comprising the amino acid sequence of SEQ ID NO: 1987, and a VH comprising the amino acid sequence of SEQ ID NO: 90.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 90. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 90. In some embodiments, substitutions, insertions, or deletions occur in regions outside the CDRs (e.g., in the FRs). Optionally, the antibody or antigen-binding fragment thereof comprises the VH sequence SEQ ID NO: 90, including one or more post-translational modifications of that sequence. In a particular embodiment, the VH comprises one, two or three CDRs selected from: a. CDR-H1, comprising the amino acid sequence SEQ ID NO: 632, b. CDR-H2, comprising the amino acid sequence SEQ ID NO: 1174, and c. CDR-H3, comprising the amino acid sequence SEQ ID NO: 1716.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 361. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 361. In some embodiments, the substitutions, insertions, or deletions occur in regions outside the CDRs (e.g., in the FRs). Optionally, the antibody or antigen-binding fragment thereof comprises the VL sequence SEQ ID NO: 361, including one or more post-translational modifications of that sequence. In a particular embodiment, the VL comprises one, two or three CDRs selected from: a. CDR-L1, comprising the amino acid sequence SEQ ID NO: 903, b. CDR-L2, comprising the amino acid sequence SEQ ID NO: 1445, and c. CDR-L3, comprising the amino acid sequence SEQ ID NO: 1987.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 90, and the VL amino acid sequence of SEQ ID NO: 361, optionally including post-translational modifications of those sequences.

TESO1003

In one aspect, the present disclosure provides an antibody or antigen-binding fragment thereof comprising at least one or both variable regions selected from: a. VH comprising the amino acid sequence of SEQ ID NO: 91 and b. VL comprising the amino acid sequence of SEQ ID NO: 362.

In one aspect, the present disclosure provides an antibody or antigen-binding fragment thereof comprising at least one, two, three, four, five, or six CDRs selected from: a. CDR-H1 comprising the amino acid sequence of SEQ ID NO: 633, b. CDR-H2 comprising the amino acid sequence of SEQ ID NO: 1175, c. CDR-H3 comprising the amino acid sequence of SEQ ID NO: 1717, d. CDR-L1 comprising the amino acid sequence of SEQ ID NO: 904, e. CDR-L2 comprising the amino acid sequence of SEQ ID NO: 1446, and f. CDR-L3 comprising the amino acid sequence of SEQ ID NO: 1988.

In one aspect, the present disclosure provides an antibody or antigen-binding fragment thereof comprising a CDR-H3 comprising the amino acid sequence of SEQ ID NO: 1717, and a CDR-L3 comprising the amino acid sequence of SEQ ID NO: 1988.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 633, b. CDR-H2 comprising the amino acid sequence of SEQ ID NO: 1175, c. CDR-H3 comprising the amino acid sequence of SEQ ID NO: 1717, and a VL comprising the amino acid sequence of SEQ ID NO: 362.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 904, b. CDR-L2 comprising the amino acid sequence of SEQ ID NO: 1446, c. CDR-L3 comprising the amino acid sequence of SEQ ID NO: 1988, and a VH comprising the amino acid sequence of SEQ ID NO: 91.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 91. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 91. In some embodiments, substitutions, insertions, or deletions occur in regions outside the CDRs (e.g., in the FRs). Optionally, the antibody or antigen-binding fragment thereof comprises the VH sequence SEQ ID NO: 91, including one or more post-translational modifications of that sequence. In a particular embodiment, the VH comprises one, two or three CDRs selected from: a. CDR-H1, comprising the amino acid sequence SEQ ID NO: 633, b. CDR-H2, comprising the amino acid sequence SEQ ID NO: 1175, and c. CDR-H3, comprising the amino acid sequence SEQ ID NO: 1717.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 362. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 362. In some embodiments, the substitutions, insertions, or deletions occur in regions outside the CDRs (e.g., in the FRs). Optionally, the antibody or antigen-binding fragment thereof comprises the VL sequence SEQ ID NO: 362, including one or more post-translational modifications of that sequence. In a particular embodiment, the VL comprises one, two or three CDRs selected from: a. CDR-L1, comprising the amino acid sequence SEQ ID NO: 904, b. CDR-L2, comprising the amino acid sequence SEQ ID NO: 1446, and c. CDR-L3, comprising the amino acid sequence SEQ ID NO: 1988.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 91, and the VL amino acid sequence of SEQ ID NO: 362, optionally including post-translational modifications of those sequences.
TESO1004

In one aspect, the present disclosure provides an antibody or antigen-binding fragment thereof comprising at least one or both variable regions selected from: a. VH comprising the amino acid sequence of SEQ ID NO: 92 and b. VL comprising the amino acid sequence of SEQ ID NO: 363.

In one aspect, the present disclosure provides an antibody or antigen-binding fragment thereof comprising at least one, two, three, four, five, or six CDRs selected from: a. CDR-H1 comprising the amino acid sequence of SEQ ID NO: 634, b. CDR-H2 comprising the amino acid sequence of SEQ ID NO: 1176, c. CDR-H3 comprising the amino acid sequence of SEQ ID NO: 1718, d. CDR-L1 comprising the amino acid sequence of SEQ ID NO: 905, e. CDR-L2 comprising the amino acid sequence of SEQ ID NO: 1447, and f. CDR-L3 comprising the amino acid sequence of SEQ ID NO: 1989.

In one aspect, the present disclosure provides an antibody or antigen-binding fragment thereof comprising a CDR-H3 comprising the amino acid sequence of SEQ ID NO: 1718, and a CDR-L3 comprising the amino acid sequence of SEQ ID NO: 1989.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 634, b. CDR-H2 comprising the amino acid sequence of SEQ ID NO: 1176, c. CDR-H3 comprising the amino acid sequence of SEQ ID NO: 1718, and a VL comprising the amino acid sequence of SEQ ID NO: 363.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 905, b. CDR-L2 comprising the amino acid sequence of SEQ ID NO: 1447, c. CDR-L3 comprising the amino acid sequence of SEQ ID NO: 1989, and a VH comprising the amino acid sequence of SEQ ID NO: 92.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 92. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 92. In some embodiments, substitutions, insertions, or deletions occur in regions outside the CDRs (e.g., in the FRs). Optionally, the antibody or antigen-binding fragment thereof comprises the VH sequence SEQ ID NO: 92, including one or more post-translational modifications of that sequence. In a particular embodiment, the VH comprises one, two or three CDRs selected from: a. CDR-H1, comprising the amino acid sequence SEQ ID NO: 634, b. CDR-H2, comprising the amino acid sequence SEQ ID NO: 1176, and c. CDR-H3, comprising the amino acid sequence SEQ ID NO: 1718.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 363. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 363. In some embodiments, the substitutions, insertions, or deletions occur in regions outside the CDRs (e.g., in the FRs). Optionally, the antibody or antigen-binding fragment thereof comprises the VL sequence SEQ ID NO: 363, including one or more post-translational modifications of that sequence. In a particular embodiment, the VL comprises one, two or three CDRs selected from: a. CDR-L1, comprising the amino acid sequence SEQ ID NO: 905, b. CDR-L2, comprising the amino acid sequence SEQ ID NO: 1447, and c. CDR-L3, comprising the amino acid sequence SEQ ID NO: 1989.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 92, and the VL amino acid sequence of SEQ ID NO: 363, optionally including post-translational modifications of those sequences.

TESO1005

In one aspect, the present disclosure provides an antibody or antigen-binding fragment thereof comprising at least one or both variable regions selected from: a VH comprising the amino acid sequence of SEQ ID NO: 93 and b. VL comprising the amino acid sequence of SEQ ID NO: 364.

In one aspect, the present disclosure provides an antibody or antigen-binding fragment thereof comprising at least one, two, three, four, five, or six CDRs selected from: a. CDR-H1 comprising the amino acid sequence of SEQ ID NO: 635, b. CDR-H2 comprising the amino acid sequence of SEQ ID NO: 1177, c. CDR-H3 comprising the amino acid sequence of SEQ ID NO: 1719, d. CDR-L1 comprising the amino acid sequence of SEQ ID NO: 906, e. CDR-L2 comprising the amino acid sequence of SEQ ID NO: 1448, and f. CDR-L3 comprising the amino acid sequence of SEQ ID NO: 1990.

In one aspect, the present disclosure provides an antibody or antigen-binding fragment thereof comprising a CDR-H3 comprising the amino acid sequence of SEQ ID NO: 1719, and a CDR-L3 comprising the amino acid sequence of SEQ ID NO: 1990.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 635, b. CDR-H2 comprising the amino acid sequence of SEQ ID NO: 1177, c. CDR-H3 comprising the amino acid sequence of SEQ ID NO: 1719, and a VL comprising the amino acid sequence of SEQ ID NO: 364.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 906, b. CDR-L2 comprising the amino acid sequence of SEQ ID NO: 1448, c. CDR-L3 comprising the amino acid sequence of SEQ ID NO: 1990, and a VH comprising the amino acid sequence of SEQ ID NO: 93.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 93. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 93. In some embodiments, substitutions, insertions, or deletions occur in regions outside the CDRs (e.g., in the FRs). Optionally, the antibody or antigen-binding fragment thereof comprises the VH sequence SEQ ID NO: 93, including one or more post-translational modifications of that sequence. In a particular embodiment, the VH comprises one, two or three CDRs selected from: a. CDR-H1, comprising the amino acid sequence SEQ ID NO: 635, b. CDR-H2, comprising the amino acid sequence SEQ ID NO: 1177, and c. CDR-H3, comprising the amino acid sequence SEQ ID NO: 1719.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 364. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 364. In some embodiments, the substitutions, insertions, or deletions occur in regions outside the CDRs (e.g., in the FRs). Optionally, the antibody or antigen-binding fragment thereof comprises the VL sequence SEQ ID NO: 364, including one or more post-translational modifications of that sequence. In a particular embodiment, the VL comprises one, two or three CDRs selected from: a. CDR-L1, comprising the amino acid sequence SEQ ID NO: 906, b. CDR-L2, comprising the amino acid sequence SEQ ID NO: 1448, and c. CDR-L3, comprising the amino acid sequence SEQ ID NO: 1990.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 93, and the VL amino acid sequence of SEQ ID NO: 364, optionally including post-translational modifications of those sequences.

TESO1006

In one aspect, the present disclosure provides an antibody or antigen-binding fragment thereof comprising at least one or both variable regions selected from: a. VH comprising the amino acid sequence of SEQ ID NO: 94 and b. VL comprising the amino acid sequence of SEQ ID NO: 365.

In one aspect, the present disclosure provides an antibody or antigen-binding fragment thereof comprising at least one, two, three, four, five, or six CDRs selected from: a. CDR-H1 comprising the amino acid sequence of SEQ ID NO: 636, b. CDR-H2 comprising the amino acid sequence of SEQ ID NO: 1178, c. CDR-H3 comprising the amino acid sequence of SEQ ID NO: 1720, d. CDR-L1 comprising the amino acid sequence of SEQ ID NO: 907, e. CDR-L2 comprising the amino acid sequence of SEQ ID NO: 1449, and f. CDR-L3 comprising the amino acid sequence of SEQ ID NO: 1991.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 636, b. CDR-H2 comprising the amino acid sequence of SEQ ID NO: 1178, c. CDR-H3 comprising the amino acid sequence of SEQ ID NO: 1720, and a VL comprising the amino acid sequence of SEQ ID NO: 365.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 907, b. CDR-L2 comprising the amino acid sequence of SEQ ID NO: 1449, c. CDR-L3 comprising the amino acid sequence of SEQ ID NO: 1991, and a VH comprising the amino acid sequence of SEQ ID NO: 94.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 94. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 94. In some embodiments, substitutions, insertions, or deletions occur in regions outside the CDRs (e.g., in the FRs). Optionally, the antibody or antigen-binding fragment thereof comprises the VH sequence SEQ ID NO: 94, including one or more post-translational modifications of that sequence. In a particular embodiment, the VH comprises one, two or three CDRs selected from: a. CDR-H1, comprising the amino acid sequence SEQ ID NO: 636, b. CDR-H2, comprising the amino acid sequence SEQ ID NO: 1178, and c. CDR-H3, comprising the amino acid sequence SEQ ID NO: 1720.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 365. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 365. In some embodiments, the substitutions, insertions, or deletions occur in regions outside the CDRs (e.g., in the FRs). Optionally, the antibody or antigen-binding fragment thereof comprises the VL sequence SEQ ID NO: 365, including one or more post-translational modifications of that sequence. In a particular embodiment, the VL comprises one, two or three CDRs selected from: a. CDR-L1, comprising the amino acid sequence SEQ ID NO: 907, b. CDR-L2, comprising the amino acid sequence SEQ ID NO: 1449, and c. CDR-L3, comprising the amino acid sequence SEQ ID NO: 1991.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 94, and the VL amino acid sequence of SEQ ID NO: 365, optionally including post-translational modifications of those sequences.

TESO1007

In one aspect, the present disclosure provides an antibody or antigen-binding fragment thereof comprising at least one or both variable regions selected from: a VH comprising the amino acid sequence of SEQ ID NO: 95 and b. VL comprising the amino acid sequence of SEQ ID NO: 366.

In one aspect, the present disclosure provides an antibody or antigen-binding fragment thereof comprising at least one, two, three, four, five, or six CDRs selected from: a. CDR-H1 comprising the amino acid sequence of SEQ ID NO: 637, b. CDR-H2 comprising the amino acid sequence of SEQ ID NO: 1179, c. CDR-H3 comprising the amino acid sequence of SEQ ID NO: 1721, d. CDR-L1 comprising the amino acid sequence of SEQ ID NO: 908, e. CDR-L2 comprising the amino acid sequence of SEQ ID NO: 1450, and f. CDR-L3 comprising the amino acid sequence of SEQ ID NO: 1992.

In one aspect, the present disclosure provides an antibody or antigen-binding fragment thereof comprising a CDR-H3 comprising the amino acid sequence of SEQ ID NO: 1721, and a CDR-L3 comprising the amino acid sequence of SEQ ID NO: 1992.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 637, b. CDR-H2 comprising the amino acid sequence of SEQ ID NO: 1179, c. CDR-H3 comprising the amino acid sequence of SEQ ID NO: 1721, and a VL comprising the amino acid sequence of SEQ ID NO: 366.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 908, b. CDR-L2 comprising the amino acid sequence of SEQ ID NO: 1450, c. CDR-L3 comprising the amino acid sequence of SEQ ID NO: 1992, and a VH comprising the amino acid sequence of SEQ ID NO: 95.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 95. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 95. In some embodiments, substitutions, insertions, or deletions occur in regions outside the CDRs (e.g., in the FRs). Optionally, the antibody or antigen-binding fragment thereof comprises the VH sequence SEQ ID NO: 95, including one or more post-translational modifications of that sequence. In a particular embodiment, the VH comprises one, two or three CDRs selected from: a. CDR-H1, comprising the amino acid sequence SEQ ID NO: 637, b. CDR-H2, comprising the amino acid sequence SEQ ID NO: 1179, and c. CDR-H3, comprising the amino acid sequence SEQ ID NO: 1721.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 366. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 366. In some embodiments, the substitutions, insertions, or deletions occur in regions outside the CDRs (e.g., in the FRs). Optionally, the antibody or antigen-binding fragment thereof comprises the VL sequence SEQ ID NO: 366, including one or more post-translational modifications of that sequence. In a particular embodiment, the VL comprises one, two or three CDRs selected from: a. CDR-L1, comprising the amino acid sequence SEQ ID NO: 908, b. CDR-L2, comprising the amino acid sequence SEQ ID NO: 1450, and c. CDR-L3, comprising the amino acid sequence SEQ ID NO: 1992.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 95, and the VL amino acid sequence of SEQ ID NO: 366, optionally including post-translational modifications of those sequences.

THNS1001

In one aspect, the present disclosure provides an antibody or antigen-binding fragment thereof comprising at least one or both variable regions selected from: a. VH comprising the amino acid sequence of SEQ ID NO: 96 and VL comprising the amino acid sequence of SEQ ID NO: 367.

In one aspect, the present disclosure provides an antibody or antigen-binding fragment thereof comprising at least one, two, three, four, five, or six CDRs selected from: a. CDR-H1 comprising the amino acid sequence of SEQ ID NO: 638, b. CDR-H2 comprising the amino acid sequence of SEQ ID NO: 1180, c. CDR-H3 comprising the amino acid sequence of SEQ ID NO: 1722, d. CDR-L1 comprising the amino acid sequence of SEQ ID NO: 909, e. CDR-L2 comprising the amino acid sequence of SEQ ID NO: 1451, f. CDR-L3 comprising the amino acid sequence of SEQ ID NO: 1993.

In one aspect, the present disclosure provides an antibody or antigen-binding fragment thereof comprising a CDR-H3 comprising the amino acid sequence of SEQ ID NO: 1722, and a CDR-L3 comprising the amino acid sequence of SEQ ID NO: 1993.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 638, b. CDR-H2 comprising the amino acid sequence of SEQ ID NO: 1180, c. CDR-H3 comprising the amino acid sequence of SEQ ID NO: 1722, and a VL comprising the amino acid sequence of SEQ ID NO: 367.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 909, b. CDR-L2 comprising the amino acid sequence of SEQ ID NO: 1451, c. CDR-L3 comprising the amino acid sequence of SEQ ID NO: 1993, and a VH comprising the amino acid sequence of SEQ ID NO: 96.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 96. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 96. In some embodiments, substitutions, insertions, or deletions occur in regions outside the CDRs (e.g., in the FRs). Optionally, the antibody or antigen-binding fragment thereof comprises the VH sequence SEQ ID NO: 96, including one or more post-translational modifications of that sequence. In a particular embodiment, the VH comprises one, two or three CDRs selected from: a. CDR-H1, comprising the amino acid sequence SEQ ID NO: 638, b. CDR-H2, comprising the amino acid sequence SEQ ID NO: 1180, and c. CDR-H3, comprising the amino acid sequence SEQ ID NO: 1722.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 367. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 367. In some embodiments, the substitutions, insertions, or deletions occur in regions outside the CDRs (e.g., in the FRs). Optionally, the antibody or antigen-binding fragment thereof comprises the VL sequence SEQ ID NO: 367, including one or more post-translational modifications of that sequence. In a particular embodiment, the VL comprises one, two or three CDRs selected from: a. CDR-L1, comprising the amino acid sequence SEQ ID NO: 909, b. CDR-L2, comprising the amino acid sequence SEQ ID NO: 1451, and c. CDR-L3, comprising the amino acid sequence SEQ ID NO: 1993.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 96, and the VL amino acid sequence of SEQ ID NO: 367, optionally including post-translational modifications of those sequences.

THNS1002

In one aspect, the present disclosure provides an antibody or antigen-binding fragment thereof comprising at least one or both variable regions selected from: a. VH comprising the amino acid sequence of SEQ ID NO: 97 and b. VL comprising the amino acid sequence of SEQ ID NO: 368.

In one aspect, the present disclosure provides an antibody or antigen-binding fragment thereof comprising at least one, two, three, four, five, or six CDRs selected from: a. CDR-H1 comprising the amino acid sequence of SEQ ID NO: 639, b. CDR-H2 comprising the amino acid sequence of SEQ ID NO: 1181, c. CDR-H3 comprising the amino acid sequence of SEQ ID NO: 1723, d. CDR-L1 comprising the amino acid sequence of SEQ ID NO: 910, e. CDR-L2 comprising the amino acid sequence of SEQ ID NO: 1452, and f. CDR-L3 comprising the amino acid sequence of SEQ ID NO: 1994.

In one aspect, the present disclosure provides an antibody or antigen-binding fragment thereof comprising a CDR-H3 comprising the amino acid sequence of SEQ ID NO: 1723, and a CDR-L3 comprising the amino acid sequence of SEQ ID NO: 1994.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 639, b. CDR-H2 comprising the amino acid sequence of SEQ ID NO: 1181, c. CDR-H3 comprising the amino acid sequence of SEQ ID NO: 1723, and a VL comprising the amino acid sequence of SEQ ID NO: 368.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 910, b. CDR-L2 comprising the amino acid sequence of SEQ ID NO: 1452, c. CDR-L3 comprising the amino acid sequence of SEQ ID NO: 1994, and a VH comprising the amino acid sequence of SEQ ID NO: 97.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 97. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 97. In some embodiments, substitutions, insertions, or deletions occur in regions outside the CDRs (e.g., in the FRs). Optionally, the antibody or antigen-binding fragment thereof comprises the VH sequence SEQ ID NO: 97, including one or more post-translational modifications of that sequence. In a particular embodiment, the VH comprises one, two or three CDRs selected from: a. CDR-H1, comprising the amino acid sequence SEQ ID NO: 639, b. CDR-H2, comprising the amino acid sequence SEQ ID NO: 1181, and c. CDR-H3, comprising the amino acid sequence SEQ ID NO: 1723.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 368. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 368. In some embodiments, the substitutions, insertions, or deletions occur in regions outside the CDRs (e.g., in the FRs). Optionally, the antibody or antigen-binding fragment thereof comprises the VL sequence SEQ ID NO: 368, including one or more post-translational modifications of that sequence. In a particular embodiment, the VL comprises one, two or three CDRs selected from: a. CDR-L1, comprising the amino acid sequence SEQ ID NO: 910, b. CDR-L2, comprising the amino acid sequence SEQ ID NO: 1452, and c. CDR-L3, comprising the amino acid sequence SEQ ID NO: 1994.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 97, and the VL amino acid sequence of SEQ ID NO: 368, optionally including post-translational modifications of those sequences.

THNS1003

In one aspect, the present disclosure provides an antibody or antigen-binding fragment thereof comprising at least one or both variable regions selected from: a. VH comprising the amino acid sequence of SEQ ID NO: 98 and b. VL comprising the amino acid sequence of SEQ ID NO: 369.

In one aspect, the present disclosure provides an antibody or antigen-binding fragment thereof comprising at least one, two, three, four, five, or six CDRs selected from: a. CDR-H1 comprising the amino acid sequence of SEQ ID NO: 640, b. CDR-H2 comprising the amino acid sequence of SEQ ID NO: 1182, c. CDR-H3 comprising the amino acid sequence of SEQ ID NO: 1724, d. CDR-L1 comprising the amino acid sequence of SEQ ID NO: 911, e. CDR-L2 comprising the amino acid sequence of SEQ ID NO: 1453, and f. CDR-L3 comprising the amino acid sequence of SEQ ID NO: 1995.

In one aspect, the present disclosure provides an antibody or antigen-binding fragment thereof comprising a CDR-H3 comprising the amino acid sequence of SEQ ID NO: 1724, and a CDR-L3 comprising the amino acid sequence of SEQ ID NO: 1995.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 640, b. CDR-H2 comprising the amino acid sequence of SEQ ID NO: 1182, c. CDR-H3 comprising the amino acid sequence of SEQ ID NO: 1724, and a VL comprising the amino acid sequence of SEQ ID NO: 369.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 911, b. CDR-L2 comprising the amino acid sequence of SEQ ID NO: 1453, c. CDR-L3 comprising the amino acid sequence of SEQ ID NO: 1995, and a VH comprising the amino acid sequence of SEQ ID NO: 98.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 98. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 98. In some embodiments, substitutions, insertions, or deletions occur in regions outside the CDRs (e.g., in the FRs). Optionally, the antibody or antigen-binding fragment thereof comprises the VH sequence SEQ ID NO: 98, including one or more post-translational modifications of that sequence. In a particular embodiment, the VH comprises one, two or three CDRs selected from: a. CDR-H1, comprising the amino acid sequence SEQ ID NO: 640, b. CDR-H2, comprising the amino acid sequence SEQ ID NO: 1182, and c. CDR-H3, comprising the amino acid sequence SEQ ID NO: 1724.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 369. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 369. In some embodiments, the substitutions, insertions, or deletions occur in regions outside the CDRs (e.g., in the FRs). Optionally, the antibody or antigen-binding fragment thereof comprises the VL sequence SEQ ID NO: 369, including one or more post-translational modifications of that sequence. In a particular embodiment, the VL comprises one, two or three CDRs selected from: a. CDR-L1, comprising the amino acid sequence SEQ ID NO: 911, b. CDR-L2, comprising the amino acid sequence SEQ ID NO: 1453, and c. CDR-L3, comprising the amino acid sequence SEQ ID NO: 1995.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 98, and the VL amino acid sequence of SEQ ID NO: 369, optionally including post-translational modifications of those sequences.

THNS1004

In one aspect, the present disclosure provides an antibody or antigen-binding fragment thereof comprising at least one or both variable regions selected from: a. VH comprising the amino acid sequence of SEQ ID NO: 99 and b. VL comprising the amino acid sequence of SEQ ID NO: 370.

In one aspect, the present disclosure provides an antibody or antigen-binding fragment thereof comprising at least one, two, three, four, five, or six CDRs selected from: a. CDR-H1 comprising the amino acid sequence of SEQ ID NO: 641, b. CDR-H2 comprising the amino acid sequence of SEQ ID NO: 1183, c. CDR-H3 comprising the amino acid sequence of SEQ ID NO: 1725, d. CDR-L1 comprising the amino acid sequence of SEQ ID NO: 912, e. CDR-L2 comprising the amino acid sequence of SEQ ID NO: 1454, and f. CDR-L3 comprising the amino acid sequence of SEQ ID NO: 1996.

In one aspect, the present disclosure provides an antibody or antigen-binding fragment thereof comprising a CDR-H3 comprising the amino acid sequence of SEQ ID NO: 1725, and a CDR-L3 comprising the amino acid sequence of SEQ ID NO: 1996.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 641, b. CDR-H2 comprising the amino acid sequence of SEQ ID NO: 1183, c. CDR-H3 comprising the amino acid sequence of SEQ ID NO: 1725, and a VL comprising the amino acid sequence of SEQ ID NO: 370.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 912, b. CDR-L2 comprising the amino acid sequence of SEQ ID NO: 1454, c. CDR-L3 comprising the amino acid sequence of SEQ ID NO: 1996, and a VH comprising the amino acid sequence of SEQ ID NO: 99.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 99. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 99. In some embodiments, substitutions, insertions, or deletions occur in regions outside the CDRs (e.g., in the FRs). Optionally, the antibody or antigen-binding fragment thereof comprises the VH sequence SEQ ID NO: 99, including one or more post-translational modifications of that sequence. In a particular embodiment, the VH comprises one, two or three CDRs selected from: a. CDR-H1, comprising the amino acid sequence SEQ ID NO: 641, b. CDR-H2, comprising the amino acid sequence SEQ ID NO: 1183, and c. CDR-H3, comprising the amino acid sequence SEQ ID NO: 1725.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 370. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 370. In some embodiments, the substitutions, insertions, or deletions occur in regions outside the CDRs (e.g., in the FRs). Optionally, the antibody or antigen-binding fragment thereof comprises the VL sequence SEQ ID NO: 370, including one or more post-translational modifications of that sequence. In a particular embodiment, the VL comprises one, two or three CDRs selected from: a. CDR-L1, comprising the amino acid sequence SEQ ID NO: 912, b. CDR-L2, comprising the amino acid sequence SEQ ID NO: 1454, and c. CDR-L3, comprising the amino acid sequence SEQ ID NO: 1996.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 99, and the VL amino acid sequence of SEQ ID NO: 370, optionally including post-translational modifications of those sequences.

THNS1005

In one aspect, the present disclosure provides an antibody or antigen-binding fragment thereof comprising at least one or both variable regions selected from: a. VH comprising the amino acid sequence of SEQ ID NO: 100 and b. VL comprising the amino acid sequence of SEQ ID NO: 371.

In one aspect, the present disclosure provides an antibody or antigen-binding fragment thereof comprising at least one, two, three, four, five, or six CDRs selected from: a. CDR-H1 comprising the amino acid sequence of SEQ ID NO: 642, b. CDR-H2 comprising the amino acid sequence of SEQ ID NO: 1184, c. CDR-H3 comprising the amino acid sequence of SEQ ID NO: 1726, d. CDR-L1 comprising the amino acid sequence of SEQ ID NO: 913, e. CDR-L2 comprising the amino acid sequence of SEQ ID NO: 1455, and f. CDR-L3 comprising the amino acid sequence of SEQ ID NO: 1997.

In one aspect, the present disclosure provides an antibody or antigen-binding fragment thereof comprising a CDR-H3 comprising the amino acid sequence of SEQ ID NO: 1726, and a CDR-L3 comprising the amino acid sequence of SEQ ID NO: 1997.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 642, b. CDR-H2 comprising the amino acid sequence of SEQ ID NO: 1184, c. CDR-H3 comprising the amino acid sequence of SEQ ID NO: 1726, and a VL comprising the amino acid sequence of SEQ ID NO: 371.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 913, b. CDR-L2 comprising the amino acid sequence of SEQ ID NO: 1455, c. CDR-L3 comprising the amino acid sequence of SEQ ID NO: 1997, and a VH comprising the amino acid sequence of SEQ ID NO: 100.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 100. In some embodiments, a VH sequence having at least 90%, 91%, 92%, 93%, 94%, 95%, 96%, 97%, 98%, or 99% identity contains substitutions (e.g., conservative substitutions), thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 100. In some embodiments, substitutions, insertions, or deletions occur in regions outside the CDRs (e.g., in the FRs). Optionally, the antibody or antigen-binding fragment thereof comprises the VH sequence SEQ ID NO: 100, including one or more post-translational modifications of that sequence. In a particular embodiment, the VH comprises one, two or three CDRs selected from: a. CDR-H1, comprising the amino acid sequence SEQ ID NO: 642, b. CDR-H2, comprising the amino acid sequence SEQ ID NO: 1184, and c. CDR-H3, comprising the amino acid sequence SEQ ID NO: 1726.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 371. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 371. In some embodiments, the substitutions, insertions, or deletions occur in regions outside the CDRs (e.g., in the FRs). Optionally, the antibody or antigen-binding fragment thereof comprises the VL sequence SEQ ID NO: 371, including one or more post-translational modifications of that sequence. In a particular embodiment, the VL comprises one, two or three CDRs selected from: a. CDR-L1, comprising the amino acid sequence SEQ ID NO: 913, b. CDR-L2, comprising the amino acid sequence SEQ ID NO: 1455, and c. CDR-L3, comprising the amino acid sequence SEQ ID NO: 1997.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 100, and the VL amino acid sequence of SEQ ID NO: 371, optionally including post-translational modifications of those sequences.

THNS1006

In one aspect, the present disclosure provides an antibody or antigen-binding fragment thereof comprising at least one or both variable regions selected from: a. VH comprising the amino acid sequence of SEQ ID NO: 101 and b. VL comprising the amino acid sequence of SEQ ID NO: 372.

In one aspect, the present disclosure provides an antibody or antigen-binding fragment thereof comprising at least one, two, three, four, five, or six CDRs selected from: a. CDR-H1 comprising the amino acid sequence of SEQ ID NO: 643, b. CDR-H2 comprising the amino acid sequence of SEQ ID NO: 1185, c. CDR-H3 comprising the amino acid sequence of SEQ ID NO: 1727, d. CDR-L1 comprising the amino acid sequence of SEQ ID NO: 914, e. CDR-L2 comprising the amino acid sequence of SEQ ID NO: 1456, and f. CDR-L3 comprising the amino acid sequence of SEQ ID NO: 1998.

In one aspect, the present disclosure provides an antibody or antigen-binding fragment thereof comprising a CDR-H3 comprising the amino acid sequence of SEQ ID NO: 1727, and a CDR-L3 comprising the amino acid sequence of SEQ ID NO: 1998.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 643, b. CDR-H2 comprising the amino acid sequence of SEQ ID NO: 1185, c. CDR-H3 comprising the amino acid sequence of SEQ ID NO: 1727, and a VL comprising the amino acid sequence of SEQ ID NO: 372.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 914, b. CDR-L2 comprising the amino acid sequence of SEQ ID NO: 1456, c. CDR-L3 comprising the amino acid sequence of SEQ ID NO: 1998, and a VH comprising the amino acid sequence of SEQ ID NO: 101.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 101. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 101. In some embodiments, substitutions, insertions, or deletions occur in regions outside the CDRs (e.g., in the FRs). Optionally, the antibody or antigen-binding fragment thereof comprises the VH sequence SEQ ID NO: 101, including one or more post-translational modifications of that sequence. In a particular embodiment, the VH comprises one, two or three CDRs selected from: a. CDR-H1, comprising the amino acid sequence SEQ ID NO: 643, b. CDR-H2, comprising the amino acid sequence SEQ ID NO: 1185, and a CDR-H3, comprising the amino acid sequence SEQ ID NO: 1727.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 372. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 372. In some embodiments, the substitutions, insertions, or deletions occur in regions outside the CDRs (e.g., in the FRs). Optionally, the antibody or antigen-binding fragment thereof comprises the VL sequence SEQ ID NO: 372, including one or more post-translational modifications of that sequence. In a particular embodiment, the VL comprises one, two or three CDRs selected from: a. CDR-L1, comprising the amino acid sequence SEQ ID NO: 914, b. CDR-L2, comprising the amino acid sequence SEQ ID NO: 1456, and c. CDR-L3, comprising the amino acid sequence SEQ ID NO: 1998.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 101, and the VL amino acid sequence of SEQ ID NO: 372, optionally including post-translational modifications of those sequences.

THNS1007

In one aspect, the present disclosure provides an antibody or antigen-binding fragment thereof comprising at least one or both variable regions selected from: a. VH comprising the amino acid sequence of SEQ ID NO: 102 and b. VL comprising the amino acid sequence of SEQ ID NO: 373.

In one aspect, the present disclosure provides an antibody or antigen-binding fragment thereof comprising at least one, two, three, four, five, or six CDRs selected from: a. CDR-H1 comprising the amino acid sequence of SEQ ID NO: 644, b. CDR-H2 comprising the amino acid sequence of SEQ ID NO: 1186, c. CDR-H3 comprising the amino acid sequence of SEQ ID NO: 1728, d. CDR-L1 comprising the amino acid sequence of SEQ ID NO: 915, e. CDR-L2 comprising the amino acid sequence of SEQ ID NO: 1457, and f. CDR-L3 comprising the amino acid sequence of SEQ ID NO: 1999.

In one aspect, the present disclosure provides an antibody or antigen-binding fragment thereof comprising a CDR-H3 comprising the amino acid sequence of SEQ ID NO: 1728, and a CDR-L3 comprising the amino acid sequence of SEQ ID NO: 1999.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 644, b. CDR-H2 comprising the amino acid sequence of SEQ ID NO: 1186, c. CDR-H3 comprising the amino acid sequence of SEQ ID NO: 1728, and a VL comprising the amino acid sequence of SEQ ID NO: 373.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 915, b. CDR-L2 comprising the amino acid sequence of SEQ ID NO: 1457, c. CDR-L3 comprising the amino acid sequence of SEQ ID NO: 1999, and a VH comprising the amino acid sequence of SEQ ID NO: 102.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 102. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 102. In some embodiments, substitutions, insertions, or deletions occur in regions outside the CDRs (e.g., in the FRs). Optionally, the antibody or antigen-binding fragment thereof comprises the VH sequence SEQ ID NO: 102, including one or more post-translational modifications of that sequence. In a particular embodiment, the VH comprises one, two or three CDRs selected from: a. CDR-H1, comprising the amino acid sequence SEQ ID NO: 644, b. CDR-H2, comprising the amino acid sequence SEQ ID NO: 1186, and c. CDR-H3, comprising the amino acid sequence SEQ ID NO: 1728.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 373. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 373. In some embodiments, the substitutions, insertions, or deletions occur in regions outside the CDRs (e.g., in the FRs). Optionally, the antibody or antigen-binding fragment thereof comprises the VL sequence SEQ ID NO: 373, including one or more post-translational modifications of that sequence. In a particular embodiment, the VL comprises one, two or three CDRs selected from: a. CDR-L1, comprising the amino acid sequence SEQ ID NO: 915, b. CDR-L2, comprising the amino acid sequence SEQ ID NO: 1457, and c. CDR-L3, comprising the amino acid sequence SEQ ID NO: 1999.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 102, and the VL amino acid sequence of SEQ ID NO: 373, optionally including post-translational modifications of those sequences. THNS1008

In one aspect, the present disclosure provides an antibody or antigen-binding fragment thereof comprising at least one or both variable regions selected from: a. VH comprising the amino acid sequence of SEQ ID NO: 103 and b. VL comprising the amino acid sequence of SEQ ID NO: 374.

In one aspect, the present disclosure provides an antibody or antigen-binding fragment thereof comprising at least one, two, three, four, five, or six CDRs selected from: a. CDR-H1 comprising the amino acid sequence of SEQ ID NO: 645, b. CDR-H2 comprising the amino acid sequence of SEQ ID NO: 1187, c. CDR-H3 comprising the amino acid sequence of SEQ ID NO: 1729, d. CDR-L1 comprising the amino acid sequence of SEQ ID NO: 916, e. CDR-L2 comprising the amino acid sequence of SEQ ID NO: 1458, and f. CDR-L3 comprising the amino acid sequence of SEQ ID NO: 2000.

In one aspect, the present disclosure provides an antibody or antigen-binding fragment thereof comprising at least one, two, three, four, five, or six CDRs selected from: a. CDR-H1 comprising a CDR-H3 comprising the amino acid sequence of SEQ ID NO: 1729, and a CDR-L3 comprising the amino acid sequence of SEQ ID NO: 2000.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 645, b. CDR-H2 comprising the amino acid sequence of SEQ ID NO: 1187, c. CDR-H3 comprising the amino acid sequence of SEQ ID NO: 1729, and a VL comprising the amino acid sequence of SEQ ID NO: 374.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 916, b. CDR-L2 comprising the amino acid sequence of SEQ ID NO: 1458, c. CDR-L3 comprising the amino acid sequence of SEQ ID NO: 2000, and a VH comprising the amino acid sequence of SEQ ID NO: 103.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 103. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 103. In some embodiments, substitutions, insertions, or deletions occur in regions outside the CDRs (e.g., in the FRs). Optionally, the antibody or antigen-binding fragment thereof comprises the VH sequence SEQ ID NO: 103, including one or more post-translational modifications of that sequence. In a particular embodiment, the VH comprises one, two or three CDRs selected from: a. CDR-H1, comprising the amino acid sequence SEQ ID NO: 645, b. CDR-H2, comprising the amino acid sequence SEQ ID NO: 1187, and c. CDR-H3, comprising the amino acid sequence SEQ ID NO: 1729.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 374. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 374. In some embodiments, the substitutions, insertions, or deletions occur in regions outside the CDRs (e.g., in the FRs). Optionally, the antibody or antigen-binding fragment thereof comprises the VL sequence SEQ ID NO: 374, including one or more post-translational modifications of that sequence. In a particular embodiment, the VL comprises one, two or three CDRs selected from: a. CDR-L1, comprising the amino acid sequence SEQ ID NO: 916, b. CDR-L2, comprising the amino acid sequence SEQ ID NO: 1458, and c. CDR-L3, comprising the amino acid sequence SEQ ID NO: 2000.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 103, and the VL amino acid sequence of SEQ ID NO: 374, optionally including post-translational modifications of those sequences.
THNS1009

In one aspect, the present disclosure provides an antibody or antigen-binding fragment thereof comprising at least one or both variable regions selected from: a. VH comprising the amino acid sequence of SEQ ID NO: 104 and b. VL comprising the amino acid sequence of SEQ ID NO: 375.

In one aspect, the present disclosure provides an antibody or antigen-binding fragment thereof comprising at least one, two, three, four, five, or six CDRs selected from: a. CDR-H1 comprising the amino acid sequence of SEQ ID NO: 646, b. CDR-H2 comprising the amino acid sequence of SEQ ID NO: 1188, c. CDR-H3 comprising the amino acid sequence of SEQ ID NO: 1730, d. CDR-L1 comprising the amino acid sequence of SEQ ID NO: 917, e. CDR-L2 comprising the amino acid sequence of SEQ ID NO: 1459, and f. CDR-L3 comprising the amino acid sequence of SEQ ID NO: 2001.

In one aspect, the present disclosure provides an antibody or antigen-binding fragment thereof comprising a CDR-H3 comprising the amino acid sequence of SEQ ID NO: 1730, and a CDR-L3 comprising the amino acid sequence of SEQ ID NO: 2001.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 646, b. CDR-H2 comprising the amino acid sequence of SEQ ID NO: 1188, c. CDR-H3 comprising the amino acid sequence of SEQ ID NO: 1730, and a VL comprising the amino acid sequence of SEQ ID NO: 375.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 917, b. CDR-L2 comprising the amino acid sequence of SEQ ID NO: 1459, c. CDR-L3 comprising the amino acid sequence of SEQ ID NO: 2001, and a VH comprising the amino acid sequence of SEQ ID NO: 104.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 104. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 104. In some embodiments, substitutions, insertions, or deletions occur in regions outside the CDRs (e.g., in the FRs). Optionally, the antibody or antigen-binding fragment thereof comprises the VH sequence SEQ ID NO: 104, including one or more post-translational modifications of that sequence. In a particular embodiment, the VH comprises one, two or three CDRs selected from: a. CDR-H1, comprising the amino acid sequence SEQ ID NO: 646, b. CDR-H2, comprising the amino acid sequence SEQ ID NO: 1188, and c. CDR-H3, comprising the amino acid sequence SEQ ID NO: 1730.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 375. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 375. In some embodiments, the substitutions, insertions, or deletions occur in regions outside the CDRs (e.g., in the FRs). Optionally, the antibody or antigen-binding fragment thereof comprises the VL sequence SEQ ID NO: 375, including one or more post-translational modifications of that sequence. In a particular embodiment, the VL comprises one, two or three CDRs selected from: a. CDR-L1, comprising the amino acid sequence SEQ ID NO: 917, b. CDR-L2, comprising the amino acid sequence SEQ ID NO: 1459, and c. CDR-L3, comprising the amino acid sequence SEQ ID NO: 2001.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 104, and the VL amino acid sequence of SEQ ID NO: 375, optionally including post-translational modifications of those sequences.
THNS1010

In one aspect, the present disclosure provides an antibody or antigen-binding fragment thereof comprising at least one or both variable regions selected from: a. VH comprising the amino acid sequence of SEQ ID NO: 105 and b. VL comprising the amino acid sequence of SEQ ID NO: 376.

In one aspect, the present disclosure provides an antibody or antigen-binding fragment thereof comprising at least one, two, three, four, five, or six CDRs selected from: a. CDR-H1 comprising the amino acid sequence of SEQ ID NO: 647, b. CDR-H2 comprising the amino acid sequence of SEQ ID NO: 1189, c. CDR-H3 comprising the amino acid sequence of SEQ ID NO: 1731, d. CDR-L1 comprising the amino acid sequence of SEQ ID NO: 918, e. CDR-L2 comprising the amino acid sequence of SEQ ID NO: 1460, and f. CDR-L3 comprising the amino acid sequence of SEQ ID NO: 2002.

In one aspect, the present disclosure provides an antibody or antigen-binding fragment thereof comprising a CDR-H3 comprising the amino acid sequence of SEQ ID NO: 1731, and a CDR-L3 comprising the amino acid sequence of SEQ ID NO: 2002.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 647, b. CDR-H2 comprising the amino acid sequence of SEQ ID NO: 1189, c. CDR-H3 comprising the amino acid sequence of SEQ ID NO: 1731, and a VL comprising the amino acid sequence of SEQ ID NO: 376.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 918, b. CDR-L2 comprising the amino acid sequence of SEQ ID NO: 1460, c. CDR-L3 comprising the amino acid sequence of SEQ ID NO: 2002, and a VH comprising the amino acid sequence of SEQ ID NO: 105.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 105. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 105. In some embodiments, substitutions, insertions, or deletions occur in regions outside the CDRs (e.g., in the FRs). Optionally, the antibody or antigen-binding fragment thereof comprises the VH sequence SEQ ID NO: 105, including one or more post-translational modifications of that sequence. In a particular embodiment, the VH comprises one, two or three CDRs selected from: a. CDR-H1, comprising the amino acid sequence SEQ ID NO: 647, b. CDR-H2, comprising the amino acid sequence SEQ ID NO: 1189, and c. CDR-H3, comprising the amino acid sequence SEQ ID NO: 1731.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 376. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 376. In some embodiments, the substitutions, insertions, or deletions occur in regions outside the CDRs (e.g., in the FRs). Optionally, the antibody or antigen-binding fragment thereof comprises the VL sequence SEQ ID NO: 376, including one or more post-translational modifications of that sequence. In a particular embodiment, the VL comprises one, two or three CDRs selected from: a. CDR-L1, comprising the amino acid sequence SEQ ID NO: 918, b. CDR-L2, comprising the amino acid sequence SEQ ID NO: 1460, and c. CDR-L3, comprising the amino acid sequence SEQ ID NO: 2002.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 105, and the VL amino acid sequence of SEQ ID NO: 376, optionally including post-translational modifications of those sequences.

THNS1011

In one aspect, the present disclosure provides an antibody or antigen-binding fragment thereof comprising at least one or both variable regions selected from: a. VH comprising the amino acid sequence of SEQ ID NO: 106 and b. VL comprising the amino acid sequence of SEQ ID NO: 377.

In one aspect, the present disclosure provides an antibody or antigen-binding fragment thereof comprising at least one, two, three, four, five, or six CDRs selected from: a. CDR-H1 comprising the amino acid sequence of SEQ ID NO: 648, b. CDR-H2 comprising the amino acid sequence of SEQ ID NO: 1190, c. CDR-H3 comprising the amino acid sequence of SEQ ID NO: 1732, d. CDR-L1 comprising the amino acid sequence of SEQ ID NO: 919, e. CDR-L2 comprising the amino acid sequence of SEQ ID NO: 1461, and f. CDR-L3 comprising the amino acid sequence of SEQ ID NO: 2003.

In one aspect, the present disclosure provides an antibody or antigen-binding fragment thereof comprising a CDR-H3 comprising the amino acid sequence of SEQ ID NO: 1732, and a CDR-L3 comprising the amino acid sequence of SEQ ID NO: 2003.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 648, b. CDR-H2 comprising the amino acid sequence of SEQ ID NO: 1190, c. CDR-H3 comprising the amino acid sequence of SEQ ID NO: 1732, and a VL comprising the amino acid sequence of SEQ ID NO: 377.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 919, b. CDR-L2 comprising the amino acid sequence of SEQ ID NO: 1461, c. CDR-L3 comprising the amino acid sequence of SEQ ID NO: 2003, and a VH comprising the amino acid sequence of SEQ ID NO: 106.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 106. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 106. In some embodiments, substitutions, insertions, or deletions occur in regions outside the CDRs (e.g., in the FRs). Optionally, the antibody or antigen-binding fragment thereof comprises the VH sequence SEQ ID NO: 106, including one or more post-translational modifications of that sequence. In a particular embodiment, the VH comprises one, two or three CDRs selected from: a. CDR-H1, comprising the amino acid sequence SEQ ID NO: 648, b. CDR-H2, comprising the amino acid sequence SEQ ID NO: 1190, and c. CDR-H3, comprising the amino acid sequence SEQ ID NO: 1732.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 377. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 377. In some embodiments, the substitutions, insertions, or deletions occur in regions outside the CDRs (e.g., in the FRs). Optionally, the antibody or antigen-binding fragment thereof comprises the VL sequence SEQ ID NO: 377, including one or more post-translational modifications of that sequence. In a particular embodiment, the VL comprises one, two or three CDRs selected from: a. CDR-L1, comprising the amino acid sequence SEQ ID NO: 919, b. CDR-L2, comprising the amino acid sequence SEQ ID NO: 1461, and c. CDR-L3, comprising the amino acid sequence SEQ ID NO: 2003.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 106, and the VL amino acid sequence of SEQ ID NO: 377, optionally including post-translational modifications of those sequences.

THNS1012

In one aspect, the present disclosure provides an antibody or antigen-binding fragment thereof comprising at least one or both variable regions selected from: a. VH comprising the amino acid sequence of SEQ ID NO: 107 and b. VL comprising the amino acid sequence of SEQ ID NO: 378.

In one aspect, the present disclosure provides an antibody or antigen-binding fragment thereof comprising at least one, two, three, four, five, or six CDRs selected from: a. CDR-H1 comprising the amino acid sequence of SEQ ID NO: 649, b. CDR-H2 comprising the amino acid sequence of SEQ ID NO: 1191, c. CDR-H3 comprising the amino acid sequence of SEQ ID NO: 1733, d. CDR-L1 comprising the amino acid sequence of SEQ ID NO: 920, e. CDR-L2 comprising the amino acid sequence of SEQ ID NO: 1462, f. CDR-L3 comprising the amino acid sequence of SEQ ID NO: 2004.

In one aspect, the present disclosure provides an antibody or antigen-binding fragment thereof comprising a CDR-H3 comprising the amino acid sequence of SEQ ID NO: 1733, and a CDR-L3 comprising the amino acid sequence of SEQ ID NO: 2004.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 649, b. CDR-H2 comprising the amino acid sequence of SEQ ID NO: 1191, c. CDR-H3 comprising the amino acid sequence of SEQ ID NO: 1733, and a VL comprising the amino acid sequence of SEQ ID NO: 378.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 920, b. CDR-L2 comprising the amino acid sequence of SEQ ID NO: 1462, c. CDR-L3 comprising the amino acid sequence of SEQ ID NO: 2004, and a VH comprising the amino acid sequence of SEQ ID NO: 107.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 107. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 107. In some embodiments, substitutions, insertions, or deletions occur in regions outside the CDRs (e.g., in the FRs). Optionally, the antibody or antigen-binding fragment thereof comprises the VH sequence SEQ ID NO: 107, including one or more post-translational modifications of that sequence. In a particular embodiment, the VH comprises one, two or three CDRs selected from: a. CDR-H1, comprising the amino acid sequence SEQ ID NO: 649, b. CDR-H2, comprising the amino acid sequence SEQ ID NO: 1191, and c. CDR-H3, comprising the amino acid sequence SEQ ID NO: 1733.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 378. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 378. In some embodiments, the substitutions, insertions, or deletions occur in regions outside the CDRs (e.g., in the FRs). Optionally, the antibody or antigen-binding fragment thereof comprises the VL sequence SEQ ID NO: 378, including one or more post-translational modifications of that sequence. In a particular embodiment, the VL comprises one, two or three CDRs selected from: a. CDR-L1, comprising the amino acid sequence SEQ ID NO: 920, b. CDR-L2, comprising the amino acid sequence SEQ ID NO: 1462, and c. CDR-L3, comprising the amino acid sequence SEQ ID NO: 2004.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 107, and the VL amino acid sequence of SEQ ID NO: 378, optionally including post-translational modifications of those sequences.

THNS1013

In one aspect, the present disclosure provides an antibody or antigen-binding fragment thereof comprising at least one or both variable regions selected from: a. VH comprising the amino acid sequence of SEQ ID NO: 108 and b. VL comprising the amino acid sequence of SEQ ID NO: 379.

In one aspect, the present disclosure provides an antibody or antigen-binding fragment thereof comprising at least one, two, three, four, five, or six CDRs selected from: a. CDR-H1 comprising the amino acid sequence of SEQ ID NO: 650, b. CDR-H2 comprising the amino acid sequence of SEQ ID NO: 1192, c. CDR-H3 comprising the amino acid sequence of SEQ ID NO: 1734, d. CDR-L1 comprising the amino acid sequence of SEQ ID NO: 921, e. CDR-L2 comprising the amino acid sequence of SEQ ID NO: 1463, and f. CDR-L3 comprising the amino acid sequence of SEQ ID NO: 2005.

In one aspect, the present disclosure provides an antibody or antigen-binding fragment thereof comprising a CDR-H3 comprising the amino acid sequence of SEQ ID NO: 1734, and a CDR-L3 comprising the amino acid sequence of SEQ ID NO: 2005.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 650, b. CDR-H2 comprising the amino acid sequence of SEQ ID NO: 1192, c. CDR-H3 comprising the amino acid sequence of SEQ ID NO: 1734, and a VL comprising the amino acid sequence of SEQ ID NO: 379.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 921, b. CDR-L2 comprising the amino acid sequence of SEQ ID NO: 1463, c. CDR-L3 comprising the amino acid sequence of SEQ ID NO: 2005, and a VH comprising the amino acid sequence of SEQ ID NO: 108.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 108. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 108. In some embodiments, substitutions, insertions, or deletions occur in regions outside the CDRs (e.g., in the FRs). Optionally, the antibody or antigen-binding fragment thereof comprises the VH sequence SEQ ID NO: 108, including one or more post-translational modifications of that sequence. In a particular embodiment, the VH comprises one, two or three CDRs selected from: a. CDR-H1, comprising the amino acid sequence SEQ ID NO: 650, b. CDR-H2, comprising the amino acid sequence SEQ ID NO: 1192, and c. CDR-H3, comprising the amino acid sequence SEQ ID NO: 1734.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 379. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 379. In some embodiments, the substitutions, insertions, or deletions occur in regions outside the CDRs (e.g., in the FRs). Optionally, the antibody or antigen-binding fragment thereof comprises the VL sequence SEQ ID NO: 379, including one or more post-translational modifications of that sequence. In a particular embodiment, the VL comprises one, two or three CDRs selected from: a. CDR-L1, comprising the amino acid sequence SEQ ID NO: 921, b. CDR-L2, comprising the amino acid sequence SEQ ID NO: 1463, and c. CDR-L3, comprising the amino acid sequence SEQ ID NO: 2005.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 108, and the VL amino acid sequence of SEQ ID NO: 379, optionally including post-translational modifications of those sequences.
THNS1014

In one aspect, the present disclosure provides an antibody or antigen-binding fragment thereof comprising at least one or both variable regions selected from: a. VH comprising the amino acid sequence of SEQ ID NO: 109 and b. VL comprising the amino acid sequence of SEQ ID NO: 380.

In one aspect, the present disclosure provides an antibody or antigen-binding fragment thereof comprising at least one, two, three, four, five, or six CDRs selected from: a. CDR-H1 comprising the amino acid sequence of SEQ ID NO: 651, b. CDR-H2 comprising the amino acid sequence of SEQ ID NO: 1193, c. CDR-H3 comprising the amino acid sequence of SEQ ID NO: 1735, d. CDR-L1 comprising the amino acid sequence of SEQ ID NO: 922, e. CDR-L2 comprising the amino acid sequence of SEQ ID NO: 1464, and f. CDR-L3 comprising the amino acid sequence of SEQ ID NO: 2006.

In one aspect, the present disclosure provides an antibody or antigen-binding fragment thereof comprising a CDR-H3 comprising the amino acid sequence of SEQ ID NO: 1735, and a CDR-L3 comprising the amino acid sequence of SEQ ID NO: 2006.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 651, b. CDR-H2 comprising the amino acid sequence of SEQ ID NO: 1193, c. CDR-H3 comprising the amino acid sequence of SEQ ID NO: 1735, and a VL comprising the amino acid sequence of SEQ ID NO: 380.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 922, b. CDR-L2 comprising the amino acid sequence of SEQ ID NO: 1464, c. CDR-L3 comprising the amino acid sequence of SEQ ID NO: 2006, and a VH comprising the amino acid sequence of SEQ ID NO: 109.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 109. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 109. In some embodiments, substitutions, antigen-binding fragment thereof comprises the VH sequence SEQ ID NO: 109, including one or more post-translational modifications of that sequence. In a particular embodiment, the VH comprises one, two or three CDRs selected from: a. CDR-H1, comprising the amino acid sequence SEQ ID NO: 651, b. CDR-H2, comprising the amino acid sequence SEQ ID NO: 1193, and c. CDR-H3, comprising the amino acid sequence SEQ ID NO: 1735.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 380. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 380. In some embodiments, the substitutions, insertions, or deletions occur in regions outside the CDRs (e.g., in the FRs). Optionally, the antibody or antigen-binding fragment thereof comprises the VL sequence SEQ ID NO: 380, including one or more post-translational modifications of that sequence. In a particular embodiment, the VL comprises one, two or three CDRs selected from: a. CDR-L1, comprising the amino acid sequence SEQ ID NO: 922, b. CDR-L2, comprising the amino acid sequence SEQ ID NO: 1464, and c. CDR-L3, comprising the amino acid sequence SEQ ID NO: 2006.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 109, and the VL amino acid sequence of SEQ ID NO: 380, optionally including post-translational modifications of those sequences.

TKIC1001

In one aspect, the present disclosure provides an antibody or antigen-binding fragment thereof comprising at least one or both variable regions selected from: a. VH comprising the amino acid sequence of SEQ ID NO: 110 and b. VL comprising the amino acid sequence of SEQ ID NO: 381.

In one aspect, the present disclosure provides an antibody or antigen-binding fragment thereof comprising at least one, two, three, four, five, or six CDRs selected from: a. CDR-H1 comprising the amino acid sequence of SEQ ID NO: 652, b. CDR-H2 comprising the amino acid sequence of SEQ ID NO: 1194, c. CDR-H3 comprising the amino acid sequence of SEQ ID NO: 1736, d. CDR-L1 comprising the amino acid sequence of SEQ ID NO: 923, e. CDR-L2 comprising the amino acid sequence of SEQ ID NO: 1465, and f. CDR-L3 comprising the amino acid sequence of SEQ ID NO: 2007.

In one aspect, the present disclosure provides an antibody or antigen-binding fragment thereof comprising a CDR-H3 comprising the amino acid sequence of SEQ ID NO: 1736, and a CDR-L3 comprising the amino acid sequence of SEQ ID NO: 2007.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 652, b. CDR-H2 comprising the amino acid sequence of SEQ ID NO: 1194, c. CDR-H3 comprising the amino acid sequence of SEQ ID NO: 1736, and a VL comprising the amino acid sequence of SEQ ID NO: 381.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 923, b. CDR-L2 comprising the amino acid sequence of SEQ ID NO: 1465, c. CDR-L3 comprising the amino acid sequence of SEQ ID NO: 2007, and a VH comprising the amino acid sequence of SEQ ID NO: 110.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 110. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 110. In some embodiments, substitutions, insertions, or deletions occur in regions outside the CDRs (e.g., in the FRs). Optionally, the antibody or antigen-binding fragment thereof comprises the VH sequence SEQ ID NO: 110, including one or more post-translational modifications of that sequence. In a particular embodiment, the VH comprises one, two or three CDRs selected from: a. CDR-H1, comprising the amino acid sequence SEQ ID NO: 652, b. CDR-H2, comprising the amino acid sequence SEQ ID NO: 1194, and c. CDR-H3, comprising the amino acid sequence SEQ ID NO: 1736.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 381. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 381. In some embodiments, the substitutions, insertions, or deletions occur in regions outside the CDRs (e.g., in the FRs). Optionally, the antibody or antigen-binding fragment thereof comprises the VL sequence SEQ ID NO: 381, including one or more post-translational modifications of that sequence. In a particular embodiment, the VL comprises one, two or three CDRs selected from: a. CDR-L1, comprising the amino acid sequence SEQ ID NO: 923, b. CDR-L2, comprising the amino acid sequence SEQ ID NO: 1465, and c. CDR-L3, comprising the amino acid sequence SEQ ID NO: 2007.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 110, and the VL amino acid sequence of SEQ ID NO: 381, optionally including post-translational modifications of those sequences.
TKIC1002

In one aspect, the present disclosure provides an antibody or antigen-binding fragment thereof comprising at least one or both variable regions selected from: a. VH comprising the amino acid sequence of SEQ ID NO: 111 and b. VL comprising the amino acid sequence of SEQ ID NO: 382.

In one aspect, the present disclosure provides an antibody or antigen-binding fragment thereof comprising at least one, two, three, four, five, or six CDRs selected from: a. CDR-H1 comprising the amino acid sequence of SEQ ID NO: 653, b. CDR-H2 comprising the amino acid sequence of SEQ ID NO: 1195, c. CDR-H3 comprising the amino acid sequence of SEQ ID NO: 1737, d. CDR-L1 comprising the amino acid sequence of SEQ ID NO: 924, e. CDR-L2 comprising the amino acid sequence of SEQ ID NO: 1466, and f. CDR-L3 comprising the amino acid sequence of SEQ ID NO: 2008.

In one aspect, the present disclosure provides an antibody or antigen-binding fragment thereof comprising a CDR-H3 comprising the amino acid sequence of SEQ ID NO: 1737, and a CDR-L3 comprising the amino acid sequence of SEQ ID NO: 2008.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 653, b. CDR-H2 comprising the amino acid sequence of SEQ ID NO: 1195, c. CDR-H3 comprising the amino acid sequence of SEQ ID NO: 1737, and a VL comprising the amino acid sequence of SEQ ID NO: 382.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 924, b. CDR-L2 comprising the amino acid sequence of SEQ ID NO: 1466, c. CDR-L3 comprising the amino acid sequence of SEQ ID NO: 2008, and a VH comprising the amino acid sequence of SEQ ID NO: 111.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 111. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 111. In some embodiments, substitutions, insertions, or deletions occur in regions outside the CDRs (e.g., in the FRs). Optionally, the antibody or antigen-binding fragment thereof comprises the VH sequence SEQ ID NO: 111, including one or more post-translational modifications of that sequence. In a particular embodiment, the VH comprises one, two or three CDRs selected from: a. CDR-H1, comprising the amino acid sequence SEQ ID NO: 653, b. CDR-H2, comprising the amino acid sequence SEQ ID NO: 1195, and c. CDR-H3, comprising the amino acid sequence SEQ ID NO: 1737.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 382. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 382. In some embodiments, the substitutions, insertions, or deletions occur in regions outside the CDRs (e.g., in the FRs). Optionally, the antibody or antigen-binding fragment thereof comprises the VL sequence SEQ ID NO: 382, including one or more post-translational modifications of that sequence. In a particular embodiment, the VL comprises one, two or three CDRs selected from: a. CDR-L1, comprising the amino acid sequence SEQ ID NO: 924, b. CDR-L2, comprising the amino acid sequence SEQ ID NO: 1466, and c. CDR-L3, comprising the amino acid sequence SEQ ID NO: 2008.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 111, and the VL amino acid sequence of SEQ ID NO: 382, optionally including post-translational modifications of those sequences.
TKIC1003

In one aspect, the present disclosure provides an antibody or antigen-binding fragment thereof comprising at least one or both variable regions selected from: a. VH comprising the amino acid sequence of SEQ ID NO: 112 and b. VL comprising the amino acid sequence of SEQ ID NO: 383.

In one aspect, the present disclosure provides an antibody or antigen-binding fragment thereof comprising at least one, two, three, four, five, or six CDRs selected from: a. CDR-H1 comprising the amino acid sequence of SEQ ID NO: 654, b. CDR-H2 comprising the amino acid sequence of SEQ ID NO: 1196, c. CDR-H3 comprising the amino acid sequence of SEQ ID NO: 1738, d. CDR-L1 comprising the amino acid sequence of SEQ ID NO: 925, e. CDR-L2 comprising the amino acid sequence of SEQ ID NO: 1467, and f. CDR-L3 comprising the amino acid sequence of SEQ ID NO: 2009.

In one aspect, the present disclosure provides an antibody or antigen-binding fragment thereof comprising a CDR-H3 comprising the amino acid sequence of SEQ ID NO: 1738, and a CDR-L3 comprising the amino acid sequence of SEQ ID NO: 2009.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 654, b. CDR-H2 comprising the amino acid sequence of SEQ ID NO: 1196, c. CDR-H3 comprising the amino acid sequence of SEQ ID NO: 1738, and a VL comprising the amino acid sequence of SEQ ID NO: 383.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 925, b. CDR-L2 comprising the amino acid sequence of SEQ ID NO: 1467, c. CDR-L3 comprising the amino acid sequence of SEQ ID NO: 2009, and a VH comprising the amino acid sequence of SEQ ID NO: 112.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 112. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 112. In some embodiments, substitutions, insertions, or deletions occur in regions outside the CDRs (e.g., in the FRs). Optionally, the antibody or antigen-binding fragment thereof comprises the VH sequence SEQ ID NO: 112, including one or more post-translational modifications of that sequence. In a particular embodiment, the VH comprises one, two or three CDRs selected from: a. CDR-H1, comprising the amino acid sequence SEQ ID NO: 654, b. CDR-H2, comprising the amino acid sequence SEQ ID NO: 1196, and c. CDR-H3, comprising the amino acid sequence SEQ ID NO: 1738.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 383. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 383. In some embodiments, the substitutions, insertions, or deletions occur in regions outside the CDRs (e.g., in the FRs). Optionally, the antibody or antigen-binding fragment thereof comprises the VL sequence SEQ ID NO: 383, including one or more post-translational modifications of that sequence. In a particular embodiment, the VL comprises one, two or three CDRs selected from: a. CDR-L1, comprising the amino acid sequence SEQ ID NO: 925, b. CDR-L2, comprising the amino acid sequence SEQ ID NO: 1467, and c. CDR-L3, comprising the amino acid sequence SEQ ID NO: 2009.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 112, and the VL amino acid sequence of SEQ ID NO: 383, optionally including post-translational modifications of those sequences.

TKIC1004

In one aspect, the present disclosure provides an antibody or antigen-binding fragment thereof comprising at least one or both variable regions selected from: a. VH comprising the amino acid sequence of SEQ ID NO: 113 and b. VL comprising the amino acid sequence of SEQ ID NO: 384.

In one aspect, the present disclosure provides an antibody or antigen-binding fragment thereof comprising at least one, two, three, four, five, or six CDRs selected from: a. CDR-H1 comprising the amino acid sequence of SEQ ID NO: 655, b. CDR-H2 comprising the amino acid sequence of SEQ ID NO: 1197, c. CDR-H3 comprising the amino acid sequence of SEQ ID NO: 1739, d. CDR-L1 comprising the amino acid sequence of SEQ ID NO: 926, e. CDR-L2 comprising the amino acid sequence of SEQ ID NO: 1468, and f. CDR-L3 comprising the amino acid sequence of SEQ ID NO: 2010.

In one aspect, the present disclosure provides an antibody or antigen-binding fragment thereof comprising a CDR-H3 comprising the amino acid sequence of SEQ ID NO: 1739, and a CDR-L3 comprising the amino acid sequence of SEQ ID NO: 2010.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 655, b. CDR-H2 comprising the amino acid sequence of SEQ ID NO: 1197, c. CDR-H3 comprising the amino acid sequence of SEQ ID NO: 1739, and a VL comprising the amino acid sequence of SEQ ID NO: 384.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 926, b. CDR-L2 comprising the amino acid sequence of SEQ ID NO: 1468, c. CDR-L3 comprising the amino acid sequence of SEQ ID NO: 2010, and a VH comprising the amino acid sequence of SEQ ID NO: 113.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 113. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 113. In some embodiments, substitutions, insertions, or deletions occur in regions outside the CDRs (e.g., in the FRs). Optionally, the antibody or antigen-binding fragment thereof comprises the VH sequence SEQ ID NO: 113, including one or more post-translational modifications of that sequence. In a particular embodiment, the VH comprises one, two or three CDRs selected from: a. CDR-H1, comprising the amino acid sequence SEQ ID NO: 655, b. CDR-H2, comprising the amino acid sequence SEQ ID NO: 1197, and c. CDR-H3, comprising the amino acid sequence SEQ ID NO: 1739.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 384. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 384. In some embodiments, the substitutions, insertions, or deletions occur in regions outside the CDRs (e.g., in the FRs). Optionally, the antibody or antigen-binding fragment thereof comprises the VL sequence SEQ ID NO: 384, including one or more post-translational modifications of that sequence. In a particular embodiment, the VL comprises one, two or three CDRs selected from: a. CDR-L1, comprising the amino acid sequence SEQ ID NO: 926, b. CDR-L2, comprising the amino acid sequence SEQ ID NO: 1468, and c. CDR-L3, comprising the amino acid sequence SEQ ID NO: 2010.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 113, and the VL amino acid sequence of SEQ ID NO: 384, optionally including post-translational modifications of those sequences.

TKIC1005

In one aspect, the present disclosure provides an antibody or antigen-binding fragment thereof comprising at least one or both variable regions selected from: a. VH comprising the amino acid sequence of SEQ ID NO: 114 and b. VL comprising the amino acid sequence of SEQ ID NO: 385.

In one aspect, the present disclosure provides an antibody or antigen-binding fragment thereof comprising at least one, two, three, four, five, or six CDRs selected from: a. CDR-H1 comprising the amino acid sequence of SEQ ID NO: 656, b. CDR-H2 comprising the amino acid sequence of SEQ ID NO: 1198, c. CDR-H3 comprising the amino acid sequence of SEQ ID NO: 1740, d. CDR-L1 comprising the amino acid sequence of SEQ ID NO: 927, e. CDR-L2 comprising the amino acid sequence of SEQ ID NO: 1469, and f. CDR-L3 comprising the amino acid sequence of SEQ ID NO: 2011.

In one aspect, the present disclosure provides an antibody or antigen-binding fragment thereof comprising a CDR-H3 comprising the amino acid sequence of SEQ ID NO: 1740, and a CDR-L3 comprising the amino acid sequence of SEQ ID NO: 2011.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 656, b. CDR-H2 comprising the amino acid sequence of SEQ ID NO: 1198, c. CDR-H3 comprising the amino acid sequence of SEQ ID NO: 1740, and a VL comprising the amino acid sequence of SEQ ID NO: 385.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 927, b. CDR-L2 comprising the amino acid sequence of SEQ ID NO: 1469, c. CDR-L3 comprising the amino acid sequence of SEQ ID NO: 2011, and a VH comprising the amino acid sequence of SEQ ID NO: 114.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 114. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 114. In some embodiments, substitutions, insertions, or deletions occur in regions outside the CDRs (e.g., in the FRs). Optionally, the antibody or antigen-binding fragment thereof comprises the VH sequence SEQ ID NO: 114, including one or more post-translational modifications of that sequence. In a particular embodiment, the VH comprises one, two or three CDRs selected from: a. CDR-H1, comprising the amino acid sequence SEQ ID NO: 656, b. CDR-H2, comprising the amino acid sequence SEQ ID NO: 1198, and c. CDR-H3, comprising the amino acid sequence SEQ ID NO: 1740.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 385. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 385. In some embodiments, the substitutions, insertions, or deletions occur in regions outside the CDRs (e.g., in the FRs). Optionally, the antibody or antigen-binding fragment thereof comprises the VL sequence SEQ ID NO: 385, including one or more post-translational modifications of that sequence. In a particular embodiment, the VL comprises one, two or three CDRs selected from: a. CDR-L1, comprising the amino acid sequence SEQ ID NO: 927, b. CDR-L2, comprising the amino acid sequence SEQ ID NO: 1469, and c. CDR-L3, comprising the amino acid sequence SEQ ID NO: 2011.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 114, and the VL amino acid sequence of SEQ ID NO: 385, optionally including post-translational modifications of those sequences.

TKIC1006

In one aspect, the present disclosure provides an antibody or antigen-binding fragment thereof comprising at least one or both variable regions selected from: a. VH comprising the amino acid sequence of SEQ ID NO: 115 and b. VL comprising the amino acid sequence of SEQ ID NO: 386.

In one aspect, the present disclosure provides an antibody or antigen-binding fragment thereof comprising at least one, two, three, four, five, or six CDRs selected from: a. CDR-H1 comprising the amino acid sequence of SEQ ID NO: 657, b. CDR-H2 comprising the amino acid sequence of SEQ ID NO: 1199, c. CDR-H3 comprising the amino acid sequence of SEQ ID NO: 1741, d. CDR-L1 comprising the amino acid sequence of SEQ ID NO: 928, e. CDR-L2 comprising the amino acid sequence of SEQ ID NO: 1470, and f. CDR-L3 comprising the amino acid sequence of SEQ ID NO: 2012.

In one aspect, the present disclosure provides an antibody or antigen-binding fragment thereof comprising a CDR-H3 comprising the amino acid sequence of SEQ ID NO: 1741, and a CDR-L3 comprising the amino acid sequence of SEQ ID NO: 2012.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 657, b. CDR-H2 comprising the amino acid sequence of SEQ ID NO: 1199, c. CDR-H3 comprising the amino acid sequence of SEQ ID NO: 1741, and a VL comprising the amino acid sequence of SEQ ID NO: 386.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 928, c. CDR-L2 comprising the amino acid sequence of SEQ ID NO: 1470, d. CDR-L3 comprising the amino acid sequence of SEQ ID NO: 2012, and a VH comprising the amino acid sequence of SEQ ID NO: 115.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 115. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 115. In some embodiments, substitutions, insertions, or deletions occur in regions outside the CDRs (e.g., in the FRs). Optionally, the antibody or antigen-binding fragment thereof comprises the VH sequence SEQ ID NO: 115, including one or more post-translational modifications of that sequence. In a particular embodiment, the VH comprises one, two or three CDRs selected from: a. CDR-H1, comprising the amino acid sequence SEQ ID NO: 657, b. CDR-H2, comprising the amino acid sequence SEQ ID NO: 1199, and c. CDR-H3, comprising the amino acid sequence SEQ ID NO: 1741.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 386. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 386. In some embodiments, the substitutions, insertions, or deletions occur in regions outside the CDRs (e.g., in the FRs). Optionally, the antibody or antigen-binding fragment thereof comprises the VL sequence SEQ ID NO: 386, including one or more post-translational modifications of that sequence. In a particular embodiment, the VL comprises one, two or three CDRs selected from: a. CDR-L1, comprising the amino acid sequence SEQ ID NO: 928, b. CDR-L2, comprising the amino acid sequence SEQ ID NO: 1470, and c. CDR-L3, comprising the amino acid sequence SEQ ID NO: 2012.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 115, and the VL amino acid sequence of SEQ ID NO: 386, optionally including post-translational modifications of those sequences.

TKIC1007

In one aspect, the present disclosure provides an antibody or antigen-binding fragment thereof comprising at least one or both variable regions selected from: a. VH comprising the amino acid sequence of SEQ ID NO: 116 and b. VL comprising the amino acid sequence of SEQ ID NO: 387.

In one aspect, the present disclosure provides an antibody or antigen-binding fragment thereof comprising at least one, two, three, four, five, or six CDRs selected from: a. CDR-H1 comprising the amino acid sequence of SEQ ID NO: 658, b. CDR-H2 comprising the amino acid sequence of SEQ ID NO: 1200, c. CDR-H3 comprising the amino acid sequence of SEQ ID NO: 1742, d. CDR-L1 comprising the amino acid sequence of SEQ ID NO: 929, e. CDR-L2 comprising the amino acid sequence of SEQ ID NO: 1471, and f. CDR-L3 comprising the amino acid sequence of SEQ ID NO: 2013.

In one aspect, the present disclosure provides an antibody or antigen-binding fragment thereof comprising a CDR-H3 comprising the amino acid sequence of SEQ ID NO: 1742 and a CDR-L3 comprising the amino acid sequence of SEQ ID NO: 2013.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 658, b. CDR-H2 comprising the amino acid sequence of SEQ ID NO: 1200, c. CDR-H3 comprising the amino acid sequence of SEQ ID NO: 1742, and a VL comprising the amino acid sequence of SEQ ID NO: 387.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 929, b. CDR-L2 comprising the amino acid sequence of SEQ ID NO: 1471, c. CDR-L3 comprising the amino acid sequence of SEQ ID NO: 2013, and a VH comprising the amino acid sequence of SEQ ID NO: 116.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 116. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 116. In some embodiments, substitutions, insertions, or deletions occur in regions outside the CDRs (e.g., in the FRs). Optionally, the antibody or antigen-binding fragment thereof comprises the VH sequence SEQ ID NO: 116, including one or more post-translational modifications of that sequence. In a particular embodiment, the VH comprises one, two or three CDRs selected from: a. CDR-H1, comprising the amino acid sequence SEQ ID NO: 658, b. CDR-H2, comprising the amino acid sequence SEQ ID NO: 1200, and c. CDR-H3, comprising the amino acid sequence SEQ ID NO: 1742.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 387. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 387. In some embodiments, the substitutions, insertions, or deletions occur in regions outside the CDRs (e.g., in the FRs). Optionally, the antibody or antigen-binding fragment thereof comprises the VL sequence SEQ ID NO: 387, including one or more post-translational modifications of that sequence. In a particular embodiment, the VL comprises one, two or three CDRs selected from: a. CDR-L1, comprising the amino acid sequence SEQ ID NO: 929, b. CDR-L2, comprising the amino acid sequence SEQ ID NO: 1471, and c. CDR-L3, comprising the amino acid sequence SEQ ID NO: 2013.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 116, and the VL amino acid sequence of SEQ ID NO: 387, optionally including post-translational modifications of those sequences.
TKIC1008

In one aspect, the present disclosure provides an antibody or antigen-binding fragment thereof comprising at least one or both variable regions selected from: a. VH comprising the amino acid sequence of SEQ ID NO: 117 and b. VL comprising the amino acid sequence of SEQ ID NO: 388.

In one aspect, the present disclosure provides an antibody or antigen-binding fragment thereof comprising at least one, two, three, four, five, or six CDRs selected from: a. CDR-H1 comprising the amino acid sequence of SEQ ID NO: 659, b. CDR-H2 comprising the amino acid sequence of SEQ ID NO: 1201, c. CDR-H3 comprising the amino acid sequence of SEQ ID NO: 1743, d. CDR-L1 comprising the amino acid sequence of SEQ ID NO: 930, e. CDR-L2 comprising the amino acid sequence of SEQ ID NO: 1472, and f. CDR-L3 comprising the amino acid sequence of SEQ ID NO: 2014.

In one aspect, the present disclosure provides an antibody or antigen-binding fragment thereof comprising a CDR-H3 comprising the amino acid sequence of SEQ ID NO: 1743, and a CDR-L3 comprising the amino acid sequence of SEQ ID NO: 2014.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 659, b. CDR-H2 comprising the amino acid sequence of SEQ ID NO: 1201, c. CDR-H3 comprising the amino acid sequence of SEQ ID NO: 1743, and a VL comprising the amino acid sequence of SEQ ID NO: 388.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 930, b. CDR-L2 comprising the amino acid sequence of SEQ ID NO: 1472, c. CDR-L3 comprising the amino acid sequence of SEQ ID NO: 2014, and a VH comprising the amino acid sequence of SEQ ID NO: 117.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 117. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 117. In some embodiments, substitutions, insertions, or deletions occur in regions outside the CDRs (e.g., in the FRs). Optionally, the antibody or antigen-binding fragment thereof comprises the VH sequence SEQ ID NO: 117, including one or more post-translational modifications of that sequence. In a particular embodiment, the VH comprises one, two or three CDRs selected from: a. CDR-H1, comprising the amino acid sequence SEQ ID NO: 659, b. CDR-H2, comprising the amino acid sequence SEQ ID NO: 1201, and c. CDR-H3, comprising the amino acid sequence SEQ ID NO: 1743.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 388. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 388. In some embodiments, the substitutions, insertions, or deletions occur in regions outside the CDRs (e.g., in the FRs). Optionally, the antibody or antigen-binding fragment thereof comprises the VL sequence SEQ ID NO: 388, including one or more post-translational modifications of that sequence. In a particular embodiment, the VL comprises one, two or three CDRs selected from: a. CDR-L1, comprising the amino acid sequence SEQ ID NO: 930, b. CDR-L2, comprising the amino acid sequence SEQ ID NO: 1472, and c. CDR-L3, comprising the amino acid sequence SEQ ID NO: 2014.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 117, and the VL amino acid sequence of SEQ ID NO: 388, optionally including post-translational modifications of those sequences.
TKIC1009

In one aspect, the present disclosure provides an antibody or antigen-binding fragment thereof comprising at least one or both variable regions selected from: a. VH comprising the amino acid sequence of SEQ ID NO: 118 and b. VL comprising the amino acid sequence of SEQ ID NO: 389.

In one aspect, the present disclosure provides an antibody or antigen-binding fragment thereof comprising at least one, two, three, four, five, or six CDRs selected from: a. CDR-H1 comprising the amino acid sequence of SEQ ID NO: 660, b. CDR-H2 comprising the amino acid sequence of SEQ ID NO: 1202, c. CDR-H3 comprising the amino acid sequence of SEQ ID NO: 1744, d. CDR-L1 comprising the amino acid sequence of SEQ ID NO: 931, e. CDR-L2 comprising the amino acid sequence of SEQ ID NO: 1473, and f. CDR-L3 comprising the amino acid sequence of SEQ ID NO: 2015.

In one aspect, the present disclosure provides an antibody or antigen-binding fragment thereof comprising a CDR-H3 comprising the amino acid sequence of SEQ ID NO: 1744, and a CDR-L3 comprising the amino acid sequence of SEQ ID NO: 2015.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 660, b. CDR-H2 comprising the amino acid sequence of SEQ ID NO: 1202, c. CDR-H3 comprising the amino acid sequence of SEQ ID NO: 1744, and a VL comprising the amino acid sequence of SEQ ID NO: 389.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 931, b. CDR-L2 comprising the amino acid sequence of SEQ ID NO: 1473, c. CDR-L3 comprising the amino acid sequence of SEQ ID NO: 2015, and a VH comprising the amino acid sequence of SEQ ID NO: 118.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 118. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 118. In some embodiments, substitutions, insertions, or deletions occur in regions outside the CDRs (e.g., in the FRs). Optionally, the antibody or antigen-binding fragment thereof comprises the VH sequence SEQ ID NO: 118, including one or more post-translational modifications of that sequence. In a particular embodiment, the VH comprises one, two or three CDRs selected from: a. CDR-H1, comprising the amino acid sequence SEQ ID NO: 660, b. CDR-H2, comprising the amino acid sequence SEQ ID NO: 1202, and c. CDR-H3, comprising the amino acid sequence SEQ ID NO: 1744.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 389. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 389. In some embodiments, the substitutions, insertions, or deletions occur in regions outside the CDRs (e.g., in the FRs). Optionally, the antibody or antigen-binding fragment thereof comprises the VL sequence SEQ ID NO: 389, including one or more post-translational modifications of that sequence. In a particular embodiment, the VL comprises one, two or three CDRs selected from: a. CDR-L1, comprising the amino acid sequence SEQ ID NO: 931, b. CDR-L2, comprising the amino acid sequence SEQ ID NO: 1473, and c. CDR-L3, comprising the amino acid sequence SEQ ID NO: 2015.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 118, and the VL amino acid sequence of SEQ ID NO: 389, optionally including post-translational modifications of those sequences.
TKIC1010

In one aspect, the present disclosure provides an antibody or antigen-binding fragment thereof comprising at least one or both variable regions selected from: a. VH comprising the amino acid sequence of SEQ ID NO: 119 and b. VL comprising the amino acid sequence of SEQ ID NO: 390.

In one aspect, the present disclosure provides an antibody or antigen-binding fragment thereof comprising at least one, two, three, four, five, or six CDRs selected from: a. CDR-H1 comprising the amino acid sequence of SEQ ID NO: 661, b. CDR-H2 comprising the amino acid sequence of SEQ ID NO: 1203, c. CDR-H3 comprising the amino acid sequence of SEQ ID NO: 1745, d. CDR-L1 comprising the amino acid sequence of SEQ ID NO: 932, e. CDR-L2 comprising the amino acid sequence of SEQ ID NO: 1474, and f. CDR-L3 comprising the amino acid sequence of SEQ ID NO: 2016.

In one aspect, the present disclosure provides an antibody or antigen-binding fragment thereof comprising a CDR-H3 comprising the amino acid sequence of SEQ ID NO: 1745, and a CDR-L3 comprising the amino acid sequence of SEQ ID NO: 2016.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 661, b. CDR-H2 comprising the amino acid sequence of SEQ ID NO: 1203, c. CDR-H3 comprising the amino acid sequence of SEQ ID NO: 1745, and a VL comprising the amino acid sequence of SEQ ID NO: 390.

In one aspect, the present disclosure provides an antibody or antigen-binding fragment thereof comprising at least one, at least two, or all three VL CDR sequences selected from: a CDR-L1 comprising the amino acid sequence of SEQ ID NO: 932, b. CDR-L2 comprising the amino acid sequence of SEQ ID NO: 1474, c. CDR-L3 comprising the amino acid sequence of SEQ ID NO: 2016, and d. VH comprising the amino acid sequence of SEQ ID NO: 119.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 119. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 119. In some embodiments, substitutions, insertions, or deletions occur in regions outside the CDRs (e.g., in the FRs). Optionally, the antibody or antigen-binding fragment thereof comprises the VH sequence SEQ ID NO: 119, including one or more post-translational modifications of that sequence. In a particular embodiment, the VH comprises one, two or three CDRs selected from: a. CDR-H1, comprising the amino acid sequence SEQ ID NO: 661, b. CDR-H2, comprising the amino acid sequence SEQ ID NO: 1203, and c. CDR-H3, comprising the amino acid sequence SEQ ID NO: 1745.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 390. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 390. In some embodiments, the substitutions, insertions, or deletions occur in regions outside the CDRs (e.g., in the FRs). Optionally, the antibody or antigen-binding fragment thereof comprises the VL sequence SEQ ID NO: 390, including one or more post-translational modifications of that sequence. In a particular embodiment, the VL comprises one, two or three CDRs selected from: a. CDR-L1, comprising the amino acid sequence SEQ ID NO: 932, b. CDR-L2, comprising the amino acid sequence SEQ ID NO: 1474, and c. CDR-L3, comprising the amino acid sequence SEQ ID NO: 2016.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 119, and the VL amino acid sequence of SEQ ID NO: 390, optionally including post-translational modifications of those sequences.

TKIC1011

In one aspect, the present disclosure provides an antibody or antigen-binding fragment thereof comprising at least one or both variable regions selected from: a. VH comprising the amino acid sequence of SEQ ID NO: 120 and b. VL comprising the amino acid sequence of SEQ ID NO: 391.

In one aspect, the present disclosure provides an antibody or antigen-binding fragment thereof comprising at least one, two, three, four, five, or six CDRs selected from: a. CDR-H1 comprising the amino acid sequence of SEQ ID NO: 662, b. CDR-H2 comprising the amino acid sequence of SEQ ID NO: 1204, c. CDR-H3 comprising the amino acid sequence of SEQ ID NO: 1746, d. CDR-L1 comprising the amino acid sequence of SEQ ID NO: 933, e. CDR-L2 comprising the amino acid sequence of SEQ ID NO: 1475, and f. CDR-L3 comprising the amino acid sequence of SEQ ID NO: 2017.

In one aspect, the present disclosure provides an antibody or antigen-binding fragment thereof comprising a CDR-H3 comprising the amino acid sequence of SEQ ID NO: 1746, and a CDR-L3 comprising the amino acid sequence of SEQ ID NO: 2017.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 662, b. CDR-H2 comprising the amino acid sequence of SEQ ID NO: 1204, c. CDR-H3 comprising the amino acid sequence of SEQ ID NO: 1746, and a VL comprising the amino acid sequence of SEQ ID NO: 391.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 933, b. CDR-L2 comprising the amino acid sequence of SEQ ID NO: 1475, c. CDR-L3 comprising the amino acid sequence of SEQ ID NO: 2017, and a VH comprising the amino acid sequence of SEQ ID NO: 120.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 120. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 120. In some embodiments, substitutions, insertions, or deletions occur in regions outside the CDRs (e.g., in the FRs). Optionally, the antibody or antigen-binding fragment thereof comprises the VH sequence SEQ ID NO: 120, including one or more post-translational modifications of that sequence. In a particular embodiment, the VH comprises one, two or three CDRs selected from: a. CDR-H1, comprising the amino acid sequence SEQ ID NO: 662, b. CDR-H2, comprising the amino acid sequence SEQ ID NO: 1204, and c. CDR-H3, comprising the amino acid sequence SEQ ID NO: 1746.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 391. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 391. In some embodiments, the substitutions, insertions, or deletions occur in regions outside the CDRs (e.g., in the FRs). Optionally, the antibody or antigen-binding fragment thereof comprises the VL sequence SEQ ID NO: 391, including one or more post-translational modifications of that sequence. In a particular embodiment, the VL comprises one, two or three CDRs selected from: a. CDR-L1, comprising the amino acid sequence SEQ ID NO: 933, b. CDR-L2, comprising the amino acid sequence SEQ ID NO: 1475, and c. CDR-L3, comprising the amino acid sequence SEQ ID NO: 2017.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 120, and the VL amino acid sequence of SEQ ID NO: 391, optionally including post-translational modifications of those sequences.
TKIC1012

In one aspect, the present disclosure provides an antibody or antigen-binding fragment thereof comprising at least one or both variable regions selected from: a. VH comprising the amino acid sequence of SEQ ID NO: 121 and b. VL comprising the amino acid sequence of SEQ ID NO: 392.

In one aspect, the present disclosure provides an antibody or antigen-binding fragment thereof comprising at least one, two, three, four, five, or six CDRs selected from: a. CDR-H1 comprising the amino acid sequence of SEQ ID NO: 663, b. CDR-H2 comprising the amino acid sequence of SEQ ID NO: 1205, c. CDR-H3 comprising the amino acid sequence of SEQ ID NO: 1747, d. CDR-L1 comprising the amino acid sequence of SEQ ID NO: 934, e. CDR-L2 comprising the amino acid sequence of SEQ ID NO: 1476, and f. CDR-L3 comprising the amino acid sequence of SEQ ID NO: 2018.

In one aspect, the present disclosure provides an antibody or antigen-binding fragment thereof comprising a CDR-H3 comprising the amino acid sequence of SEQ ID NO: 1747, and a CDR-L3 comprising the amino acid sequence of SEQ ID NO: 2018.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 663, b. CDR-H2 comprising the amino acid sequence of SEQ ID NO: 1205, c. CDR-H3 comprising the amino acid sequence of SEQ ID NO: 1747, and a VL comprising the amino acid sequence of SEQ ID NO: 392.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 934, b. CDR-L2 comprising the amino acid sequence of SEQ ID NO: 1476, c. CDR-L3 comprising the amino acid sequence of SEQ ID NO: 2018, and a VH comprising the amino acid sequence of SEQ ID NO: 121.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 121. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 121. In some embodiments, substitutions, insertions, or deletions occur in regions outside the CDRs (e.g., in the FRs). Optionally, the antibody or antigen-binding fragment thereof comprises the VH sequence SEQ ID NO: 121, including one or more post-translational modifications of that sequence. In a particular embodiment, the VH comprises one, two or three CDRs selected from: a. CDR-H1, comprising the amino acid sequence SEQ ID NO: 663, b. CDR-H2, comprising the amino acid sequence SEQ ID NO: 1205, and c. CDR-H3, comprising the amino acid sequence SEQ ID NO: 1747.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 392. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 392. In some embodiments, the substitutions, insertions, or deletions occur in regions outside the CDRs (e.g., in the FRs). Optionally, the antibody or antigen-binding fragment thereof comprises the VL sequence SEQ ID NO: 392, including one or more post-translational modifications of that sequence. In a particular embodiment, the VL comprises one, two or three CDRs selected from: a. CDR-L1, comprising the amino acid sequence SEQ ID NO: 934, b. CDR-L2, comprising the amino acid sequence SEQ ID NO: 1476, and c. CDR-L3, comprising the amino acid sequence SEQ ID NO: 2018.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 121, and the VL amino acid sequence of SEQ ID NO: 392, optionally including post-translational modifications of those sequences.

TKIC1013

In one aspect, the present disclosure provides an antibody or antigen-binding fragment thereof comprising at least one or both variable regions selected from: a. VH comprising the amino acid sequence of SEQ ID NO: 122 and b. VL comprising the amino acid sequence of SEQ ID NO: 393.

In one aspect, the present disclosure provides an antibody or antigen-binding fragment thereof comprising at least one, two, three, four, five, or six CDRs selected from: a. CDR-H1 comprising the amino acid sequence of SEQ ID NO: 664, b. CDR-H2 comprising the amino acid sequence of SEQ ID NO: 1206, c. CDR-H3 comprising the amino acid sequence of SEQ ID NO: 1748, d. CDR-L1 comprising the amino acid sequence of SEQ ID NO: 935, e. CDR-L2 comprising the amino acid sequence of SEQ ID NO: 1477, and f. CDR-L3 comprising the amino acid sequence of SEQ ID NO: 2019.

In one aspect, the present disclosure provides an antibody or antigen-binding fragment thereof comprising a CDR-H3 comprising the amino acid sequence of SEQ ID NO: 1748, and a CDR-L3 comprising the amino acid sequence of SEQ ID NO: 2019.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 664, b. CDR-H2 comprising the amino acid sequence of SEQ ID NO: 1206, c. CDR-H3 comprising the amino acid sequence of SEQ ID NO: 1748, and a VL comprising the amino acid sequence of SEQ ID NO: 393.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 935, b. CDR-L2 comprising the amino acid sequence of SEQ ID NO: 1477, c. CDR-L3 comprising the amino acid sequence of SEQ ID NO: 2019, and a VH comprising the amino acid sequence of SEQ ID NO: 122.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 122. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 122. In some embodiments, substitutions, insertions, or deletions occur in regions outside the CDRs (e.g., in the FRs). Optionally, the antibody or antigen-binding fragment thereof comprises the VH sequence SEQ ID NO: 122, including one or more post-translational modifications of that sequence. In a particular embodiment, the VH comprises one, two or three CDRs selected from: a. CDR-H1, comprising the amino acid sequence SEQ ID NO: 664, b. CDR-H2, comprising the amino acid sequence SEQ ID NO: 1206, and c. CDR-H3, comprising the amino acid sequence SEQ ID NO: 1748.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 393. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 393. In some embodiments, the substitutions, insertions, or deletions occur in regions outside the CDRs (e.g., in the FRs). Optionally, the antibody or antigen-binding fragment thereof comprises the VL sequence SEQ ID NO: 393, including one or more post-translational modifications of that sequence. In a particular embodiment, the VL comprises one, two or three CDRs selected from: a. CDR-L1, comprising the amino acid sequence SEQ ID NO: 935, b. CDR-L2, comprising the amino acid sequence SEQ ID NO: 1477, and c. CDR-L3, comprising the amino acid sequence SEQ ID NO: 2019.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 122, and the VL amino acid sequence of SEQ ID NO: 393, optionally including post-translational modifications of those sequences.

TKIC1014

In one aspect, the present disclosure provides an antibody or antigen-binding fragment thereof comprising at least one or both variable regions selected from: a. VH comprising the amino acid sequence of SEQ ID NO: 123 and b. VL comprising the amino acid sequence of SEQ ID NO: 394.

In one aspect, the present disclosure provides an antibody or antigen-binding fragment thereof comprising at least one, two, three, four, five, or six CDRs selected from: a. CDR-H1 comprising the amino acid sequence of SEQ ID NO: 665, b. CDR-H2 comprising the amino acid sequence of SEQ ID NO: 1207, c. CDR-H3 comprising the amino acid sequence of SEQ ID NO: 1749, d. CDR-L1 comprising the amino acid sequence of SEQ ID NO: 936, e. CDR-L2 comprising the amino acid sequence of SEQ ID NO: 1478, and f. CDR-L3 comprising the amino acid sequence of SEQ ID NO: 2020.

In one aspect, the present disclosure provides an antibody or antigen-binding fragment thereof comprising a CDR-H3 comprising the amino acid sequence of SEQ ID NO: 1749, and a CDR-L3 comprising the amino acid sequence of SEQ ID NO: 2020.

In one aspect, the present disclosure provides an antibody or antigen-binding fragment thereof comprising at least one, at least two, or all three VH CDR sequences selected from: a CDR-H1 comprising the amino acid sequence of SEQ ID NO: 665, b. CDR-H2 comprising the amino acid sequence of SEQ ID NO: 1207, c. CDR-H3 comprising the amino acid sequence of SEQ ID NO: 1749, and a VL comprising the amino acid sequence of SEQ ID NO: 394.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 936, b. CDR-L2 comprising the amino acid sequence of SEQ ID NO: 1478, c. CDR-L3 comprising the amino acid sequence of SEQ ID NO: 2020, and a VH comprising the amino acid sequence of SEQ ID NO: 123.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 123. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 123. In some embodiments, substitutions, insertions, or deletions occur in regions outside the CDRs (e.g., in the FRs). Optionally, the antibody or antigen-binding fragment thereof comprises the VH sequence SEQ ID NO: 123, including one or more post-translational modifications of that sequence. In a particular embodiment, the VH comprises one, two or three CDRs selected from: a. CDR-H1, comprising the amino acid sequence SEQ ID NO: 665, b. CDR-H2, comprising the amino acid sequence SEQ ID NO: 1207, and c. CDR-H3, comprising the amino acid sequence SEQ ID NO: 1749.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 394. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 394. In some embodiments, the substitutions, insertions, or deletions occur in regions outside the CDRs (e.g., in the FRs). Optionally, the antibody or antigen-binding fragment thereof comprises the VL sequence SEQ ID NO: 394, including one or more post-translational modifications of that sequence. In a particular embodiment, the VL comprises one, two or three CDRs selected from: a. CDR-L1, comprising the amino acid sequence SEQ ID NO: 936, b. CDR-L2, comprising the amino acid sequence SEQ ID NO: 1478, and c. CDR-L3, comprising the amino acid sequence SEQ ID NO: 2020.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 123, and the VL amino acid sequence of SEQ ID NO: 394, optionally including post-translational modifications of those sequences.
TKIC1015

In one aspect, the present disclosure provides an antibody or antigen-binding fragment thereof comprising at least one or both variable regions selected from: a. VH comprising the amino acid sequence of SEQ ID NO: 124 and b. VL comprising the amino acid sequence of SEQ ID NO: 395.

In one aspect, the present disclosure provides an antibody or antigen-binding fragment thereof comprising at least one, two, three, four, five, or six CDRs selected from: a. CDR-H1 comprising the amino acid sequence of SEQ ID NO: 666, b. CDR-H2 comprising the amino acid sequence of SEQ ID NO: 1208, c. CDR-H3 comprising the amino acid sequence of SEQ ID NO: 1750, d. CDR-L1 comprising the amino acid sequence of SEQ ID NO: 937, e. CDR-L2 comprising the amino acid sequence of SEQ ID NO: 1479, and f. CDR-L3 comprising the amino acid sequence of SEQ ID NO: 2021.

In one aspect, the present disclosure provides an antibody or antigen-binding fragment thereof comprising a CDR-H3 comprising the amino acid sequence of SEQ ID NO: 1750 and a CDR-L3 comprising the amino acid sequence of SEQ ID NO: 2021.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 666, b. CDR-H2 comprising the amino acid sequence of SEQ ID NO: 1208, c. CDR-H3 comprising the amino acid sequence of SEQ ID NO: 1750, and a VL comprising the amino acid sequence of SEQ ID NO: 395.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 937, b. CDR-L2 comprising the amino acid sequence of SEQ ID NO: 1479, c. CDR-L3 comprising the amino acid sequence of SEQ ID NO: 2021, and a VH comprising the amino acid sequence of SEQ ID NO: 124.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 124. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 124. In some embodiments, substitutions, insertions, or deletions occur in regions outside the CDRs (e.g., in the FRs). Optionally, the antibody or antigen-binding fragment thereof comprises the VH sequence SEQ ID NO: 124, including one or more post-translational modifications of that sequence. In a particular embodiment, the VH comprises one, two or three CDRs selected from: a. CDR-H1, comprising the amino acid sequence SEQ ID NO: 666, b. CDR-H2, comprising the amino acid sequence SEQ ID NO: 1208, and c. CDR-H3, comprising the amino acid sequence SEQ ID NO: 1750.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 395. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 395. In some embodiments, the substitutions, insertions, or deletions occur in regions outside the CDRs (e.g., in the FRs). Optionally, the antibody or antigen-binding fragment thereof comprises the VL sequence SEQ ID NO: 395, including one or more post-translational modifications of that sequence. In a particular embodiment, the VL comprises one, two or three CDRs selected from: a. CDR-L1, comprising the amino acid sequence SEQ ID NO: 937, b. CDR-L2, comprising the amino acid sequence SEQ ID NO: 1479, and c. CDR-L3, comprising the amino acid sequence SEQ ID NO: 2021.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 124, and the VL amino acid sequence of SEQ ID NO: 395, optionally including post-translational modifications of those sequences.

TKIC1016

In one aspect, the present disclosure provides an antibody or antigen-binding fragment thereof comprising at least one or both variable regions selected from: a. VH comprising the amino acid sequence of SEQ ID NO: 125 and b. VL comprising the amino acid sequence of SEQ ID NO: 396.

In one aspect, the present disclosure provides an antibody or antigen-binding fragment thereof comprising at least one, two, three, four, five, or six CDRs selected from: a. CDR-H1 comprising the amino acid sequence of SEQ ID NO: 667, b. CDR-H2 comprising the amino acid sequence of SEQ ID NO: 1209, c. CDR-H3 comprising the amino acid sequence of SEQ ID NO: 1751, d. CDR-L1 comprising the amino acid sequence of SEQ ID NO: 938, e. CDR-L2 comprising the amino acid sequence of SEQ ID NO: 1480, and f. CDR-L3 comprising the amino acid sequence of SEQ ID NO: 2022.

In one aspect, the present disclosure provides an antibody or antigen-binding fragment thereof comprising a CDR-H3 comprising the amino acid sequence of SEQ ID NO: 1751, and a CDR-L3 comprising the amino acid sequence of SEQ ID NO: 2022.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 667, b. CDR-H2 comprising the amino acid sequence of SEQ ID NO: 1209, c. CDR-H3 comprising the amino acid sequence of SEQ ID NO: 1751, and a VL comprising the amino acid sequence of SEQ ID NO: 396.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 938, b. CDR-L2 comprising the amino acid sequence of SEQ ID NO: 1480, c. CDR-L3 comprising the amino acid sequence of SEQ ID NO: 2022, and a VH comprising the amino acid sequence of SEQ ID NO: 125.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 125. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 125. In some embodiments, substitutions, insertions, or deletions occur in regions outside the CDRs (e.g., in the FRs). Optionally, the antibody or antigen-binding fragment thereof comprises the VH sequence SEQ ID NO: 125, including one or more post-translational modifications of that sequence. In a particular embodiment, the VH comprises one, two or three CDRs selected from: a. CDR-H1, comprising the amino acid sequence SEQ ID NO: 667, b. CDR-H2, comprising the amino acid sequence SEQ ID NO: 1209, and c. CDR-H3, comprising the amino acid sequence SEQ ID NO: 1751.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 396. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 396. In some embodiments, the substitutions, insertions, or deletions occur in regions outside the CDRs (e.g., in the FRs). Optionally, the antibody or antigen-binding fragment thereof comprises the VL sequence SEQ ID NO: 396, including one or more post-translational modifications of that sequence. In a particular embodiment, the VL comprises one, two or three CDRs selected from: a. CDR-L1, comprising the amino acid sequence SEQ ID NO: 938, b. CDR-L2, comprising the amino acid sequence SEQ ID NO: 1480, and c. CDR-L3, comprising the amino acid sequence SEQ ID NO: 2022.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 125, and the VL amino acid sequence of SEQ ID NO: 396, optionally including post-translational modifications of those sequences.

TKIC1017

In one aspect, the present disclosure provides an antibody or antigen-binding fragment thereof comprising at least one or both variable regions selected from: a. VH comprising the amino acid sequence of SEQ ID NO: 126 and b. VL comprising the amino acid sequence of SEQ ID NO: 397.

In one aspect, the present disclosure provides an antibody or antigen-binding fragment thereof comprising at least one, two, three, four, five, or six CDRs selected from: a. CDR-H1 comprising the amino acid sequence of SEQ ID NO: 668, b. CDR-H2 comprising the amino acid sequence of SEQ ID NO: 1210, c. CDR-H3 comprising the amino acid sequence of SEQ ID NO: 1752, d. CDR-L1 comprising the amino acid sequence of SEQ ID NO: 939, e. CDR-L2 comprising the amino acid sequence of SEQ ID NO: 1481, and f. CDR-L3 comprising the amino acid sequence of SEQ ID NO: 2023.

In one aspect, the present disclosure provides an antibody or antigen-binding fragment thereof comprising a CDR-H3 comprising the amino acid sequence of SEQ ID NO: 1752, and a CDR-L3 comprising the amino acid sequence of SEQ ID NO: 2023.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 668, b. CDR-H2 comprising the amino acid sequence of SEQ ID NO: 1210, c. CDR-H3 comprising the amino acid sequence of SEQ ID NO: 1752, and a VL comprising the amino acid sequence of SEQ ID NO: 397.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 939, b. CDR-L2 comprising the amino acid sequence of SEQ ID NO: 1481, c. CDR-L3 comprising the amino acid sequence of SEQ ID NO: 2023, and a VH comprising the amino acid sequence of SEQ ID NO: 126.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 126. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 126. In some embodiments, substitutions, insertions, or deletions occur in regions outside the CDRs (e.g., in the FRs). Optionally, the antibody or antigen-binding fragment thereof comprises the VH sequence SEQ ID NO: 126, including one or more post-translational modifications of that sequence. In a particular embodiment, the VH comprises one, two or three CDRs selected from: a. CDR-H1, comprising the amino acid sequence SEQ ID NO: 668, b. CDR-H2, comprising the amino acid sequence SEQ ID NO: 1210, and c. CDR-H3, comprising the amino acid sequence SEQ ID NO: 1752.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 397. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 397. In some embodiments, the substitutions, insertions, or deletions occur in regions outside the CDRs (e.g., in the FRs). Optionally, the antibody or antigen-binding fragment thereof comprises the VL sequence SEQ ID NO: 397, including one or more post-translational modifications of that sequence. In a particular embodiment, the VL comprises one, two or three CDRs selected from: a. CDR-L1, comprising the amino acid sequence SEQ ID NO: 939, b. CDR-L2, comprising the amino acid sequence SEQ ID NO: 1481, and b. CDR-L3, comprising the amino acid sequence SEQ ID NO: 2023.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 126, and the VL amino acid sequence of SEQ ID NO: 397, optionally including post-translational modifications of those sequences.

TKIC1018

In one aspect, the present disclosure provides an antibody or antigen-binding fragment thereof comprising at least one or both variable regions selected from: a. VH comprising the amino acid sequence of SEQ ID NO: 127 and b. VL comprising the amino acid sequence of SEQ ID NO: 398.

In one aspect, the present disclosure provides an antibody or antigen-binding fragment thereof comprising at least one, two, three, four, five, or six CDRs selected from: a. CDR-H1 comprising the amino acid sequence of SEQ ID NO: 669, b. CDR-H2 comprising the amino acid sequence of SEQ ID NO: 1211, c. CDR-H3 comprising the amino acid sequence of SEQ ID NO: 1753, d. CDR-L1 comprising the amino acid sequence of SEQ ID NO: 940, e. CDR-L2 comprising the amino acid sequence of SEQ ID NO: 1482, and f. CDR-L3 comprising the amino acid sequence of SEQ ID NO: 2024.

In one aspect, the present disclosure provides an antibody or antigen-binding fragment thereof comprising a CDR-H3 comprising the amino acid sequence of SEQ ID NO: 1753, and a CDR-L3 comprising the amino acid sequence of SEQ ID NO: 2024.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 669, b. CDR-H2 comprising the amino acid sequence of SEQ ID NO: 1211, c. CDR-H3 comprising the amino acid sequence of SEQ ID NO: 1753, and a VL comprising the amino acid sequence of SEQ ID NO: 398.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 940, b. CDR-L2 comprising the amino acid sequence of SEQ ID NO: 1482, c. CDR-L3 comprising the amino acid sequence of SEQ ID NO: 2024, and a VH comprising the amino acid sequence of SEQ ID NO: 127.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 127. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 127. In some embodiments, substitutions, insertions, or deletions occur in regions outside the CDRs (e.g., in the FRs). Optionally, the antibody or antigen-binding fragment thereof comprises the VH sequence SEQ ID NO: 127, including one or more post-translational modifications of that sequence. In a particular embodiment, the VH comprises one, two or three CDRs selected from: a. CDR-H1, comprising the amino acid sequence SEQ ID NO: 669, b. CDR-H2, comprising the amino acid sequence SEQ ID NO: 1211, and c. CDR-H3, comprising the amino acid sequence SEQ ID NO: 1753.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 398. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 398. In some embodiments, the substitutions, insertions, or deletions occur in regions outside the CDRs (e.g., in the FRs). Optionally, the antibody or antigen-binding fragment thereof comprises the VL sequence SEQ ID NO: 398, including one or more post-translational modifications of that sequence. In a particular embodiment, the VL comprises one, two or three CDRs selected from: a. CDR-L1, comprising the amino acid sequence SEQ ID NO: 940, b. CDR-L2, comprising the amino acid sequence SEQ ID NO: 1482, and c. CDR-L3, comprising the amino acid sequence SEQ ID NO: 2024.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 127, and the VL amino acid sequence of SEQ ID NO: 398, optionally including post-translational modifications of those sequences.
TKIC1019

In one aspect, the present disclosure provides an antibody or antigen-binding fragment thereof comprising at least one or both variable regions selected from: a. VH comprising the amino acid sequence of SEQ ID NO: 128 and b. VL comprising the amino acid sequence of SEQ ID NO: 399.

In one aspect, the present disclosure provides an antibody or antigen-binding fragment thereof comprising at least one, two, three, four, five, or six CDRs selected from: a. CDR-H1 comprising the amino acid sequence of SEQ ID NO: 670, b. CDR-H2 comprising the amino acid sequence of SEQ ID NO: 1212, c. CDR-H3 comprising the amino acid sequence of SEQ ID NO: 1754, d. CDR-L1 comprising the amino acid sequence of SEQ ID NO: 941, e. CDR-L2 comprising the amino acid sequence of SEQ ID NO: 1483, and f. CDR-L3 comprising the amino acid sequence of SEQ ID NO: 2025.

In one aspect, the present disclosure provides an antibody or antigen-binding fragment thereof comprising a CDR-H3 comprising the amino acid sequence of SEQ ID NO: 1754, and a CDR-L3 comprising the amino acid sequence of SEQ ID NO: 2025.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 670, b. CDR-H2 comprising the amino acid sequence of SEQ ID NO: 1212, c. CDR-H3 comprising the amino acid sequence of SEQ ID NO: 1754, and a VL comprising the amino acid sequence of SEQ ID NO: 399.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 941, b. CDR-L2 comprising the amino acid sequence of SEQ ID NO: 1483, c. CDR-L3 comprising the amino acid sequence of SEQ ID NO: 2025, and a VH comprising the amino acid sequence of SEQ ID NO: 128.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 128. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 128. In some embodiments, substitutions, insertions, or deletions occur in regions outside the CDRs (e.g., in the FRs). Optionally, the antibody or antigen-binding fragment thereof comprises the VH sequence SEQ ID NO: 128, including one or more post-translational modifications of that sequence. In a particular embodiment, the VH comprises one, two or three CDRs selected from: a. CDR-H1, comprising the amino acid sequence SEQ ID NO: 670, b. CDR-H2, comprising the amino acid sequence SEQ ID NO: 1212, and c. CDR-H3, comprising the amino acid sequence SEQ ID NO: 1754.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 399. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 399. In some embodiments, the substitutions, insertions, or deletions occur in regions outside the CDRs (e.g., in the FRs). Optionally, the antibody or antigen-binding fragment thereof comprises the VL sequence SEQ ID NO: 399, including one or more post-translational modifications of that sequence. In a particular embodiment, the VL comprises one, two or three CDRs selected from: a. CDR-L1, comprising the amino acid sequence SEQ ID NO: 941, b. CDR-L2, comprising the amino acid sequence SEQ ID NO: 1483, and c. CDR-L3, comprising the amino acid sequence SEQ ID NO: 2025.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 128, and the VL amino acid sequence of SEQ ID NO: 399, optionally including post-translational modifications of those sequences.

TKIC1020

In one aspect, the present disclosure provides an antibody or antigen-binding fragment thereof comprising at least one or both variable regions selected from: a. VH comprising the amino acid sequence of SEQ ID NO: 129 and b. VL comprising the amino acid sequence of SEQ ID NO: 400.

In one aspect, the present disclosure provides an antibody or antigen-binding fragment thereof comprising at least one, two, three, four, five, or six CDRs selected from: a. CDR-H1 comprising the amino acid sequence of SEQ ID NO: 671, b. CDR-H2 comprising the amino acid sequence of SEQ ID NO: 1213, c. CDR-H3 comprising the amino acid sequence of SEQ ID NO: 1755, d. CDR-L1 comprising the amino acid sequence of SEQ ID NO: 942, e. CDR-L2 comprising the amino acid sequence of SEQ ID NO: 1484, and f. CDR-L3 comprising the amino acid sequence of SEQ ID NO: 2026.

In one aspect, the present disclosure provides an antibody or antigen-binding fragment thereof comprising a CDR-H3 comprising the amino acid sequence of SEQ ID NO: 1755, and a CDR-L3 comprising the amino acid sequence of SEQ ID NO: 2026.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 671, b. CDR-H2 comprising the amino acid sequence of SEQ ID NO: 1213, c. CDR-H3 comprising the amino acid sequence of SEQ ID NO: 1755, and a VL comprising the amino acid sequence of SEQ ID NO: 400.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 942, b. CDR-L2 comprising the amino acid sequence of SEQ ID NO: 1484, c. CDR-L3 comprising the amino acid sequence of SEQ ID NO: 2026, and a VH comprising the amino acid sequence of SEQ ID NO: 129.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 129. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 129. In some embodiments, substitutions, insertions, or deletions occur in regions outside the CDRs (e.g., in the FRs). Optionally, the antibody or antigen-binding fragment thereof comprises the VH sequence SEQ ID NO: 129, including one or more post-translational modifications of that sequence. In a particular embodiment, the VH comprises one, two or three CDRs selected from: a. CDR-H1, comprising the amino acid sequence SEQ ID NO: 671, b. CDR-H2, comprising the amino acid sequence SEQ ID NO: 1213, and c. CDR-H3, comprising the amino acid sequence SEQ ID NO: 1755.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 400. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 400. In some embodiments, the substitutions, insertions, or deletions occur in regions outside the CDRs (e.g., in the FRs). Optionally, the antibody or antigen-binding fragment thereof comprises the VL sequence SEQ ID NO: 400, including one or more post-translational modifications of that sequence. In a particular embodiment, the VL comprises one, two or three CDRs selected from: a. CDR-L1, comprising the amino acid sequence SEQ ID NO: 942, b. CDR-L2, comprising the amino acid sequence SEQ ID NO: 1484, and c. CDR-L3, comprising the amino acid sequence SEQ ID NO: 2026.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 129, and the VL amino acid sequence of SEQ ID NO: 400, optionally including post-translational modifications of those sequences.

TKIP1001

In one aspect, the present disclosure provides an antibody or antigen-binding fragment thereof comprising at least one or both variable regions selected from: a. VH comprising the amino acid sequence of SEQ ID NO: 130 and b. VL comprising the amino acid sequence of SEQ ID NO: 401.

In one aspect, the present disclosure provides an antibody or antigen-binding fragment thereof comprising at least one, two, three, four, five, or six CDRs selected from: a. CDR-H1 comprising the amino acid sequence of SEQ ID NO: 672, b. CDR-H2 comprising the amino acid sequence of SEQ ID NO: 1214, c. CDR-H3 comprising the amino acid sequence of SEQ ID NO: 1756, d. CDR-L1 comprising the amino acid sequence of SEQ ID NO: 943, e. CDR-L2 comprising the amino acid sequence of SEQ ID NO: 1485, and f. CDR-L3 comprising the amino acid sequence of SEQ ID NO: 2027.

In one aspect, the present disclosure provides an antibody or antigen-binding fragment thereof comprising a CDR-H3 comprising the amino acid sequence of SEQ ID NO: 1756, and a CDR-L3 comprising the amino acid sequence of SEQ ID NO: 2027.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 672, b. CDR-H2 comprising the amino acid sequence of SEQ ID NO: 1214, c. CDR-H3 comprising the amino acid sequence of SEQ ID NO: 1756, and a VL comprising the amino acid sequence of SEQ ID NO: 401.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 943, b. CDR-L2 comprising the amino acid sequence of SEQ ID NO: 1485, c. CDR-L3 comprising the amino acid sequence of SEQ ID NO: 2027, and a VH comprising the amino acid sequence of SEQ ID NO: 130.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 130. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 130. In some embodiments, substitutions, insertions, or deletions occur in regions outside the CDRs (e.g., in the FRs). Optionally, the antibody or antigen-binding fragment thereof comprises the VH sequence SEQ ID NO: 130, including one or more post-translational modifications of that sequence. In a particular embodiment, the VH comprises one, two or three CDRs selected from: a. CDR-H1, comprising the amino acid sequence SEQ ID NO: 672, b. CDR-H2, comprising the amino acid sequence SEQ ID NO: 1214, and c. CDR-H3, comprising the amino acid sequence SEQ ID NO: 1756.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 401. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 401. In some embodiments, the substitutions, insertions, or deletions occur in regions outside the CDRs (e.g., in the FRs). Optionally, the antibody or antigen-binding fragment thereof comprises the VL sequence SEQ ID NO: 401, including one or more post-translational modifications of that sequence. In a particular embodiment, the VL comprises one, two or three CDRs selected from: a. CDR-L1, comprising the amino acid sequence SEQ ID NO: 943, b. CDR-L2, comprising the amino acid sequence SEQ ID NO: 1485, and c. CDR-L3, comprising the amino acid sequence SEQ ID NO: 2027.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 130, and the VL amino acid sequence of SEQ ID NO: 401, optionally including post-translational modifications of those sequences.

TKIP1002

In one aspect, the present disclosure provides an antibody or antigen-binding fragment thereof comprising at least one or both variable regions selected from: a. VH comprising the amino acid sequence of SEQ ID NO: 131 and b. VL comprising the amino acid sequence of SEQ ID NO: 402.

In one aspect, the present disclosure provides an antibody or antigen-binding fragment thereof comprising at least one, two, three, four, five, or six CDRs selected from: a. CDR-H1 comprising the amino acid sequence of SEQ ID NO: 673, b. CDR-H2 comprising the amino acid sequence of SEQ ID NO: 1215, c. CDR-H3 comprising the amino acid sequence of SEQ ID NO: 1757, d. CDR-L1 comprising the amino acid sequence of SEQ ID NO: 944, e. CDR-L2 comprising the amino acid sequence of SEQ ID NO: 1486, and f. CDR-L3 comprising the amino acid sequence of SEQ ID NO: 2028.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 673, b. CDR-H2 comprising the amino acid sequence of SEQ ID NO: 1215, c. CDR-H3 comprising the amino acid sequence of SEQ ID NO: 1757, and a VL comprising the amino acid sequence of SEQ ID NO: 402.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 944, b. CDR-L2 comprising the amino acid sequence of SEQ ID NO: 1486, c. CDR-L3 comprising the amino acid sequence of SEQ ID NO: 2028, and a VH comprising the amino acid sequence of SEQ ID NO: 131.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 131. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 131. In some embodiments, substitutions, insertions, or deletions occur in regions outside the CDRs (e.g., in the FRs). Optionally, the antibody or antigen-binding fragment thereof comprises the VH sequence SEQ ID NO: 131, including one or more post-translational modifications of that sequence. In a particular embodiment, the VH comprises one, two or three CDRs selected from: a. CDR-H1, comprising the amino acid sequence SEQ ID NO: 673, b. CDR-H2, comprising the amino acid sequence SEQ ID NO: 1215, and c. CDR-H3, comprising the amino acid sequence SEQ ID NO: 1757.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 402. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 402. In some embodiments, the substitutions, insertions, or deletions occur in regions outside the CDRs (e.g., in the FRs). Optionally, the antibody or antigen-binding fragment thereof comprises the VL sequence SEQ ID NO: 402, including one or more post-translational modifications of that sequence. In a particular embodiment, the VL comprises one, two or three CDRs selected from: a. CDR-L1, comprising the amino acid sequence SEQ ID NO: 944, b. CDR-L2, comprising the amino acid sequence SEQ ID NO: 1486, and c. CDR-L3, comprising the amino acid sequence SEQ ID NO: 2028.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 131, and the VL amino acid sequence of SEQ ID NO: 402, optionally including post-translational modifications of those sequences.
TKIP1003

In one aspect, the present disclosure provides an antibody or antigen-binding fragment thereof comprising at least one or both variable regions selected from: a. VH comprising the amino acid sequence of SEQ ID NO: 132 and b. VL comprising the amino acid sequence of SEQ ID NO: 403.

In one aspect, the present disclosure provides an antibody or antigen-binding fragment thereof comprising at least one, two, three, four, five, or six CDRs selected from: a. CDR-H1 comprising the amino acid sequence of SEQ ID NO: 674, b. CDR-H2 comprising the amino acid sequence of SEQ ID NO: 1216, c. CDR-H3 comprising the amino acid sequence of SEQ ID NO: 1758, d. CDR-L1 comprising the amino acid sequence of SEQ ID NO: 945, e. CDR-L2 comprising the amino acid sequence of SEQ ID NO: 1487, and f. CDR-L3 comprising the amino acid sequence of SEQ ID NO: 2029.

In one aspect, the present disclosure provides an antibody or antigen-binding fragment thereof comprising a CDR-H3 comprising the amino acid sequence of SEQ ID NO: 1758, and a CDR-L3 comprising the amino acid sequence of SEQ ID NO: 2029.

In one aspect, the present disclosure provides an antibody or antigen-binding fragment thereof comprising at least one, at least two, or all three VH CDR sequences selected from: a CDR-H1 comprising the amino acid sequence of SEQ ID NO: 674, b. CDR-H2 comprising the amino acid sequence of SEQ ID NO: 1216, c. CDR-H3 comprising the amino acid sequence of SEQ ID NO: 1758, and a VL comprising the amino acid sequence of SEQ ID NO: 403.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 945, b. CDR-L2 comprising the amino acid sequence of SEQ ID NO: 1487, c. CDR-L3 comprising the amino acid sequence of SEQ ID NO: 2029, and a VH comprising the amino acid sequence of SEQ ID NO: 132.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 132. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 132. In some embodiments, substitutions, insertions, or deletions occur in regions outside the CDRs (e.g., in the FRs). Optionally, the antibody or antigen-binding fragment thereof comprises the VH sequence SEQ ID NO: 132, including one or more post-translational modifications of that sequence. In a particular embodiment, the VH comprises one, two or three CDRs selected from: a. CDR-H1, comprising the amino acid sequence SEQ ID NO: 674, b. CDR-H2, comprising the amino acid sequence SEQ ID NO: 1216, and c. CDR-H3, comprising the amino acid sequence SEQ ID NO: 1758.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 403. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 403. In some embodiments, the substitutions, insertions, or deletions occur in regions outside the CDRs (e.g., in the FRs). Optionally, the antibody or antigen-binding fragment thereof comprises the VL sequence SEQ ID NO: 403, including one or more post-translational modifications of that sequence. In a particular embodiment, the VL comprises one, two or three CDRs selected from: a. CDR-L1, comprising the amino acid sequence SEQ ID NO: 945, b. CDR-L2, comprising the amino acid sequence SEQ ID NO: 1487, and c. CDR-L3, comprising the amino acid sequence SEQ ID NO: 2029.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 132, and the VL amino acid sequence of SEQ ID NO: 403, optionally including post-translational modifications of those sequences.

TKIP1004

In one aspect, the present disclosure provides an antibody or antigen-binding fragment thereof comprising at least one or both variable regions selected from: a. VH comprising the amino acid sequence of SEQ ID NO: 133 and b. VL comprising the amino acid sequence of SEQ ID NO: 404.

In one aspect, the present disclosure provides an antibody or antigen-binding fragment thereof comprising at least one, two, three, four, five, or six CDRs selected from: a. CDR-H1 comprising the amino acid sequence of SEQ ID NO: 675, b. CDR-H2 comprising the amino acid sequence of SEQ ID NO: 1217, c. CDR-H3 comprising the amino acid sequence of SEQ ID NO: 1759, d. CDR-L1 comprising the amino acid sequence of SEQ ID NO: 946, e. CDR-L2 comprising the amino acid sequence of SEQ ID NO: 1488, and f. CDR-L3 comprising the amino acid sequence of SEQ ID NO: 2030.

In one aspect, the present disclosure provides an antibody or antigen-binding fragment thereof comprising a CDR-H3 comprising the amino acid sequence of SEQ ID NO: 1759, and a CDR-L3 comprising the amino acid sequence of SEQ ID NO: 2030.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 675, b. CDR-H2 comprising the amino acid sequence of SEQ ID NO: 1217, c. CDR-H3 comprising the amino acid sequence of SEQ ID NO: 1759, and a VL comprising the amino acid sequence of SEQ ID NO: 404.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 946, b. CDR-L2 comprising the amino acid sequence of SEQ ID NO: 1488, c. CDR-L3 comprising the amino acid sequence of SEQ ID NO: 2030, and a VH comprising the amino acid sequence of SEQ ID NO: 133.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 133. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 133. In some embodiments, substitutions, insertions, or deletions occur in regions outside the CDRs (e.g., in the FRs). Optionally, the antibody or antigen-binding fragment thereof comprises the VH sequence SEQ ID NO: 133, including one or more post-translational modifications of that sequence. In a particular embodiment, the VH comprises one, two or three CDRs selected from: a CDR-H1, comprising the amino acid sequence SEQ ID NO: 675, b. CDR-H2, comprising the amino acid sequence SEQ ID NO: 1217, and c. CDR-H3, comprising the amino acid sequence SEQ ID NO: 1759.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 404. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 404. In some embodiments, the substitutions, insertions, or deletions occur in regions outside the CDRs (e.g., in the FRs). Optionally, the antibody or antigen-binding fragment thereof comprises the VL sequence SEQ ID NO: 404, including one or more post-translational modifications of that sequence. In a particular embodiment, the VL comprises one, two or three CDRs selected from: a. CDR-L1, comprising the amino acid sequence SEQ ID NO: 946, b. CDR-L2, comprising the amino acid sequence SEQ ID NO: 1488, and c. CDR-L3, comprising the amino acid sequence SEQ ID NO: 2030.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 133, and the VL amino acid sequence of SEQ ID NO: 404, optionally including post-translational modifications of those sequences.

TKIP1005

In one aspect, the present disclosure provides an antibody or antigen-binding fragment thereof comprising at least one or both variable regions selected from: a. VH comprising the amino acid sequence of SEQ ID NO: 134 and b. VL comprising the amino acid sequence of SEQ ID NO: 405.

In one aspect, the present disclosure provides an antibody or antigen-binding fragment thereof comprising at least one, two, three, four, five, or six CDRs selected from: a. CDR-H1 comprising the amino acid sequence of SEQ ID NO: 676, b. CDR-H2 comprising the amino acid sequence of SEQ ID NO: 1218, c. CDR-H3 comprising the amino acid sequence of SEQ ID NO: 1760, d. CDR-L1 comprising the amino acid sequence of SEQ ID NO: 947, e. CDR-L2 comprising the amino acid sequence of SEQ ID NO: 1489, and f. CDR-L3 comprising the amino acid sequence of SEQ ID NO: 2031.

In one aspect, the present disclosure provides an antibody or antigen-binding fragment thereof comprising a CDR-H3 comprising the amino acid sequence of SEQ ID NO: 1760, and a CDR-L3 comprising the amino acid sequence of SEQ ID NO: 2031.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 676, b. CDR-H2 comprising the amino acid sequence of SEQ ID NO: 1218, c. CDR-H3 comprising the amino acid sequence of SEQ ID NO: 1760, and a VL comprising the amino acid sequence of SEQ ID NO: 405.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 947, b. CDR-L2 comprising the amino acid sequence of SEQ ID NO: 1489, c. CDR-L3 comprising the amino acid sequence of SEQ ID NO: 2031, and a VH comprising the amino acid sequence of SEQ ID NO: 134.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 134. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 134. In some embodiments, substitutions, insertions, or deletions occur in regions outside the CDRs (e.g., in the FRs). Optionally, the antibody or antigen-binding fragment thereof comprises the VH sequence SEQ ID NO: 134, including one or more post-translational modifications of that sequence. In a particular embodiment, the VH comprises one, two or three CDRs selected from: a. CDR-H1, comprising the amino acid sequence SEQ ID NO: 676, b. CDR-H2, comprising the amino acid sequence SEQ ID NO: 1218, and c. CDR-H3, comprising the amino acid sequence SEQ ID NO: 1760.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 405. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 405. In some embodiments, the substitutions, insertions, or deletions occur in regions outside the CDRs (e.g., in the FRs). Optionally, the antibody or antigen-binding fragment thereof comprises the VL sequence SEQ ID NO: 405, including one or more post-translational modifications of that sequence. In a particular embodiment, the VL comprises one, two or three CDRs selected from: a. CDR-L1, comprising the amino acid sequence SEQ ID NO: 947, b. CDR-L2, comprising the amino acid sequence SEQ ID NO: 1489, and c. CDR-L3, comprising the amino acid sequence SEQ ID NO: 2031.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 134, and the VL amino acid sequence of SEQ ID NO: 405, optionally including post-translational modifications of those sequences.
TKIP1006

In one aspect, the present disclosure provides an antibody or antigen-binding fragment thereof comprising at least one or both variable regions selected from: a. VH comprising the amino acid sequence of SEQ ID NO: 135 and b. VL comprising the amino acid sequence of SEQ ID NO: 406.

In one aspect, the present disclosure provides an antibody or antigen-binding fragment thereof comprising at least one, two, three, four, five, or six CDRs selected from: a. CDR-H1 comprising the amino acid sequence of SEQ ID NO: 677, b. CDR-H2 comprising the amino acid sequence of SEQ ID NO: 1219, c. CDR-H3 comprising the amino acid sequence of SEQ ID NO: 1761, d. CDR-L1 comprising the amino acid sequence of SEQ ID NO: 948, e. CDR-L2 comprising the amino acid sequence of SEQ ID NO: 1490, and f. CDR-L3 comprising the amino acid sequence of SEQ ID NO: 2032.

In one aspect, the present disclosure provides an antibody or antigen-binding fragment thereof comprising a CDR-H3 comprising the amino acid sequence of SEQ ID NO: 1761, and a CDR-L3 comprising the amino acid sequence of SEQ ID NO: 2032.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 677, b. CDR-H2 comprising the amino acid sequence of SEQ ID NO: 1219, c. CDR-H3 comprising the amino acid sequence of SEQ ID NO: 1761, and a VL comprising the amino acid sequence of SEQ ID NO: 406.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 948, b. CDR-L2 comprising the amino acid sequence of SEQ ID NO: 1490, c. CDR-L3 comprising the amino acid sequence of SEQ ID NO: 2032, and a VH comprising the amino acid sequence of SEQ ID NO: 135.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 135. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 135. In some embodiments, substitutions, insertions, or deletions occur in regions outside the CDRs (e.g., in the FRs). Optionally, the antibody or antigen-binding fragment thereof comprises the VH sequence SEQ ID NO: 135, including one or more post-translational modifications of that sequence. In a particular embodiment, the VH comprises one, two or three CDRs selected from: a. CDR-H1, comprising the amino acid sequence SEQ ID NO: 677, b. CDR-H2, comprising the amino acid sequence SEQ ID NO: 1219, and c. CDR-H3, comprising the amino acid sequence SEQ ID NO: 1761.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 406. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 406. In some embodiments, the substitutions, insertions, or deletions occur in regions outside the CDRs (e.g., in the FRs). Optionally, the antibody or antigen-binding fragment thereof comprises the VL sequence SEQ ID NO: 406, including one or more post-translational modifications of that sequence. In a particular embodiment, the VL comprises one, two or three CDRs selected from: a. CDR-L1, comprising the amino acid sequence SEQ ID NO: 948, b. CDR-L2, comprising the amino acid sequence SEQ ID NO: 1490, and c. CDR-L3, comprising the amino acid sequence SEQ ID NO: 2032.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 135, and the VL amino acid sequence of SEQ ID NO: 406, optionally including post-translational modifications of those sequences.

TLGG1001

In one aspect, the present disclosure provides an antibody or antigen-binding fragment thereof comprising at least one or both variable regions selected from: a. VH comprising the amino acid sequence of SEQ ID NO: 136 and b. VL comprising the amino acid sequence of SEQ ID NO: 407.

In one aspect, the present disclosure provides an antibody or antigen-binding fragment thereof comprising at least one, two, three, four, five, or six CDRs selected from: a. CDR-H1 comprising the amino acid sequence of SEQ ID NO: 678, b. CDR-H2 comprising the amino acid sequence of SEQ ID NO: 1220, c. CDR-H3 comprising the amino acid sequence of SEQ ID NO: 1762, d. CDR-L1 comprising the amino acid sequence of SEQ ID NO: 949, e. CDR-L2 comprising the amino acid sequence of SEQ ID NO: 1491, and f. CDR-L3 comprising the amino acid sequence of SEQ ID NO: 2033.

In one aspect, the present disclosure provides an antibody or antigen-binding fragment thereof comprising a CDR-H3 comprising the amino acid sequence of SEQ ID NO: 1762, and a CDR-L3 comprising the amino acid sequence of SEQ ID NO: 2033.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 678, b. CDR-H2 comprising the amino acid sequence of SEQ ID NO: 1220, c. CDR-H3 comprising the amino acid sequence of SEQ ID NO: 1762, and a VL comprising the amino acid sequence of SEQ ID NO: 407.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 949, b. CDR-L2 comprising the amino acid sequence of SEQ ID NO: 1491, c. CDR-L3 comprising the amino acid sequence of SEQ ID NO: 2033, and a VH comprising the amino acid sequence of SEQ ID NO: 136.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 136. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 136. In some embodiments, substitutions, insertions, or deletions occur in regions outside the CDRs (e.g., in the FRs). Optionally, the antibody or antigen-binding fragment thereof comprises the VH sequence SEQ ID NO: 136, including one or more post-translational modifications of that sequence. In a particular embodiment, the VH comprises one, two or three CDRs selected from: a. CDR-H1, comprising the amino acid sequence SEQ ID NO: 678, b. CDR-H2, comprising the amino acid sequence SEQ ID NO: 1220, and c. CDR-H3, comprising the amino acid sequence SEQ ID NO: 1762.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 407. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 407. In some embodiments, the substitutions, insertions, or deletions occur in regions outside the CDRs (e.g., in the FRs). Optionally, the antibody or antigen-binding fragment thereof comprises the VL sequence SEQ ID NO: 407, including one or more post-translational modifications of that sequence. In a particular embodiment, the VL comprises one, two or three CDRs selected from: a. CDR-L1, comprising the amino acid sequence SEQ ID NO: 949, b. CDR-L2, comprising the amino acid sequence SEQ ID NO: 1491, and c. CDR-L3, comprising the amino acid sequence SEQ ID NO: 2033.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 136, and the VL amino acid sequence of SEQ ID NO: 407, optionally including post-translational modifications of those sequences.
TLIV1001

In one aspect, the present disclosure provides an antibody or antigen-binding fragment thereof comprising at least one or both variable regions selected from: a. VH comprising the amino acid sequence of SEQ ID NO: 137 and b. VL comprising the amino acid sequence of SEQ ID NO: 408.

In one aspect, the present disclosure provides an antibody or antigen-binding fragment thereof comprising at least one, two, three, four, five, or six CDRs selected from: a. CDR-H1 comprising the amino acid sequence of SEQ ID NO: 679, b. CDR-H2 comprising the amino acid sequence of SEQ ID NO: 1221, c. CDR-H3 comprising the amino acid sequence of SEQ ID NO: 1763, d. CDR-L1 comprising the amino acid sequence of SEQ ID NO: 950, e. CDR-L2 comprising the amino acid sequence of SEQ ID NO: 1492, f. CDR-L3 comprising the amino acid sequence of SEQ ID NO: 2034.

In one aspect, the present disclosure provides an antibody or antigen-binding fragment thereof comprising a CDR-H3 comprising the amino acid sequence of SEQ ID NO: 1763, and a CDR-L3 comprising the amino acid sequence of SEQ ID NO: 2034.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 679, b. CDR-H2 comprising the amino acid sequence of SEQ ID NO: 1221, c. CDR-H3 comprising the amino acid sequence of SEQ ID NO: 1763, and a VL comprising the amino acid sequence of SEQ ID NO: 408.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 950, b. CDR-L2 comprising the amino acid sequence of SEQ ID NO: 1492, c. CDR-L3 comprising the amino acid sequence of SEQ ID NO: 2034, and a VH comprising the amino acid sequence of SEQ ID NO: 137.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 137. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 137. In some embodiments, substitutions, insertions, or deletions occur in regions outside the CDRs (e.g., in the FRs). Optionally, the antibody or antigen-binding fragment thereof comprises the VH sequence SEQ ID NO: 137, including one or more post-translational modifications of that sequence. In a particular embodiment, the VH comprises one, two or three CDRs selected from: a. CDR-H1, comprising the amino acid sequence SEQ ID NO: 679, b. CDR-H2, comprising the amino acid sequence SEQ ID NO: 1221, and c. CDR-H3, comprising the amino acid sequence SEQ ID NO: 1763.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 408. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 408. In some embodiments, the substitutions, insertions, or deletions occur in regions outside the CDRs (e.g., in the FRs). Optionally, the antibody or antigen-binding fragment thereof comprises the VL sequence SEQ ID NO: 408, including one or more post-translational modifications of that sequence. In a particular embodiment, the VL comprises one, two or three CDRs selected from: a. CDR-L1, comprising the amino acid sequence SEQ ID NO: 950, b. CDR-L2, comprising the amino acid sequence SEQ ID NO: 1492, and c. CDR-L3, comprising the amino acid sequence SEQ ID NO: 2034.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 137, and the VL amino acid sequence of SEQ ID NO: 408, optionally including post-translational modifications of those sequences.
TLIV1002

In one aspect, the present disclosure provides an antibody or antigen-binding fragment thereof comprising at least one or both variable regions selected from: a. VH comprising the amino acid sequence of SEQ ID NO: 138 and b. VL comprising the amino acid sequence of SEQ ID NO: 409.

In one aspect, the present disclosure provides an antibody or antigen-binding fragment thereof comprising at least one, two, three, four, five, or six CDRs selected from: a. CDR-H1 comprising the amino acid sequence of SEQ ID NO: 680, b. CDR-H2 comprising the amino acid sequence of SEQ ID NO: 1222, c. CDR-H3 comprising the amino acid sequence of SEQ ID NO: 1764, d. CDR-L1 comprising the amino acid sequence of SEQ ID NO: 951, e. CDR-L2 comprising the amino acid sequence of SEQ ID NO: 1493, and f. CDR-L3 comprising the amino acid sequence of SEQ ID NO: 2035.

In one aspect, the present disclosure provides an antibody or antigen-binding fragment thereof comprising a CDR-H3 comprising the amino acid sequence of SEQ ID NO: 1764, and a CDR-L3 comprising the amino acid sequence of SEQ ID NO: 2035.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 680, b. CDR-H2 comprising the amino acid sequence of SEQ ID NO: 1222, c. CDR-H3 comprising the amino acid sequence of SEQ ID NO: 1764, and a VL comprising the amino acid sequence of SEQ ID NO: 409.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 951, b. CDR-L2 comprising the amino acid sequence of SEQ ID NO: 1493, c. CDR-L3 comprising the amino acid sequence of SEQ ID NO: 2035, and a VH comprising the amino acid sequence of SEQ ID NO: 138.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 138. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 138. In some embodiments, substitutions, insertions, or deletions occur in regions outside the CDRs (e.g., in the FRs). Optionally, the antibody or antigen-binding fragment thereof comprises the VH sequence SEQ ID NO: 138, including one or more post-translational modifications of that sequence. In a particular embodiment, the VH comprises one, two or three CDRs selected from: a. CDR-H1, comprising the amino acid sequence SEQ ID NO: 680, b. CDR-H2, comprising the amino acid sequence SEQ ID NO: 1222, and c. CDR-H3, comprising the amino acid sequence SEQ ID NO: 1764.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 409. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 409. In some embodiments, the substitutions, insertions, or deletions occur in regions outside the CDRs (e.g., in the FRs). Optionally, the antibody or antigen-binding fragment thereof comprises the VL sequence SEQ ID NO: 409, including one or more post-translational modifications of that sequence. In a particular embodiment, the VL comprises one, two or three CDRs selected from: a. CDR-L1, comprising the amino acid sequence SEQ ID NO: 951, b. CDR-L2, comprising the amino acid sequence SEQ ID NO: 1493, and c. CDR-L3, comprising the amino acid sequence SEQ ID NO: 2035.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 138, and the VL amino acid sequence of SEQ ID NO: 409, optionally including post-translational modifications of those sequences.

TLIV1003

In one aspect, the present disclosure provides an antibody or antigen-binding fragment thereof comprising at least one or both variable regions selected from: a. VH comprising the amino acid sequence of SEQ ID NO: 139 and b. VL comprising the amino acid sequence of SEQ ID NO: 410.

In one aspect, the present disclosure provides an antibody or antigen-binding fragment thereof comprising at least one, two, three, four, five, or six CDRs selected from: a. CDR-H1 comprising the amino acid sequence of SEQ ID NO: 681, b. CDR-H2 comprising the amino acid sequence of SEQ ID NO: 1223, c. CDR-H3 comprising the amino acid sequence of SEQ ID NO: 1765, d. CDR-L1 comprising the amino acid sequence of SEQ ID NO: 952, e. CDR-L2 comprising the amino acid sequence of SEQ ID NO: 1494, and f. CDR-L3 comprising the amino acid sequence of SEQ ID NO: 2036.

In one aspect, the present disclosure provides an antibody or antigen-binding fragment thereof comprising a CDR-H3 and a CDR-L3 comprising the amino acid sequence of SEQ ID NO: 2036.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 681, b. CDR-H2 comprising the amino acid sequence of SEQ ID NO: 1223, c. CDR-H3 comprising the amino acid sequence of SEQ ID NO: 1765, and a VL comprising the amino acid sequence of SEQ ID NO: 410.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 952, b. CDR-L2 comprising the amino acid sequence of SEQ ID NO: 1494, c. CDR-L3 comprising the amino acid sequence of SEQ ID NO: 2036, and a VH comprising the amino acid sequence of SEQ ID NO: 139.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 139. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 139. In some embodiments, substitutions, insertions, or deletions occur in regions outside the CDRs (e.g., in the FRs). Optionally, the antibody or antigen-binding fragment thereof comprises the VH sequence SEQ ID NO: 139, including one or more post-translational modifications of that sequence. In a particular embodiment, the VH comprises one, two or three CDRs selected from: a. CDR-H1, comprising the amino acid sequence SEQ ID NO: 681, b. CDR-H2, comprising the amino acid sequence SEQ ID NO: 1223, and c. CDR-H3, comprising the amino acid sequence SEQ ID NO: 1765.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 410. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 410. In some embodiments, the substitutions, insertions, or deletions occur in regions outside the CDRs (e.g., in the FRs). Optionally, the antibody or antigen-binding fragment thereof comprises the VL sequence SEQ ID NO: 410, including one or more post-translational modifications of that sequence. In a particular embodiment, the VL comprises one, two or three CDRs selected from: a. CDR-L1, comprising the amino acid sequence SEQ ID NO: 952, b. CDR-L2, comprising the amino acid sequence SEQ ID NO: 1494, and c. CDR-L3, comprising the amino acid sequence SEQ ID NO: 2036.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 139, and the VL amino acid sequence of SEQ ID NO: 410, optionally including post-translational modifications of those sequences.
TLIV1004

In one aspect, the present disclosure provides an antibody or antigen-binding fragment thereof comprising at least one or both variable regions selected from: a. VH comprising the amino acid sequence of SEQ ID NO: 140 and a VL comprising the amino acid sequence of SEQ ID NO: 411.

In one aspect, the present disclosure provides an antibody or antigen-binding fragment thereof comprising at least one, two, three, four, five, or six CDRs selected from: a. CDR-H1 comprising the amino acid sequence of SEQ ID NO: 682, b. CDR-H2 comprising the amino acid sequence of SEQ ID NO: 1224, c. CDR-H3 comprising the amino acid sequence of SEQ ID NO: 1766, d. CDR-L1 comprising the amino acid sequence of SEQ ID NO: 953, e. CDR-L2 comprising the amino acid sequence of SEQ ID NO: 1495, and f. CDR-L3 comprising the amino acid sequence of SEQ ID NO: 2037.

In one aspect, the present disclosure provides an antibody or antigen-binding fragment thereof comprising a CDR-H3 comprising the amino acid sequence of SEQ ID NO: 1766, and a CDR-L3 comprising the amino acid sequence of SEQ ID NO: 2037.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 682, b. CDR-H2 comprising the amino acid sequence of SEQ ID NO: 1224, c. CDR-H3 comprising the amino acid sequence of SEQ ID NO: 1766, and a VL comprising the amino acid sequence of SEQ ID NO: 411.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 953, b. CDR-L2 comprising the amino acid sequence of SEQ ID NO: 1495, c. CDR-L3 comprising the amino acid sequence of SEQ ID NO: 2037, and a VH comprising the amino acid sequence of SEQ ID NO: 140.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 140. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 140. In some embodiments, substitutions, insertions, or deletions occur in regions outside the CDRs (e.g., in the FRs). Optionally, the antibody or antigen-binding fragment thereof comprises the VH sequence SEQ ID NO: 140, including one or more post-translational modifications of that sequence. In a particular embodiment, the VH comprises one, two or three CDRs selected from: a. CDR-H1, comprising the amino acid sequence SEQ ID NO: 682, b. CDR-H2, comprising the amino acid sequence SEQ ID NO: 1224, and c. CDR-H3, comprising the amino acid sequence SEQ ID NO: 1766.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 411. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 411. In some embodiments, the substitutions, insertions, or deletions occur in regions outside the CDRs (e.g., in the FRs). Optionally, the antibody or antigen-binding fragment thereof comprises the VL sequence SEQ ID NO: 411, including one or more post-translational modifications of that sequence. In a particular embodiment, the VL comprises one, two or three CDRs selected from: a. CDR-L1, comprising the amino acid sequence SEQ ID NO: 953, b. CDR-L2, comprising the amino acid sequence SEQ ID NO: 1495, and c. CDR-L3, comprising the amino acid sequence SEQ ID NO: 2037.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 140, and the VL amino acid sequence of SEQ ID NO: 411, optionally including post-translational modifications of those sequences.
TLUA1001

In one aspect, the present disclosure provides an antibody or antigen-binding fragment thereof comprising at least one or both variable regions selected from: a. VH comprising the amino acid sequence of SEQ ID NO: 141 and b. VL comprising the amino acid sequence of SEQ ID NO: 412.

In one aspect, the present disclosure provides an antibody or antigen-binding fragment thereof comprising at least one, two, three, four, five, or six CDRs selected from: a. CDR-H1 comprising the amino acid sequence of SEQ ID NO: 683, b. CDR-H2 comprising the amino acid sequence of SEQ ID NO: 1225, c. CDR-H3 comprising the amino acid sequence of SEQ ID NO: 1767, d. CDR-L1 comprising the amino acid sequence of SEQ ID NO: 954, e. CDR-L2 comprising the amino acid sequence of SEQ ID NO: 1496, and f. CDR-L3 comprising the amino acid sequence of SEQ ID NO: 2038.

In one aspect, the present disclosure provides an antibody or antigen-binding fragment thereof comprising a CDR-H3 comprising the amino acid sequence of SEQ ID NO: 1767, and a CDR-L3 comprising the amino acid sequence of SEQ ID NO: 2038.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 683, b. CDR-H2 comprising the amino acid sequence of SEQ ID NO: 1225, c. CDR-H3 comprising the amino acid sequence of SEQ ID NO: 1767, and a VL comprising the amino acid sequence of SEQ ID NO: 412.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 954, b. CDR-L2 comprising the amino acid sequence of SEQ ID NO: 1496, c. CDR-L3 comprising the amino acid sequence of SEQ ID NO: 2038, and a VH comprising the amino acid sequence of SEQ ID NO: 141.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 141. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 141. In some embodiments, substitutions, insertions, or deletions occur in regions outside the CDRs (e.g., in the FRs). Optionally, the antibody or antigen-binding fragment thereof comprises the VH sequence SEQ ID NO: 141, including one or more post-translational modifications of that sequence. In a particular embodiment, the VH comprises one, two or three CDRs selected from: a. CDR-H1, comprising the amino acid sequence SEQ ID NO: 683, b. CDR-H2, comprising the amino acid sequence SEQ ID NO: 1225, and c. CDR-H3, comprising the amino acid sequence SEQ ID NO: 1767.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 412. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 412. In some embodiments, the substitutions, insertions, or deletions occur in regions outside the CDRs (e.g., in the FRs). Optionally, the antibody or antigen-binding fragment thereof comprises the VL sequence SEQ ID NO: 412, including one or more post-translational modifications of that sequence. In a particular embodiment, the VL comprises one, two or three CDRs selected from: a. CDR-L1, comprising the amino acid sequence SEQ ID NO: 954, b. CDR-L2, comprising the amino acid sequence SEQ ID NO: 1496, and c. CDR-L3, comprising the amino acid sequence SEQ ID NO: 2038.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 141, and the VL amino acid sequence of SEQ ID NO: 412, optionally including post-translational modifications of those sequences.
TLUA1002

In one aspect, the present disclosure provides an antibody or antigen-binding fragment thereof comprising at least one or both variable regions selected from: a. VH comprising the amino acid sequence of SEQ ID NO: 142 and b. VL comprising the amino acid sequence of SEQ ID NO: 413.

In one aspect, the present disclosure provides an antibody or antigen-binding fragment thereof comprising at least one, two, three, four, five, or six CDRs selected from: a. CDR-H1 comprising the amino acid sequence of SEQ ID NO: 684, b. CDR-H2 comprising the amino acid sequence of SEQ ID NO: 1226, c. CDR-H3 comprising the amino acid sequence of SEQ ID NO: 1768, d. CDR-L1 comprising the amino acid sequence of SEQ ID NO: 955, e. CDR-L2 comprising the amino acid sequence of SEQ ID NO: 1497, and f. CDR-L3 comprising the amino acid sequence of SEQ ID NO: 2039.

In one aspect, the present disclosure provides an antibody or antigen-binding fragment thereof comprising a CDR-H3 comprising the amino acid sequence of SEQ ID NO: 1768, and a CDR-L3 comprising the amino acid sequence of SEQ ID NO: 2039.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 684, b. CDR-H2 comprising the amino acid sequence of SEQ ID NO: 1226, c. CDR-H3 comprising the amino acid sequence of SEQ ID NO: 1768, and a VL comprising the amino acid sequence of SEQ ID NO: 413.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 955, b. CDR-L2 comprising the amino acid sequence of SEQ ID NO: 1497, c. CDR-L3 comprising the amino acid sequence of SEQ ID NO: 2039, and a VH comprising the amino acid sequence of SEQ ID NO: 142.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 142. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 142. In some embodiments, substitutions, insertions, or deletions occur in regions outside the CDRs (e.g., in the FRs). Optionally, the antibody or antigen-binding fragment thereof comprises the VH sequence SEQ ID NO: 142, including one or more post-translational modifications of that sequence. In a particular embodiment, the VH comprises one, two or three CDRs selected from: a. CDR-H1, comprising the amino acid sequence SEQ ID NO: 684, b. CDR-H2, comprising the amino acid sequence SEQ ID NO: 1226, and c. CDR-H3, comprising the amino acid sequence SEQ ID NO: 1768.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 413. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 413. In some embodiments, the substitutions, insertions, or deletions occur in regions outside the CDRs (e.g., in the FRs). Optionally, the antibody or antigen-binding fragment thereof comprises the VL sequence SEQ ID NO: 413, including one or more post-translational modifications of that sequence. In a particular embodiment, the VL comprises one, two or three CDRs selected from: a. CDR-L1, comprising the amino acid sequence SEQ ID NO: 955, b. CDR-L2, comprising the amino acid sequence SEQ ID NO: 1497, and c. CDR-L3, comprising the amino acid sequence SEQ ID NO: 2039.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 142, and the VL amino acid sequence of SEQ ID NO: 413, optionally including post-translational modifications of those sequences.
TLUA1003

In one aspect, the present disclosure provides an antibody or antigen-binding fragment thereof comprising at least one or both variable regions selected from: a. VH comprising the amino acid sequence of SEQ ID NO: 143 and b. VL comprising the amino acid sequence of SEQ ID NO: 414.

In one aspect, the present disclosure provides an antibody or antigen-binding fragment thereof comprising at least one, two, three, four, five, or six CDRs selected from: a. CDR-H1 comprising the amino acid sequence of SEQ ID NO: 685, b. CDR-H2 comprising the amino acid sequence of SEQ ID NO: 1227, c. CDR-H3 comprising the amino acid sequence of SEQ ID NO: 1769, d. CDR-L1 comprising the amino acid sequence of SEQ ID NO: 956, e. CDR-L2 comprising the amino acid sequence of SEQ ID NO: 1498, and f. CDR-L3 comprising the amino acid sequence of SEQ ID NO: 2040.

In one aspect, the present disclosure provides an antibody or antigen-binding fragment thereof comprising a CDR-H3 comprising the amino acid sequence of SEQ ID NO: 1769, and a CDR-L3 comprising the amino acid sequence of SEQ ID NO: 2040.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 685, b. CDR-H2 comprising the amino acid sequence of SEQ ID NO: 1227, c. CDR-H3 comprising the amino acid sequence of SEQ ID NO: 1769, and a VL comprising the amino acid sequence of SEQ ID NO: 414.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 956, b. CDR-L2 comprising the amino acid sequence of SEQ ID NO: 1498, c. CDR-L3 comprising the amino acid sequence of SEQ ID NO: 2040, and a VH comprising the amino acid sequence of SEQ ID NO: 143.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 143. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 143. In some embodiments, substitutions, insertions, or deletions occur in regions outside the CDRs (e.g., in the FRs). Optionally, the antibody or antigen-binding fragment thereof comprises the VH sequence SEQ ID NO: 143, including one or more post-translational modifications of that sequence. In a particular embodiment, the VH comprises one, two or three CDRs selected from: a. CDR-H1, comprising the amino acid sequence SEQ ID NO: 685, b. CDR-H2, comprising the amino acid sequence SEQ ID NO: 1227, and c. CDR-H3, comprising the amino acid sequence SEQ ID NO: 1769.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 414. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 414. In some embodiments, the substitutions, insertions, or deletions occur in regions outside the CDRs (e.g., in the FRs). Optionally, the antibody or antigen-binding fragment thereof comprises the VL sequence SEQ ID NO: 414, including one or more post-translational modifications of that sequence. In a particular embodiment, the VL comprises one, two or three CDRs selected from: a. CDR-L1, comprising the amino acid sequence SEQ ID NO: 956, b. CDR-L2, comprising the amino acid sequence SEQ ID NO: 1498, and c. CDR-L3, comprising the amino acid sequence SEQ ID NO: 2040.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 143, and the VL amino acid sequence of SEQ ID NO: 414, optionally including post-translational modifications of those sequences.
TLUA1004

In one aspect, the present disclosure provides an antibody or antigen-binding fragment thereof comprising at least one or both variable regions selected from: a. VH comprising the amino acid sequence of SEQ ID NO: 144 and b. VL comprising the amino acid sequence of SEQ ID NO: 415.

In one aspect, the present disclosure provides an antibody or antigen-binding fragment thereof comprising at least one, two, three, four, five, or six CDRs selected from: a. CDR-H1 comprising the amino acid sequence of SEQ ID NO: 686, b. CDR-H2 comprising the amino acid sequence of SEQ ID NO: 1228, c. CDR-H3 comprising the amino acid sequence of SEQ ID NO: 1770, d. CDR-L1 comprising the amino acid sequence of SEQ ID NO: 957, e. CDR-L2 comprising the amino acid sequence of SEQ ID NO: 1499, and f. CDR-L3 comprising the amino acid sequence of SEQ ID NO: 2041.

In one aspect, the present disclosure provides an antibody or antigen-binding fragment thereof comprising a CDR-H3 comprising the amino acid sequence of SEQ ID NO: 1770, and a CDR-L3 comprising the amino acid sequence of SEQ ID NO: 2041.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 686, b. CDR-H2 comprising the amino acid sequence of SEQ ID NO: 1228, c. CDR-H3 comprising the amino acid sequence of SEQ ID NO: 1770, and a VL comprising the amino acid sequence of SEQ ID NO: 415.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 957, b. CDR-L2 comprising the amino acid sequence of SEQ ID NO: 1499, c. CDR-L3 comprising the amino acid sequence of SEQ ID NO: 2041, and a VH comprising the amino acid sequence of SEQ ID NO: 144.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 144. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 144. In some embodiments, substitutions, insertions, or deletions occur in regions outside the CDRs (e.g., in the FRs). Optionally, the antibody or antigen-binding fragment thereof comprises the VH sequence SEQ ID NO: 144, including one or more post-translational modifications of that sequence. In a particular embodiment, the VH comprises one, two or three CDRs selected from: a. CDR-H1, comprising the amino acid sequence SEQ ID NO: 686, b. CDR-H2, comprising the amino acid sequence SEQ ID NO: 1228, and c. CDR-H3, comprising the amino acid sequence SEQ ID NO: 1770.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 415. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 415. In some embodiments, the substitutions, insertions, or deletions occur in regions outside the CDRs (e.g., in the FRs). Optionally, the antibody or antigen-binding fragment thereof comprises the VL sequence SEQ ID NO: 415, including one or more post-translational modifications of that sequence. In a particular embodiment, the VL comprises one, two or three CDRs selected from: a. CDR-L1, comprising the amino acid sequence SEQ ID NO: 957, b. CDR-L2, comprising the amino acid sequence SEQ ID NO: 1499, and c. CDR-L3, comprising the amino acid sequence SEQ ID NO: 2041.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 144, and the VL amino acid sequence of SEQ ID NO: 415, optionally including post-translational modifications of those sequences.
TLUA1005

In one aspect, the present disclosure provides an antibody or antigen-binding fragment thereof comprising at least one or both variable regions selected from: a. VH comprising the amino acid sequence of SEQ ID NO: 145, and b. VL comprising the amino acid sequence of SEQ ID NO: 416.

In one aspect, the present disclosure provides an antibody or antigen-binding fragment thereof comprising at least one, two, three, four, five, or six CDRs selected from: a. CDR-H1 comprising the amino acid sequence of SEQ ID NO: 687, b. CDR-H2 comprising the amino acid sequence of SEQ ID NO: 1229, c. CDR-H3 comprising the amino acid sequence of SEQ ID NO: 1771, d. CDR-L1 comprising the amino acid sequence of SEQ ID NO: 958, e. CDR-L2 comprising the amino acid sequence of SEQ ID NO: 1500, and f. CDR-L3 comprising the amino acid sequence of SEQ ID NO: 2042.

In one aspect, the present disclosure provides an antibody or antigen-binding fragment thereof comprising a CDR-H3 comprising the amino acid sequence of SEQ ID NO: 1771, and a CDR-L3 comprising the amino acid sequence of SEQ ID NO: 2042.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 687, b. CDR-H2 comprising the amino acid sequence of SEQ ID NO: 1229, c. CDR-H3 comprising the amino acid sequence of SEQ ID NO: 1771, and a VL comprising the amino acid sequence of SEQ ID NO: 416.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 958, b. CDR-L2 comprising the amino acid sequence of SEQ ID NO: 1500, c. CDR-L3 comprising the amino acid sequence of SEQ ID NO: 2042, and a VH comprising the amino acid sequence of SEQ ID NO: 145.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 145. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 145. In some embodiments, substitutions, insertions, or deletions occur in regions outside the CDRs (e.g., in the FRs). Optionally, the antibody or antigen-binding fragment thereof comprises the VH sequence SEQ ID NO: 145, including one or more post-translational modifications of that sequence. In a particular embodiment, the VH comprises one, two or three CDRs selected from: a. CDR-H1, comprising the amino acid sequence SEQ ID NO: 687, b. CDR-H2, comprising the amino acid sequence SEQ ID NO: 1229, and c. CDR-H3, comprising the amino acid sequence SEQ ID NO: 1771.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 416. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 416. In some embodiments, the substitutions, insertions, or deletions occur in regions outside the CDRs (e.g., in the FRs). Optionally, the antibody or antigen-binding fragment thereof comprises the VL sequence SEQ ID NO: 416, including one or more post-translational modifications of that sequence. In a particular embodiment, the VL comprises one, two or three CDRs selected from: a. CDR-L1, comprising the amino acid sequence SEQ ID NO: 958, b. CDR-L2, comprising the amino acid sequence SEQ ID NO: 1500, and c. CDR-L3, comprising the amino acid sequence SEQ ID NO: 2042.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 145, and the VL amino acid sequence of SEQ ID NO: 416, optionally including post-translational modifications of those sequences.
TLUA1006

In one aspect, the present disclosure provides an antibody or antigen-binding fragment thereof comprising at least one or both variable regions selected from: a. VH comprising the amino acid sequence of SEQ ID NO: 146 and b. VL comprising the amino acid sequence of SEQ ID NO: 417.

In one aspect, the present disclosure provides an antibody or antigen-binding fragment thereof comprising at least one, two, three, four, five, or six CDRs selected from: a. CDR-H1 comprising the amino acid sequence of SEQ ID NO: 688, b. CDR-H2 comprising the amino acid sequence of SEQ ID NO: 1230, c. CDR-H3 comprising the amino acid sequence of SEQ ID NO: 1772, d. CDR-L1 comprising the amino acid sequence of SEQ ID NO: 959, e. CDR-L2 comprising the amino acid sequence of SEQ ID NO: 1501, and f. CDR-L3 comprising the amino acid sequence of SEQ ID NO: 2043.

In one aspect, the present disclosure provides an antibody or antigen-binding fragment thereof comprising a CDR-H3 comprising the amino acid sequence of SEQ ID NO: 1772 and a CDR-L3 comprising the amino acid sequence of SEQ ID NO: 2043.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 688, b. CDR-H2 comprising the amino acid sequence of SEQ ID NO: 1230, c. CDR-H3 comprising the amino acid sequence of SEQ ID NO: 1772, and a VL comprising the amino acid sequence of SEQ ID NO: 417.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 959, b. CDR-L2 comprising the amino acid sequence of SEQ ID NO: 1501, c. CDR-L3 comprising the amino acid sequence of SEQ ID NO: 2043, and a VH comprising the amino acid sequence of SEQ ID NO: 146.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 146. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 146. In some embodiments, substitutions, insertions, or deletions occur in regions outside the CDRs (e.g., in the FRs). Optionally, the antibody or antigen-binding fragment thereof comprises the VH sequence SEQ ID NO: 146, including one or more post-translational modifications of that sequence. In a particular embodiment, the VH comprises one, two or three CDRs selected from: a. CDR-H1, comprising the amino acid sequence SEQ ID NO: 688, b. CDR-H2, comprising the amino acid sequence SEQ ID NO: 1230, and c. CDR-H3, comprising the amino acid sequence SEQ ID NO: 1772.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 417. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 417. In some embodiments, the substitutions, insertions, or deletions occur in regions outside the CDRs (e.g., in the FRs). Optionally, the antibody or antigen-binding fragment thereof comprises the VL sequence SEQ ID NO: 417, including one or more post-translational modifications of that sequence. In a particular embodiment, the VL comprises one, two or three CDRs selected from: a. CDR-L1, comprising the amino acid sequence SEQ ID NO: 959, b. CDR-L2, comprising the amino acid sequence SEQ ID NO: 1501, and c. CDR-L3, comprising the amino acid sequence SEQ ID NO: 2043.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 146, and the VL amino acid sequence of SEQ ID NO: 417, optionally including post-translational modifications of those sequences.

TLUA1007

In one aspect, the present disclosure provides an antibody or antigen-binding fragment thereof comprising at least one or both variable regions selected from: a. VH comprising the amino acid sequence of SEQ ID NO: 147 and b. VL comprising the amino acid sequence of SEQ ID NO: 418.

In one aspect, the present disclosure provides an antibody or antigen-binding fragment thereof comprising at least one, two, three, four, five, or six CDRs selected from: a. CDR-H1 comprising the amino acid sequence of SEQ ID NO: 689, b. CDR-H2 comprising the amino acid sequence of SEQ ID NO: 1231, c. CDR-H3 comprising the amino acid sequence of SEQ ID NO: 1773, d. CDR-L1 comprising the amino acid sequence of SEQ ID NO: 960, e. CDR-L2 comprising the amino acid sequence of SEQ ID NO: 1502, and f. CDR-L3 comprising the amino acid sequence of SEQ ID NO: 2044.

In one aspect, the present disclosure provides an antibody or antigen-binding fragment thereof comprising a CDR-H3 comprising the amino acid sequence of SEQ ID NO: 1773, and a CDR-L3 comprising the amino acid sequence of SEQ ID NO: 2044.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 689, b. CDR-H2 comprising the amino acid sequence of SEQ ID NO: 1231, c. CDR-H3 comprising the amino acid sequence of SEQ ID NO: 1773, and a VL comprising the amino acid sequence of SEQ ID NO: 418.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 960, b. CDR-L2 comprising the amino acid sequence of SEQ ID NO: 1502, c. CDR-L3 comprising the amino acid sequence of SEQ ID NO: 2044, and a VH comprising the amino acid sequence of SEQ ID NO: 147.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 147. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 147. In some embodiments, substitutions, insertions, or deletions occur in regions outside the CDRs (e.g., in the FRs). Optionally, the antibody or antigen-binding fragment thereof comprises the VH sequence SEQ ID NO: 147, including one or more post-translational modifications of that sequence. In a particular embodiment, the VH comprises one, two or three CDRs selected from: a. CDR-H1, comprising the amino acid sequence SEQ ID NO: 689, b. CDR-H2, comprising the amino acid sequence SEQ ID NO: 1231, and c. CDR-H3, comprising the amino acid sequence SEQ ID NO: 1773.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 418. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 418. In some embodiments, the substitutions, insertions, or deletions occur in regions outside the CDRs (e.g., in the FRs). Optionally, the antibody or antigen-binding fragment thereof comprises the VL sequence SEQ ID NO: 418, including one or more post-translational modifications of that sequence. In a particular embodiment, the VL comprises one, two or three CDRs selected from: a. CDR-L1, comprising the amino acid sequence SEQ ID NO: 960, b. CDR-L2, comprising the amino acid sequence SEQ ID NO: 1502, and c. CDR-L3, comprising the amino acid sequence SEQ ID NO: 2044.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 147, and the VL amino acid sequence of SEQ ID NO: 418, optionally including post-translational modifications of those sequences.
TLUA1008

In one aspect, the present disclosure provides an antibody or antigen-binding fragment thereof comprising at least one or both variable regions selected from: a. VH comprising the amino acid sequence of SEQ ID NO: 148 and b. VL comprising the amino acid sequence of SEQ ID NO: 419.

In one aspect, the present disclosure provides an antibody or antigen-binding fragment thereof comprising at least one, two, three, four, five, or six CDRs selected from: a. CDR-H1 comprising the amino acid sequence of SEQ ID NO: 690, b. CDR-H2 comprising the amino acid sequence of SEQ ID NO: 1232, c. CDR-H3 comprising the amino acid sequence of SEQ ID NO: 1774, d. CDR-L1 comprising the amino acid sequence of SEQ ID NO: 961, e. CDR-L2 comprising the amino acid sequence of SEQ ID NO: 1503, and f. CDR-L3 comprising the amino acid sequence of SEQ ID NO: 2045.

In one aspect, the present disclosure provides an antibody or antigen-binding fragment thereof comprising a CDR-H3 comprising the amino acid sequence of SEQ ID NO: 1774, and a CDR-L3 comprising the amino acid sequence of SEQ ID NO: 2045.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 690, b. CDR-H2 comprising the amino acid sequence of SEQ ID NO: 1232, c. CDR-H3 comprising the amino acid sequence of SEQ ID NO: 1774, and VL comprising the amino acid sequence of SEQ ID NO: 419.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 961, b. CDR-L2 comprising the amino acid sequence of SEQ ID NO: 1503, c. CDR-L3 comprising the amino acid sequence of SEQ ID NO: 2045, and a VH comprising the amino acid sequence of SEQ ID NO: 148.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 148. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 148. In some embodiments, substitutions, insertions, or deletions occur in regions outside the CDRs (e.g., in the FRs). Optionally, the antibody or antigen-binding fragment thereof comprises the VH sequence SEQ ID NO: 148, including one or more post-translational modifications of that sequence. In a particular embodiment, the VH comprises one, two or three CDRs selected from: a. CDR-H1, comprising the amino acid sequence SEQ ID NO: 690, b. CDR-H2, comprising the amino acid sequence SEQ ID NO: 1232, and c. CDR-H3, comprising the amino acid sequence SEQ ID NO: 1774.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 419. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 419. In some embodiments, the substitutions, insertions, or deletions occur in regions outside the CDRs (e.g., in the FRs). Optionally, the antibody or antigen-binding fragment thereof comprises the VL sequence SEQ ID NO: 419, including one or more post-translational modifications of that sequence. In a particular embodiment, the VL comprises one, two or three CDRs selected from: a. CDR-L1, comprising the amino acid sequence SEQ ID NO: 961, b. CDR-L2, comprising the amino acid sequence SEQ ID NO: 1503, and c. CDR-L3, comprising the amino acid sequence SEQ ID NO: 2045.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 148, and the VL amino acid sequence of SEQ ID NO: 419, optionally including post-translational modifications of those sequences.
TLUA1009

In one aspect, the present disclosure provides an antibody or antigen-binding fragment thereof comprising at least one or both variable regions selected from: a. VH comprising the amino acid sequence of SEQ ID NO: 149 and b. VL comprising the amino acid sequence of SEQ ID NO: 420.

In one aspect, the present disclosure provides an antibody or antigen-binding fragment thereof comprising at least one, two, three, four, five, or six CDRs selected from: a CDR-H1 comprising the amino acid sequence of SEQ ID NO: 691, b. CDR-H2 comprising the amino acid sequence of SEQ ID NO: 1233, c. CDR-H3 comprising the amino acid sequence of SEQ ID NO: 1775, d. CDR-L1 comprising the amino acid sequence of SEQ ID NO: 962, e. CDR-L2 comprising the amino acid sequence of SEQ ID NO: 1504, and f. CDR-L3 comprising the amino acid sequence of SEQ ID NO: 2046.

In one aspect, the present disclosure provides an antibody or antigen-binding fragment thereof comprising a CDR-H3 comprising the amino acid sequence of SEQ ID NO: 1775, and a CDR-L3 comprising the amino acid sequence of SEQ ID NO: 2046.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 691, b. CDR-H2 comprising the amino acid sequence of SEQ ID NO: 1233, c. CDR-H3 comprising the amino acid sequence of SEQ ID NO: 1775, and a VL comprising the amino acid sequence of SEQ ID NO: 420.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 962, b. CDR-L2 comprising the amino acid sequence of SEQ ID NO: 1504, c. CDR-L3 comprising the amino acid sequence of SEQ ID NO: 2046, and a VH comprising the amino acid sequence of SEQ ID NO: 149.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 149. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 149. In some embodiments, substitutions, insertions, or deletions occur in regions outside the CDRs (e.g., in the FRs). Optionally, the antibody or antigen-binding fragment thereof comprises the VH sequence SEQ ID NO: 149, including one or more post-translational modifications of that sequence. In a particular embodiment, the VH comprises one, two or three CDRs selected from: a. CDR-H1, comprising the amino acid sequence SEQ ID NO: 691, b. CDR-H2, comprising the amino acid sequence SEQ ID NO: 1233, and c. CDR-H3, comprising the amino acid sequence SEQ ID NO: 1775.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 420. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 420. In some embodiments, the substitutions, insertions, or deletions occur in regions outside the CDRs (e.g., in the FRs). Optionally, the antibody or antigen-binding fragment thereof comprises the VL sequence SEQ ID NO: 420, including one or more post-translational modifications of that sequence. In a particular embodiment, the VL comprises one, two or three CDRs selected from: a. CDR-L1, comprising the amino acid sequence SEQ ID NO: 962, b. CDR-L2, comprising the amino acid sequence SEQ ID NO: 1504, and c. CDR-L3, comprising the amino acid sequence SEQ ID NO: 2046.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 149, and the VL amino acid sequence of SEQ ID NO: 420, optionally including post-translational modifications of those sequences.
TLUA1010

In one aspect, the present disclosure provides an antibody or antigen-binding fragment thereof comprising at least one or both variable regions selected from: a. VH comprising the amino acid sequence of SEQ ID NO: 150 and b. VL comprising the amino acid sequence of SEQ ID NO: 421.

In one aspect, the present disclosure provides an antibody or antigen-binding fragment thereof comprising at least one, two, three, four, five, or six CDRs selected from: a. CDR-H1 comprising the amino acid sequence of SEQ ID NO: 692, b. CDR-H2 comprising the amino acid sequence of SEQ ID NO: 1234, c. CDR-H3 comprising the amino acid sequence of SEQ ID NO: 1776, d. CDR-L1 comprising the amino acid sequence of SEQ ID NO: 963, e. CDR-L2 comprising the amino acid sequence of SEQ ID NO: 1505, and f. CDR-L3 comprising the amino acid sequence of SEQ ID NO: 2047.

In one aspect, the present disclosure provides an antibody or antigen-binding fragment thereof comprising a CDR-H3 comprising the amino acid sequence of SEQ ID NO: 1776 and a CDR-L3 comprising the amino acid sequence of SEQ ID NO: 2047.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 692, b. CDR-H2 comprising the amino acid sequence of SEQ ID NO: 1234, c. CDR-H3 comprising the amino acid sequence of SEQ ID NO: 1776, and a VL comprising the amino acid sequence of SEQ ID NO: 421.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 963, b. CDR-L2 comprising the amino acid sequence of SEQ ID NO: 1505, c. CDR-L3 comprising the amino acid sequence of SEQ ID NO: 2047, and a VH comprising the amino acid sequence of SEQ ID NO: 150.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 150. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 150. In some embodiments, substitutions, insertions, or deletions occur in regions outside the CDRs (e.g., in the FRs). Optionally, the antibody or antigen-binding fragment thereof comprises the VH sequence SEQ ID NO: 150, including one or more post-translational modifications of that sequence. In a particular embodiment, the VH comprises one, two or three CDRs selected from: a. CDR-H1, comprising the amino acid sequence SEQ ID NO: 692, b. CDR-H2, comprising the amino acid sequence SEQ ID NO: 1234, and c. CDR-H3, comprising the amino acid sequence SEQ ID NO: 1776.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 421. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 421. In some embodiments, the substitutions, insertions, or deletions occur in regions outside the CDRs (e.g., in the FRs). Optionally, the antibody or antigen-binding fragment thereof comprises the VL sequence SEQ ID NO: 421, including one or more post-translational modifications of that sequence. In a particular embodiment, the VL comprises one, two or three CDRs selected from: a. CDR-L1, comprising the amino acid sequence SEQ ID NO: 963, b. CDR-L2, comprising the amino acid sequence SEQ ID NO: 1505, and c. CDR-L3, comprising the amino acid sequence SEQ ID NO: 2047.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 150, and the VL amino acid sequence of SEQ ID NO: 421, optionally including post-translational modifications of those sequences.
TLUA1011

In one aspect, the present disclosure provides an antibody or antigen-binding fragment thereof comprising at least one or both variable regions selected from: a. VH comprising the amino acid sequence of SEQ ID NO: 151 and b. VL comprising the amino acid sequence of SEQ ID NO: 422.

In one aspect, the present disclosure provides an antibody or antigen-binding fragment thereof comprising at least one, two, three, four, five, or six CDRs selected from: a. CDR-H1 comprising the amino acid sequence of SEQ ID NO: 693, b. CDR-H2 comprising the amino acid sequence of SEQ ID NO: 1235, c. CDR-H3 comprising the amino acid sequence of SEQ ID NO: 1777, d. CDR-L1 comprising the amino acid sequence of SEQ ID NO: 964, e. CDR-L2 comprising the amino acid sequence of SEQ ID NO: 1506, and f. CDR-L3 comprising the amino acid sequence of SEQ ID NO: 2048.

In one aspect, the present disclosure provides an antibody or antigen-binding fragment thereof comprising a CDR-H3 comprising the amino acid sequence of SEQ ID NO: 1777, and a CDR-L3 comprising the amino acid sequence of SEQ ID NO: 2048.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 693, b. CDR-H2 comprising the amino acid sequence of SEQ ID NO: 1235, c. CDR-H3 comprising the amino acid sequence of SEQ ID NO: 1777, and a VL comprising the amino acid sequence of SEQ ID NO: 422.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 964, b. CDR-L2 comprising the amino acid sequence of SEQ ID NO: 1506, c. CDR-L3 comprising the amino acid sequence of SEQ ID NO: 2048, and d. VH comprising the amino acid sequence of SEQ ID NO: 151.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 151. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 151. In some embodiments, substitutions, insertions, or deletions occur in regions outside the CDRs (e.g., in the FRs). Optionally, the antibody or antigen-binding fragment thereof comprises the VH sequence SEQ ID NO: 151, including one or more post-translational modifications of that sequence. In a particular embodiment, the VH comprises one, two or three CDRs selected from: a. CDR-H1, comprising the amino acid sequence SEQ ID NO: 693, b. CDR-H2, comprising the amino acid sequence SEQ ID NO: 1235, and a. CDR-H3, comprising the amino acid sequence SEQ ID NO: 1777.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 422. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 422. In some embodiments, the substitutions, insertions, or deletions occur in regions outside the CDRs (e.g., in the FRs). Optionally, the antibody or antigen-binding fragment thereof comprises the VL sequence SEQ ID NO: 422, including one or more post-translational modifications of that sequence. In a particular embodiment, the VL comprises one, two or three CDRs selected from: a. CDR-L1, comprising the amino acid sequence SEQ ID NO: 964, b. CDR-L2, comprising the amino acid sequence SEQ ID NO: 1506, and c. CDR-L3, comprising the amino acid sequence SEQ ID NO: 2048.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 151, and the VL amino acid sequence of SEQ ID NO: 422, optionally including post-translational modifications of those sequences.
TLUA1012

In one aspect, the present disclosure provides an antibody or antigen-binding fragment thereof comprising at least one or both variable regions selected from: a. VH comprising the amino acid sequence of SEQ ID NO: 152 and a VL comprising the amino acid sequence of SEQ ID NO: 423.

In one aspect, the present disclosure provides an antibody or antigen-binding fragment thereof comprising at least one, two, three, four, five, or six CDRs selected from: a. CDR-H1 comprising the amino acid sequence of SEQ ID NO: 694, b. CDR-H2 comprising the amino acid sequence of SEQ ID NO: 1236, c. CDR-H3 comprising the amino acid sequence of SEQ ID NO: 1778, d. CDR-L1 comprising the amino acid sequence of SEQ ID NO: 965, e. CDR-L2 comprising the amino acid sequence of SEQ ID NO: 1507, and f. CDR-L3 comprising the amino acid sequence of SEQ ID NO: 2049.

In one aspect, the present disclosure provides an antibody or antigen-binding fragment thereof comprising a CDR-H3 comprising the amino acid sequence of SEQ ID NO: 1778, and a CDR-L3 comprising the amino acid sequence of SEQ ID NO: 2049.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 694, b. CDR-H2 comprising the amino acid sequence of SEQ ID NO: 1236, c. CDR-H3 comprising the amino acid sequence of SEQ ID NO: 1778, and a VL comprising the amino acid sequence of SEQ ID NO: 423.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 965, b. CDR-L2 comprising the amino acid sequence of SEQ ID NO: 1507, c. CDR-L3 comprising the amino acid sequence of SEQ ID NO: 2049, and a VH comprising the amino acid sequence of SEQ ID NO: 152.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 152. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 152. In some embodiments, substitutions, insertions, or deletions occur in regions outside the CDRs (e.g., in the FRs). Optionally, the antibody or antigen-binding fragment thereof comprises the VH sequence SEQ ID NO: 152, including one or more post-translational modifications of that sequence. In a particular embodiment, the VH comprises one, two or three CDRs selected from: a. CDR-H1, comprising the amino acid sequence SEQ ID NO: 694, b. CDR-H2, comprising the amino acid sequence SEQ ID NO: 1236, and c. CDR-H3, comprising the amino acid sequence SEQ ID NO: 1778.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 423. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 423. In some embodiments, the substitutions, insertions, or deletions occur in regions outside the CDRs (e.g., in the FRs). Optionally, the antibody or antigen-binding fragment thereof comprises the VL sequence SEQ ID NO: 423, including one or more post-translational modifications of that sequence. In a particular embodiment, the VL comprises one, two or three CDRs selected from: a. CDR-L1, comprising the amino acid sequence SEQ ID NO: 965, b. CDR-L2, comprising the amino acid sequence SEQ ID NO: 1507, and c. CDR-L3, comprising the amino acid sequence SEQ ID NO: 2049.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 152, and the VL amino acid sequence of SEQ ID NO: 423, optionally including post-translational modifications of those sequences.

TLUA1013

In one aspect, the present disclosure provides an antibody or antigen-binding fragment thereof comprising at least one or both variable regions selected from: a. VH comprising the amino acid sequence of SEQ ID NO: 153 and b. VL comprising the amino acid sequence of SEQ ID NO: 424.

In one aspect, the present disclosure provides an antibody or antigen-binding fragment thereof comprising at least one, two, three, four, five, or six CDRs selected from: a. CDR-H1 comprising the amino acid sequence of SEQ ID NO: 695, b. CDR-H2 comprising the amino acid sequence of SEQ ID NO: 1237, c. CDR-H3 comprising the amino acid sequence of SEQ ID NO: 1779, d. CDR-L1 comprising the amino acid sequence of SEQ ID NO: 966, e. CDR-L2 comprising the amino acid sequence of SEQ ID NO: 1508, and f. CDR-L3 comprising the amino acid sequence of SEQ ID NO: 2050.

In one aspect, the present disclosure provides an antibody or antigen-binding fragment thereof comprising a CDR-H3 comprising the amino acid sequence of SEQ ID NO: 1779, and a CDR-L3 comprising the amino acid sequence of SEQ ID NO: 2050.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 695, b. CDR-H2 comprising the amino acid sequence of SEQ ID NO: 1237, c. CDR-H3 comprising the amino acid sequence of SEQ ID NO: 1779, and a VL comprising the amino acid sequence of SEQ ID NO: 424.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 966, b. CDR-L2 comprising the amino acid sequence of SEQ ID NO: 1508, c. CDR-L3 comprising the amino acid sequence of SEQ ID NO: 2050, and a VH comprising the amino acid sequence of SEQ ID NO: 153.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 153. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 153. In some embodiments, substitutions, insertions, or deletions occur in regions outside the CDRs (e.g., in the FRs). Optionally, the antibody or antigen-binding fragment thereof comprises the VH sequence SEQ ID NO: 153, including one or more post-translational modifications of that sequence. In a particular embodiment, the VH comprises one, two or three CDRs selected from: a. CDR-H1, comprising the amino acid sequence SEQ ID NO: 695, b. CDR-H2, comprising the amino acid sequence SEQ ID NO: 1237, and c. CDR-H3, comprising the amino acid sequence SEQ ID NO: 1779.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 424. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 424. In some embodiments, the substitutions, insertions, or deletions occur in regions outside the CDRs (e.g., in the FRs). Optionally, the antibody or antigen-binding fragment thereof comprises the VL sequence SEQ ID NO: 424, including one or more post-translational modifications of that sequence. In a particular embodiment, the VL comprises one, two or three CDRs selected from: a. CDR-L1, comprising the amino acid sequence SEQ ID NO: 966, b. CDR-L2, comprising the amino acid sequence SEQ ID NO: 1508, and c. CDR-L3, comprising the amino acid sequence SEQ ID NO: 2050.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 153, and the VL amino acid sequence of SEQ ID NO: 424, optionally including post-translational modifications of those sequences.

TLUA1014

In one aspect, the present disclosure provides an antibody or antigen-binding fragment thereof comprising at least one or both variable regions selected from: a. VH comprising the amino acid sequence of SEQ ID NO: 154 and b. VL comprising the amino acid sequence of SEQ ID NO: 425.

In one aspect, the present disclosure provides an antibody or antigen-binding fragment thereof comprising at least one, two, three, four, five, or six CDRs selected from: a. CDR-H1 comprising the amino acid sequence of SEQ ID NO: 696, b. CDR-H2 comprising the amino acid sequence of SEQ ID NO: 1238, c. CDR-H3 comprising the amino acid sequence of SEQ ID NO: 1780, d. CDR-L1 comprising the amino acid sequence of SEQ ID NO: 967, e. CDR-L2 comprising the amino acid sequence of SEQ ID NO: 1509, and f. CDR-L3 comprising the amino acid sequence of SEQ ID NO: 2051.

In one aspect, the present disclosure provides an antibody or antigen-binding fragment thereof comprising a CDR-H3 comprising the amino acid sequence of SEQ ID NO: 1780, and a CDR-L3 comprising the amino acid sequence of SEQ ID NO: 2051.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 696, b. CDR-H2 comprising the amino acid sequence of SEQ ID NO: 1238, c. CDR-H3 comprising the amino acid sequence of SEQ ID NO: 1780, and a VL comprising the amino acid sequence of SEQ ID NO: 425.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 967, b. CDR-L2 comprising the amino acid sequence of SEQ ID NO: 1509, c. CDR-L3 comprising the amino acid sequence of SEQ ID NO: 2051, and a VH comprising the amino acid sequence of SEQ ID NO: 154.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 154. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 154. In some embodiments, substitutions, insertions, or deletions occur in regions outside the CDRs (e.g., in the FRs). Optionally, the antibody or antigen-binding fragment thereof comprises the VH sequence SEQ ID NO: 154, including one or more post-translational modifications of that sequence. In a particular embodiment, the VH comprises one, two or three CDRs selected from: a. CDR-H1, comprising the amino acid sequence SEQ ID NO: 696, b. CDR-H2, comprising the amino acid sequence SEQ ID NO: 1238, and c. CDR-H3, comprising the amino acid sequence SEQ ID NO: 1780.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 425. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 425. In some embodiments, the substitutions, insertions, or deletions occur in regions outside the CDRs (e.g., in the FRs). Optionally, the antibody or antigen-binding fragment thereof comprises the VL sequence SEQ ID NO: 425, including one or more post-translational modifications of that sequence. In a particular embodiment, the VL comprises one, two or three CDRs selected from: a. CDR-L1, comprising the amino acid sequence SEQ ID NO: 967, b. CDR-L2, comprising the amino acid sequence SEQ ID NO: 1509, and c. CDR-L3, comprising the amino acid sequence SEQ ID NO: 2051.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 154, and the VL amino acid sequence of SEQ ID NO: 425, optionally including post-translational modifications of those sequences.
TLUA1015

In one aspect, the present disclosure provides an antibody or antigen-binding fragment thereof comprising at least one or both variable regions selected from: a. VH comprising the amino acid sequence of SEQ ID NO: 155 and b. VL comprising the amino acid sequence of SEQ ID NO: 426.

In one aspect, the present disclosure provides an antibody or antigen-binding fragment thereof comprising at least one, two, three, four, five, or six CDRs selected from: a. CDR-H1 comprising the amino acid sequence of SEQ ID NO: 697, b. CDR-H2 comprising the amino acid sequence of SEQ ID NO: 1239, c. CDR-H3 comprising the amino acid sequence of SEQ ID NO: 1781, d. CDR-L1 comprising the amino acid sequence of SEQ ID NO: 968, e. CDR-L2 comprising the amino acid sequence of SEQ ID NO: 1510, and f. CDR-L3 comprising the amino acid sequence of SEQ ID NO: 2052.

In one aspect, the present disclosure provides an antibody or antigen-binding fragment thereof comprising a CDR-H3 comprising the amino acid sequence of SEQ ID NO: 1781, and a CDR-L3 comprising the amino acid sequence of SEQ ID NO: 2052.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 697, b. CDR-H2 comprising the amino acid sequence of SEQ ID NO: 1239, c. CDR-H3 comprising the amino acid sequence of SEQ ID NO: 1781, and a VL comprising the amino acid sequence of SEQ ID NO: 426.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 968, b. CDR-L2 comprising the amino acid sequence of SEQ ID NO: 1510, c. CDR-L3 comprising the amino acid sequence of SEQ ID NO: 2052, and a VH comprising the amino acid sequence of SEQ ID NO: 155.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 155. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 155. In some embodiments, substitutions, insertions, or deletions occur in regions outside the CDRs (e.g., in the FRs). Optionally, the antibody or antigen-binding fragment thereof comprises the VH sequence SEQ ID NO: 155, including one or more post-translational modifications of that sequence. In a particular embodiment, the VH comprises one, two or three CDRs selected from: a. CDR-H1, comprising the amino acid sequence SEQ ID NO: 697, b. CDR-H2, comprising the amino acid sequence SEQ ID NO: 1239, and c. CDR-H3, comprising the amino acid sequence SEQ ID NO: 1781.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 426. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 426. In some embodiments, the substitutions, insertions, or deletions occur in regions outside the CDRs (e.g., in the FRs). Optionally, the antibody or antigen-binding fragment thereof comprises the VL sequence SEQ ID NO: 426, including one or more post-translational modifications of that sequence. In a particular embodiment, the VL comprises one, two or three CDRs selected from: a. CDR-L1, comprising the amino acid sequence SEQ ID NO: 968, b. CDR-L2, comprising the amino acid sequence SEQ ID NO: 1510, and c. CDR-L3, comprising the amino acid sequence SEQ ID NO: 2052.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 155, and the VL amino acid sequence of SEQ ID NO: 426, optionally including post-translational modifications of those sequences.
TLUA1016

In one aspect, the present disclosure provides an antibody or antigen-binding fragment thereof comprising at least one or both variable regions selected from: a. VH comprising the amino acid sequence of SEQ ID NO: 156 and b. VL comprising the amino acid sequence of SEQ ID NO: 427.

In one aspect, the present disclosure provides an antibody or antigen-binding fragment thereof comprising at least one, two, three, four, five, or six CDRs selected from: a. CDR-H1 comprising the amino acid sequence of SEQ ID NO: 698, b. CDR-H2 comprising the amino acid sequence of SEQ ID NO: 1240, c. CDR-H3 comprising the amino acid sequence of SEQ ID NO: 1782, d. CDR-L1 comprising the amino acid sequence of SEQ ID NO: 969, e. CDR-L2 comprising the amino acid sequence of SEQ ID NO: 1511, and f. CDR-L3 comprising the amino acid sequence of SEQ ID NO: 2053.

In one aspect, the present disclosure provides an antibody or antigen-binding fragment thereof comprising a CDR-H3 comprising the amino acid sequence of SEQ ID NO: 1782, and a CDR-L3 comprising the amino acid sequence of SEQ ID NO: 2053.

In one aspect, the present disclosure provides an antibody or antigen-binding fragment thereof comprising at least one, at least two, or all three VH CDR sequences selected from: a CDR-H1 comprising the amino acid sequence of SEQ ID NO: 698, b. CDR-H2 comprising the amino acid sequence of SEQ ID NO: 1240, c. CDR-H3 comprising the amino acid sequence of SEQ ID NO: 1782, and a VL comprising the amino acid sequence of SEQ ID NO: 427.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 969, b. CDR-L2 comprising the amino acid sequence of SEQ ID NO: 1511, c. CDR-L3 comprising the amino acid sequence of SEQ ID NO: 2053, and a VH comprising the amino acid sequence of SEQ ID NO: 156.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 156. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 156. In some embodiments, substitutions, insertions, or deletions occur in regions outside the CDRs (e.g., in the FRs). Optionally, the antibody or antigen-binding fragment thereof comprises the VH sequence SEQ ID NO: 156, including one or more post-translational modifications of that sequence. In a particular embodiment, the VH comprises one, two or three CDRs selected from: a. CDR-H1, comprising the amino acid sequence SEQ ID NO: 698, b. CDR-H2, comprising the amino acid sequence SEQ ID NO: 1240, and c. CDR-H3, comprising the amino acid sequence SEQ ID NO: 1782.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 427. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 427. In some embodiments, the substitutions, insertions, or deletions occur in regions outside the CDRs (e.g., in the FRs). Optionally, the antibody or antigen-binding fragment thereof comprises the VL sequence SEQ ID NO: 427, including one or more post-translational modifications of that sequence. In a particular embodiment, the VL comprises one, two or three CDRs selected from: a. CDR-L1, comprising the amino acid sequence SEQ ID NO: 969, b. CDR-L2, comprising the amino acid sequence SEQ ID NO: 1511, and c. CDR-L3, comprising the amino acid sequence SEQ ID NO: 2053.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 156, and the VL amino acid sequence of SEQ ID NO: 427, optionally including post-translational modifications of those sequences.

TLUA1017

In one aspect, the present disclosure provides an antibody or antigen-binding fragment thereof comprising at least one or both variable regions selected from: a. VH comprising the amino acid sequence of SEQ ID NO: 157 and b. VL comprising the amino acid sequence of SEQ ID NO: 428.

In one aspect, the present disclosure provides an antibody or antigen-binding fragment thereof comprising at least one, two, three, four, five, or six CDRs selected from: a. CDR-H1 comprising the amino acid sequence of SEQ ID NO: 699, b. CDR-H2 comprising the amino acid sequence of SEQ ID NO: 1241, c. CDR-H3 comprising the amino acid sequence of SEQ ID NO: 1783, d. CDR-L1 comprising the amino acid sequence of SEQ ID NO: 970, e. CDR-L2 comprising the amino acid sequence of SEQ ID NO: 1512, and f. CDR-L3 comprising the amino acid sequence of SEQ ID NO: 2054.

In one aspect, the present disclosure provides an antibody or antigen-binding fragment thereof comprising a CDR-H3 comprising the amino acid sequence of SEQ ID NO: 1783, and a CDR-L3 comprising the amino acid sequence of SEQ ID NO: 2054.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 699, b. CDR-H2 comprising the amino acid sequence of SEQ ID NO: 1241, c. CDR-H3 comprising the amino acid sequence of SEQ ID NO: 1783, and a VL comprising the amino acid sequence of SEQ ID NO: 428.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 970, b. CDR-L2 comprising the amino acid sequence of SEQ ID NO: 1512, c. CDR-L3 comprising the amino acid sequence of SEQ ID NO: 2054, and a VH comprising the amino acid sequence of SEQ ID NO: 157.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 157. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 157. In some embodiments, substitutions, insertions, or deletions occur in regions outside the CDRs (e.g., in the FRs). Optionally, the antibody or antigen-binding fragment thereof comprises the VH sequence SEQ ID NO: 157, including one or more post-translational modifications of that sequence. In a particular embodiment, the VH comprises one, two or three CDRs selected from: a. CDR-H1, comprising the amino acid sequence SEQ ID NO: 699, b. CDR-H2, comprising the amino acid sequence SEQ ID NO: 1241, and c. CDR-H3, comprising the amino acid sequence SEQ ID NO: 1783.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 428. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 428. In some embodiments, the substitutions, insertions, or deletions occur in regions outside the CDRs (e.g., in the FRs). Optionally, the antibody or antigen-binding fragment thereof comprises the VL sequence SEQ ID NO: 428, including one or more post-translational modifications of that sequence. In a particular embodiment, the VL comprises one, two or three CDRs selected from: a. CDR-L1, comprising the amino acid sequence SEQ ID NO: 970, b. CDR-L2, comprising the amino acid sequence SEQ ID NO: 1512, and c. CDR-L3, comprising the amino acid sequence SEQ ID NO: 2054.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 157, and the VL amino acid sequence of SEQ ID NO: 428, optionally including post-translational modifications of those sequences.
TLUA1018

In one aspect, the present disclosure provides an antibody or antigen-binding fragment thereof comprising at least one or both variable regions selected from: a. VH comprising the amino acid sequence of SEQ ID NO: 158 and b. VL comprising the amino acid sequence of SEQ ID NO: 429.

In one aspect, the present disclosure provides an antibody or antigen-binding fragment thereof comprising at least one, two, three, four, five, or six CDRs selected from: a. CDR-H1 comprising the amino acid sequence of SEQ ID NO: 700, b. CDR-H2 comprising the amino acid sequence of SEQ ID NO: 1242, c. CDR-H3 comprising the amino acid sequence of SEQ ID NO: 1784, d. CDR-L1 comprising the amino acid sequence of SEQ ID NO: 971, e. CDR-L2 comprising the amino acid sequence of SEQ ID NO: 1513, and f. CDR-L3 comprising the amino acid sequence of SEQ ID NO: 2055.

In one aspect, the present disclosure provides an antibody or antigen-binding fragment thereof comprising a CDR-H3 comprising the amino acid sequence of SEQ ID NO: 1784, and a CDR-L3 comprising the amino acid sequence of SEQ ID NO: 2055.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 700, b. CDR-H2 comprising the amino acid sequence of SEQ ID NO: 1242, c. CDR-H3 comprising the amino acid sequence of SEQ ID NO: 1784, and a VL comprising the amino acid sequence of SEQ ID NO: 429.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 971, b. CDR-L2 comprising the amino acid sequence of SEQ ID NO: 1513, c. CDR-L3 comprising the amino acid sequence of SEQ ID NO: 2055, and a VH comprising the amino acid sequence of SEQ ID NO: 158.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 158. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 158. In some embodiments, substitutions, insertions, or deletions occur in regions outside the CDRs (e.g., in the FRs). Optionally, the antibody or antigen-binding fragment thereof comprises the VH sequence SEQ ID NO: 158, including one or more post-translational modifications of that sequence. In a particular embodiment, the VH comprises one, two or three CDRs selected from: a. CDR-H1, comprising the amino acid sequence SEQ ID NO: 700, b. CDR-H2, comprising the amino acid sequence SEQ ID NO: 1242, and c. CDR-H3, comprising the amino acid sequence SEQ ID NO: 1784.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 429. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 429. In some embodiments, the substitutions, insertions, or deletions occur in regions outside the CDRs (e.g., in the FRs). Optionally, the antibody or antigen-binding fragment thereof comprises the VL sequence SEQ ID NO: 429, including one or more post-translational modifications of that sequence. In a particular embodiment, the VL comprises one, two or three CDRs selected from: a. CDR-L1, comprising the amino acid sequence SEQ ID NO: 971, b. CDR-L2, comprising the amino acid sequence SEQ ID NO: 1513, and c. CDR-L3, comprising the amino acid sequence SEQ ID NO: 2055.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 158, and the VL amino acid sequence of SEQ ID NO: 429, optionally including post-translational modifications of those sequences.

TLUS1001

In one aspect, the present disclosure provides an antibody or antigen-binding fragment thereof comprising at least one or both variable regions selected from: a. VH comprising the amino acid sequence of SEQ ID NO: 159 and b. VL comprising the amino acid sequence of SEQ ID NO: 430.

In one aspect, the present disclosure provides an antibody or antigen-binding fragment thereof comprising at least one, two, three, four, five, or six CDRs selected from: a. CDR-H1 comprising the amino acid sequence of SEQ ID NO: 701, b. CDR-H2 comprising the amino acid sequence of SEQ ID NO: 1243, c. CDR-H3 comprising the amino acid sequence of SEQ ID NO: 1785, d. CDR-L1 comprising the amino acid sequence of SEQ ID NO: 972, e. CDR-L2 comprising the amino acid sequence of SEQ ID NO: 1514, and f. CDR-L3 comprising the amino acid sequence of SEQ ID NO: 2056.

In one aspect, the present disclosure provides an antibody or antigen-binding fragment thereof comprising a CDR-H3 comprising the amino acid sequence of SEQ ID NO: 1785, and a CDR-L3 comprising the amino acid sequence of SEQ ID NO: 2056.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 701, b. CDR-H2 comprising the amino acid sequence of SEQ ID NO: 1243, c. CDR-H3 comprising the amino acid sequence of SEQ ID NO: 1785, and a VL comprising the amino acid sequence of SEQ ID NO: 430.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 972, b. CDR-L2 comprising the amino acid sequence of SEQ ID NO: 1514, c. CDR-L3 comprising the amino acid sequence of SEQ ID NO: 2056, and a VH comprising the amino acid sequence of SEQ ID NO: 159.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 159. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 159. In some embodiments, substitutions, insertions, or deletions occur in regions outside the CDRs (e.g., in the FRs). Optionally, the antibody or antigen-binding fragment thereof comprises the VH sequence SEQ ID NO: 159, including one or more post-translational modifications of that sequence. In a particular embodiment, the VH comprises one, two or three CDRs selected from: a. CDR-H1, comprising the amino acid sequence SEQ ID NO: 701, b. CDR-H2, comprising the amino acid sequence SEQ ID NO: 1243, and a CDR-H3, comprising the amino acid sequence SEQ ID NO: 1785.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 430. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 430. In some embodiments, the substitutions, insertions, or deletions occur in regions outside the CDRs (e.g., in the FRs). Optionally, the antibody or antigen-binding fragment thereof comprises the VL sequence SEQ ID NO: 430, including one or more post-translational modifications of that sequence. In a particular embodiment, the VL comprises one, two or three CDRs selected from: a. CDR-L1, comprising the amino acid sequence SEQ ID NO: 972, b. CDR-L2, comprising the amino acid sequence SEQ ID NO: 1514, and c. CDR-L3, comprising the amino acid sequence SEQ ID NO: 2056.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 159, and the VL amino acid sequence of SEQ ID NO: 430, optionally including post-translational modifications of those sequences.

TLUS1002

In one aspect, the present disclosure provides an antibody or antigen-binding fragment thereof comprising at least one or both variable regions selected from: a VH comprising the amino acid sequence of SEQ ID NO: 160 and b. VL comprising the amino acid sequence of SEQ ID NO: 431.

In one aspect, the present disclosure provides an antibody or antigen-binding fragment thereof comprising at least one, two, three, four, five, or six CDRs selected from: a. CDR-H1 comprising the amino acid sequence of SEQ ID NO: 702, b. CDR-H2 comprising the amino acid sequence of SEQ ID NO: 1244, c. CDR-H3 comprising the amino acid sequence of SEQ ID NO: 1786, d. CDR-L1 comprising the amino acid sequence of SEQ ID NO: 973, e. CDR-L2 comprising the amino acid sequence of SEQ ID NO: 1515, and f. CDR-L3 comprising the amino acid sequence of SEQ ID NO: 2057.

In one aspect, the present disclosure provides an antibody or antigen-binding fragment thereof comprising a CDR-H3 comprising the amino acid sequence of SEQ ID NO: 1786, and a CDR-L3 comprising the amino acid sequence of SEQ ID NO: 2057.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 702, b. CDR-H2 comprising the amino acid sequence of SEQ ID NO: 1244, c. CDR-H3 comprising the amino acid sequence of SEQ ID NO: 1786, and a VL comprising the amino acid sequence of SEQ ID NO: 431.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 973, b. CDR-L2 comprising the amino acid sequence of SEQ ID NO: 1515, c. CDR-L3 comprising the amino acid sequence of SEQ ID NO: 2057, and a VH comprising the amino acid sequence of SEQ ID NO: 160.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 160. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 160. In some embodiments, substitutions, insertions, or deletions occur in regions outside the CDRs (e.g., in the FRs). Optionally, the antibody or antigen-binding fragment thereof comprises the VH sequence SEQ ID NO: 160, including one or more post-translational modifications of that sequence. In a particular embodiment, the VH comprises one, two or three CDRs selected from: a. CDR-H1, comprising the amino acid sequence SEQ ID NO: 702, b. CDR-H2, comprising the amino acid sequence SEQ ID NO: 1244, and c. CDR-H3, comprising the amino acid sequence SEQ ID NO: 1786.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 431. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 431. In some embodiments, the substitutions, insertions, or deletions occur in regions outside the CDRs (e.g., in the FRs). Optionally, the antibody or antigen-binding fragment thereof comprises the VL sequence SEQ ID NO: 431, including one or more post-translational modifications of that sequence. In a particular embodiment, the VL comprises one, two or three CDRs selected from: a. CDR-L1, comprising the amino acid sequence SEQ ID NO: 973, b. CDR-L2, comprising the amino acid sequence SEQ ID NO: 1515, and c. CDR-L3, comprising the amino acid sequence SEQ ID NO: 2057.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 160, and the VL amino acid sequence of SEQ ID NO: 431, optionally including post-translational modifications of those sequences.
TLUS1003

In one aspect, the present disclosure provides an antibody or antigen-binding fragment thereof comprising at least one or both variable regions selected from: a. VH comprising the amino acid sequence of SEQ ID NO: 161 and b. VL comprising the amino acid sequence of SEQ ID NO: 432.

In one aspect, the present disclosure provides an antibody or antigen-binding fragment thereof comprising at least one, two, three, four, five, or six CDRs selected from: a. CDR-H1 comprising the amino acid sequence of SEQ ID NO: 703, b. CDR-H2 comprising the amino acid sequence of SEQ ID NO: 1245, c. CDR-H3 comprising the amino acid sequence of SEQ ID NO: 1787, d. CDR-L1 comprising the amino acid sequence of SEQ ID NO: 974, e. CDR-L2 comprising the amino acid sequence of SEQ ID NO: 1516, and f. CDR-L3 comprising the amino acid sequence of SEQ ID NO: 2058.

In one aspect, the present disclosure provides an antibody or antigen-binding fragment thereof comprising a CDR-H3 comprising the amino acid sequence of SEQ ID NO: 1787, and a CDR-L3 comprising the amino acid sequence of SEQ ID NO: 2058.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 703, b. CDR-H2 comprising the amino acid sequence of SEQ ID NO: 1245, c. CDR-H3 comprising the amino acid sequence of SEQ ID NO: 1787, and a VL comprising the amino acid sequence of SEQ ID NO: 432.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 974, b. CDR-L2 comprising the amino acid sequence of SEQ ID NO: 1516, c. CDR-L3 comprising the amino acid sequence of SEQ ID NO: 2058, and a VH comprising the amino acid sequence of SEQ ID NO: 161.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 161. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 161. In some embodiments, substitutions, insertions, or deletions occur in regions outside the CDRs (e.g., in the FRs). Optionally, the antibody or antigen-binding fragment thereof comprises the VH sequence SEQ ID NO: 161, including one or more post-translational modifications of that sequence. In a particular embodiment, the VH comprises one, two or three CDRs selected from: a. CDR-H1, comprising the amino acid sequence SEQ ID NO: 703, b. CDR-H2, comprising the amino acid sequence SEQ ID NO: 1245, and c. CDR-H3, comprising the amino acid sequence SEQ ID NO: 1787.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 432. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 432. In some embodiments, the substitutions, insertions, or deletions occur in regions outside the CDRs (e.g., in the FRs). Optionally, the antibody or antigen-binding fragment thereof comprises the VL sequence SEQ ID NO: 432, including one or more post-translational modifications of that sequence. In a particular embodiment, the VL comprises one, two or three CDRs selected from: a. CDR-L1, comprising the amino acid sequence SEQ ID NO: 974, b. CDR-L2, comprising the amino acid sequence SEQ ID NO: 1516, and c. CDR-L3, comprising the amino acid sequence SEQ ID NO: 2058.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 161, and the VL amino acid sequence of SEQ ID NO: 432, optionally including post-translational modifications of those sequences.

TLUS1004

In one aspect, the present disclosure provides an antibody or antigen-binding fragment thereof comprising at least one or both variable regions selected from: a. VH comprising the amino acid sequence of SEQ ID NO: 162 and b. VL comprising the amino acid sequence of SEQ ID NO: 433.

In one aspect, the present disclosure provides an antibody or antigen-binding fragment thereof comprising at least one, two, three, four, five, or six CDRs selected from: a. CDR-H1 comprising the amino acid sequence of SEQ ID NO: 704, b. CDR-H2 comprising the amino acid sequence of SEQ ID NO: 1246, c. CDR-H3 comprising the amino acid sequence of SEQ ID NO: 1788, d. CDR-L1 comprising the amino acid sequence of SEQ ID NO: 975, e. CDR-L2 comprising the amino acid sequence of SEQ ID NO: 1517, and f. CDR-L3 comprising the amino acid sequence of SEQ ID NO: 2059.

In one aspect, the present disclosure provides an antibody or antigen-binding fragment thereof comprising a CDR-H3 comprising the amino acid sequence of SEQ ID NO: 1788, and a CDR-L3 comprising the amino acid sequence of SEQ ID NO: 2059.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 704, b. CDR-H2 comprising the amino acid sequence of SEQ ID NO: 1246, c. CDR-H3 comprising the amino acid sequence of SEQ ID NO: 1788, and a VL comprising the amino acid sequence of SEQ ID NO: 433.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 975, b. CDR-L2 comprising the amino acid sequence of SEQ ID NO: 1517, c. CDR-L3 comprising the amino acid sequence of SEQ ID NO: 2059, and a VH comprising the amino acid sequence of SEQ ID NO: 162.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 162. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 162. In some embodiments, substitutions, insertions, or deletions occur in regions outside the CDRs (e.g., in the FRs). Optionally, the antibody or antigen-binding fragment thereof comprises the VH sequence SEQ ID NO: 162, including one or more post-translational modifications of that sequence. In a particular embodiment, the VH comprises one, two or three CDRs selected from: a. CDR-H1, comprising the amino acid sequence SEQ ID NO: 704, b. CDR-H2, comprising the amino acid sequence SEQ ID NO: 1246, and c. CDR-H3, comprising the amino acid sequence SEQ ID NO: 1788.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 433. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 433. In some embodiments, the substitutions, insertions, or deletions occur in regions outside the CDRs (e.g., in the FRs). Optionally, the antibody or antigen-binding fragment thereof comprises the VL sequence SEQ ID NO: 433, including one or more post-translational modifications of that sequence. In a particular embodiment, the VL comprises one, two or three CDRs selected from: a. CDR-L1, comprising the amino acid sequence SEQ ID NO: 975, b. CDR-L2, comprising the amino acid sequence SEQ ID NO: 1517, and c. CDR-L3, comprising the amino acid sequence SEQ ID NO: 2059.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 162, and the VL amino acid sequence of SEQ ID NO: 433, optionally including post-translational modifications of those sequences.

TLUS1005

In one aspect, the present disclosure provides an antibody or antigen-binding fragment thereof comprising at least one or both variable regions selected from: a. VH comprising the amino acid sequence of SEQ ID NO: 163 and b. VL comprising the amino acid sequence of SEQ ID NO: 434.

In one aspect, the present disclosure provides an antibody or antigen-binding fragment thereof comprising at least one, two, three, four, five, or six CDRs selected from: a. CDR-H1 comprising the amino acid sequence of SEQ ID NO: 705, b. CDR-H2 comprising the amino acid sequence of SEQ ID NO: 1247, c. CDR-H3 comprising the amino acid sequence of SEQ ID NO: 1789, d. CDR-L1 comprising the amino acid sequence of SEQ ID NO: 976, e. CDR-L2 comprising the amino acid sequence of SEQ ID NO: 1518, and f. CDR-L3 comprising the amino acid sequence of SEQ ID NO: 2060.

In one aspect, the present disclosure provides an antibody or antigen-binding fragment thereof comprising a CDR-H3 comprising the amino acid sequence of SEQ ID NO: 1789, and a CDR-L3 comprising the amino acid sequence of SEQ ID NO: 2060.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 705, b. CDR-H2 comprising the amino acid sequence of SEQ ID NO: 1247, c. CDR-H3 comprising the amino acid sequence of SEQ ID NO: 1789, and a VL comprising the amino acid sequence of SEQ ID NO: 434.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 976, b. CDR-L2 comprising the amino acid sequence of SEQ ID NO: 1518, c. CDR-L3 comprising the amino acid sequence of SEQ ID NO: 2060, and a VH comprising the amino acid sequence of SEQ ID NO: 163.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 163. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 163. In some embodiments, substitutions, insertions, or deletions occur in regions outside the CDRs (e.g., in the FRs). Optionally, the antibody or antigen-binding fragment thereof comprises the VH sequence SEQ ID NO: 163, including one or more post-translational modifications of that sequence. In a particular embodiment, the VH comprises one, two or three CDRs selected from: a. CDR-H1, comprising the amino acid sequence SEQ ID NO: 705, b. CDR-H2, comprising the amino acid sequence SEQ ID NO: 1247, and c. CDR-H3, comprising the amino acid sequence SEQ ID NO: 1789.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 434. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 434. In some embodiments, the substitutions, insertions, or deletions occur in regions outside the CDRs (e.g., in the FRs). Optionally, the antibody or antigen-binding fragment thereof comprises the VL sequence SEQ ID NO: 434, including one or more post-translational modifications of that sequence. In a particular embodiment, the VL comprises one, two or three CDRs selected from: a. CDR-L1, comprising the amino acid sequence SEQ ID NO: 976, b. CDR-L2, comprising the amino acid sequence SEQ ID NO: 1518, and c. CDR-L3, comprising the amino acid sequence SEQ ID NO: 2060.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 163, and the VL amino acid sequence of SEQ ID NO: 434, optionally including post-translational modifications of those sequences.

TLUS1006

In one aspect, the present disclosure provides an antibody or antigen-binding fragment thereof comprising at least one or both variable regions selected from: a. VH comprising the amino acid sequence of SEQ ID NO: 164 and b. VL comprising the amino acid sequence of SEQ ID NO: 435.

In one aspect, the present disclosure provides an antibody or antigen-binding fragment thereof comprising at least one, two, three, four, five, or six CDRs selected from: a. CDR-H1 comprising the amino acid sequence of SEQ ID NO: 706, b. CDR-H2 comprising the amino acid sequence of SEQ ID NO: 1248, c. CDR-H3 comprising the amino acid sequence of SEQ ID NO: 1790, d. CDR-L1 comprising the amino acid sequence of SEQ ID NO: 977, e. CDR-L2 comprising the amino acid sequence of SEQ ID NO: 1519, and f. CDR-L3 comprising the amino acid sequence of SEQ ID NO: 2061.

In one aspect, the present disclosure provides an antibody or antigen-binding fragment thereof comprising a CDR-H3 comprising the amino acid sequence of SEQ ID NO: 1790, and a CDR-L3 comprising the amino acid sequence of SEQ ID NO: 2061.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 706, b. CDR-H2 comprising the amino acid sequence of SEQ ID NO: 1248, c. CDR-H3 comprising the amino acid sequence of SEQ ID NO: 1790, and a VL comprising the amino acid sequence of SEQ ID NO: 435.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 977, b. CDR-L2 comprising the amino acid sequence of SEQ ID NO: 1519, c. CDR-L3 comprising the amino acid sequence of SEQ ID NO: 2061, and a VH comprising the amino acid sequence of SEQ ID NO: 164.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 164. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 164. In some embodiments, substitutions, insertions, or deletions occur in regions outside the CDRs (e.g., in the FRs). Optionally, the antibody or antigen-binding fragment thereof comprises the VH sequence SEQ ID NO: 164, including one or more post-translational modifications of that sequence. In a particular embodiment, the VH comprises one, two or three CDRs selected from: a. CDR-H1, comprising the amino acid sequence SEQ ID NO: 706, b. CDR-H2, comprising the amino acid sequence SEQ ID NO: 1248, and c. CDR-H3, comprising the amino acid sequence SEQ ID NO: 1790.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 435. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 435. In some embodiments, the substitutions, insertions, or deletions occur in regions outside the CDRs (e.g., in the FRs). Optionally, the antibody or antigen-binding fragment thereof comprises the VL sequence SEQ ID NO: 435, including one or more post-translational modifications of that sequence. In a particular embodiment, the VL comprises one, two or three CDRs selected from: a. CDR-L1, comprising the amino acid sequence SEQ ID NO: 977, b. CDR-L2, comprising the amino acid sequence SEQ ID NO: 1519, and c. CDR-L3, comprising the amino acid sequence SEQ ID NO: 2061.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 164, and the VL amino acid sequence of SEQ ID NO: 435, optionally including post-translational modifications of those sequences.

TLUS1007

In one aspect, the present disclosure provides an antibody or antigen-binding fragment thereof comprising at least one or both variable regions selected from: a. VH comprising the amino acid sequence of SEQ ID NO: 165 and b. VL comprising the amino acid sequence of SEQ ID NO: 436.

In one aspect, the present disclosure provides an antibody or antigen-binding fragment thereof comprising at least one, two, three, four, five, or six CDRs selected from: a. CDR-H1 comprising the amino acid sequence of SEQ ID NO: 707, b. CDR-H2 comprising the amino acid sequence of SEQ ID NO: 1249, c. CDR-H3 comprising the amino acid sequence of SEQ ID NO: 1791, d. CDR-L1 comprising the amino acid sequence of SEQ ID NO: 978, e. CDR-L2 comprising the amino acid sequence of SEQ ID NO: 1520, and f. CDR-L3 comprising the amino acid sequence of SEQ ID NO: 2062.

In one aspect, the present disclosure provides an antibody or antigen-binding fragment thereof comprising a CDR-H3 comprising the amino acid sequence of SEQ ID NO: 1791, and a CDR-L3 comprising the amino acid sequence of SEQ ID NO: 2062.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 707, b. CDR-H2 comprising the amino acid sequence of SEQ ID NO: 1249, c. CDR-H3 comprising the amino acid sequence of SEQ ID NO: 1791, and a VL comprising the amino acid sequence of SEQ ID NO: 436.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 978, b. CDR-L2 comprising the amino acid sequence of SEQ ID NO: 1520, c. CDR-L3 comprising the amino acid sequence of SEQ ID NO: 2062, and a VH comprising the amino acid sequence of SEQ ID NO: 165.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 165. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 165. In some embodiments, substitutions, insertions, or deletions occur in regions outside the CDRs (e.g., in the FRs). Optionally, the antibody or antigen-binding fragment thereof comprises the VH sequence SEQ ID NO: 165, including one or more post-translational modifications of that sequence. In a particular embodiment, the VH comprises one, two or three CDRs selected from: a. CDR-H1, comprising the amino acid sequence SEQ ID NO: 707, b. CDR-H2, comprising the amino acid sequence SEQ ID NO: 1249, and c. CDR-H3, comprising the amino acid sequence SEQ ID NO: 1791.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 436. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 436. In some embodiments, the substitutions, insertions, or deletions occur in regions outside the CDRs (e.g., in the FRs). Optionally, the antibody or antigen-binding fragment thereof comprises the VL sequence SEQ ID NO: 436, including one or more post-translational modifications of that sequence. In a particular embodiment, the VL comprises one, two or three CDRs selected from: a. CDR-L1, comprising the amino acid sequence SEQ ID NO: 978, b. CDR-L2, comprising the amino acid sequence SEQ ID NO: 1520, and c. CDR-L3, comprising the amino acid sequence SEQ ID NO: 2062.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 165, and the VL amino acid sequence of SEQ ID NO: 436, optionally including post-translational modifications of those sequences.

TLUS1008

In one aspect, the present disclosure provides an antibody or antigen-binding fragment thereof comprising at least one or both variable regions selected from: a. VH comprising the amino acid sequence of SEQ ID NO: 166 and b. VL comprising the amino acid sequence of SEQ ID NO: 437.

In one aspect, the present disclosure provides an antibody or antigen-binding fragment thereof comprising at least one, two, three, four, five, or six CDRs selected from: a. CDR-H1 comprising the amino acid sequence of SEQ ID NO: 708, b. CDR-H2 comprising the amino acid sequence of SEQ ID NO: 1250, c. CDR-H3 comprising the amino acid sequence of SEQ ID NO: 1792, d. CDR-L1 comprising the amino acid sequence of SEQ ID NO: 979, e. CDR-L2 comprising the amino acid sequence of SEQ ID NO: 1521, and f. CDR-L3 comprising the amino acid sequence of SEQ ID NO: 2063.

In one aspect, the present disclosure provides an antibody or antigen-binding fragment thereof comprising a CDR-H3 comprising the amino acid sequence of SEQ ID NO: 1792, and a CDR-L3 comprising the amino acid sequence of SEQ ID NO: 2063.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 708, b. CDR-H2 comprising the amino acid sequence of SEQ ID NO: 1250, c. CDR-H3 comprising the amino acid sequence of SEQ ID NO: 1792, and a VL comprising the amino acid sequence of SEQ ID NO: 437.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 979, b. CDR-L2 comprising the amino acid sequence of SEQ ID NO: 1521, c. CDR-L3 comprising the amino acid sequence of SEQ ID NO: 2063, and a VH comprising the amino acid sequence of SEQ ID NO: 166.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 166. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 166. In some embodiments, substitutions, insertions, or deletions occur in regions outside the CDRs (e.g., in the FRs). Optionally, the antibody or antigen-binding fragment thereof comprises the VH sequence SEQ ID NO: 166, including one or more post-translational modifications of that sequence. In a particular embodiment, the VH comprises one, two or three CDRs selected from: a. CDR-H1, comprising the amino acid sequence SEQ ID NO: 708, b. CDR-H2, comprising the amino acid sequence SEQ ID NO: 1250, and c. CDR-H3, comprising the amino acid sequence SEQ ID NO: 1792.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 437. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 437. In some embodiments, the substitutions, insertions, or deletions occur in regions outside the CDRs (e.g., in the FRs). Optionally, the antibody or antigen-binding fragment thereof comprises the VL sequence SEQ ID NO: 437, including one or more post-translational modifications of that sequence. In a particular embodiment, the VL comprises one, two or three CDRs selected from: a. CDR-L1, comprising the amino acid sequence SEQ ID NO: 979, b. CDR-L2, comprising the amino acid sequence SEQ ID NO: 1521, and c. CDR-L3, comprising the amino acid sequence SEQ ID NO: 2063.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 166, and the VL amino acid sequence of SEQ ID NO: 437, optionally including post-translational modifications of those sequences.

TLUS1009

In one aspect, the present disclosure provides an antibody or antigen-binding fragment thereof comprising at least one or both variable regions selected from: a. VH comprising the amino acid sequence of SEQ ID NO: 167 and b. VL comprising the amino acid sequence of SEQ ID NO: 438.

In one aspect, the present disclosure provides an antibody or antigen-binding fragment thereof comprising at least one, two, three, four, five, or six CDRs selected from: a. CDR-H1 comprising the amino acid sequence of SEQ ID NO: 709, b. CDR-H2 comprising the amino acid sequence of SEQ ID NO: 1251, c. CDR-H3 comprising the amino acid sequence of SEQ ID NO: 1793, d. CDR-L1 comprising the amino acid sequence of SEQ ID NO: 980, e. CDR-L2 comprising the amino acid sequence of SEQ ID NO: 1522, and f. CDR-L3 comprising the amino acid sequence of SEQ ID NO: 2064.

In one aspect, the present disclosure provides an antibody or antigen-binding fragment thereof comprising a CDR-H3 comprising the amino acid sequence of SEQ ID NO: 1793, and a CDR-L3 comprising the amino acid sequence of SEQ ID NO: 2064.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 709, b. CDR-H2 comprising the amino acid sequence of SEQ ID NO: 1251, c. CDR-H3 comprising the amino acid sequence of SEQ ID NO: 1793, and a VL comprising the amino acid sequence of SEQ ID NO: 438.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 980, b. CDR-L2 comprising the amino acid sequence of SEQ ID NO: 1522, c. CDR-L3 comprising the amino acid sequence of SEQ ID NO: 2064, and a VH comprising the amino acid sequence of SEQ ID NO: 167.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 167. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 167. In some embodiments, substitutions, insertions, or deletions occur in regions outside the CDRs (e.g., in the FRs). Optionally, the antibody or antigen-binding fragment thereof comprises the VH sequence SEQ ID NO: 167, including one or more post-translational modifications of that sequence. In a particular embodiment, the VH comprises one, two or three CDRs selected from: a. CDR-H1, comprising the amino acid sequence SEQ ID NO: 709, b. CDR-H2, comprising the amino acid sequence SEQ ID NO: 1251, and c. CDR-H3, comprising the amino acid sequence SEQ ID NO: 1793.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 438. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 438. In some embodiments, the substitutions, insertions, or deletions occur in regions outside the CDRs (e.g., in the FRs). Optionally, the antibody or antigen-binding fragment thereof comprises the VL sequence SEQ ID NO: 438, including one or more post-translational modifications of that sequence. In a particular embodiment, the VL comprises one, two or three CDRs selected from: a. CDR-L1, comprising the amino acid sequence SEQ ID NO: 980, b. CDR-L2, comprising the amino acid sequence SEQ ID NO: 1522, and c. CDR-L3, comprising the amino acid sequence SEQ ID NO: 2064.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 167, and the VL amino acid sequence of SEQ ID NO: 438, optionally including post-translational modifications of those sequences.
TLUS1010

In one aspect, the present disclosure provides an antibody or antigen-binding fragment thereof comprising at least one or both variable regions selected from: a. VH comprising the amino acid sequence of SEQ ID NO: 168 and b. VL comprising the amino acid sequence of SEQ ID NO: 439.

In one aspect, the present disclosure provides an antibody or antigen-binding fragment thereof comprising at least one, two, three, four, five, or six CDRs selected from: a. CDR-H1 comprising the amino acid sequence of SEQ ID NO: 710, b. CDR-H2 comprising the amino acid sequence of SEQ ID NO: 1252, c. CDR-H3 comprising the amino acid sequence of SEQ ID NO: 1794, d. CDR-L1 comprising the amino acid sequence of SEQ ID NO: 981, e. CDR-L2 comprising the amino acid sequence of SEQ ID NO: 1523, and f. CDR-L3 comprising the amino acid sequence of SEQ ID NO: 2065.

In one aspect, the present disclosure provides an antibody or antigen-binding fragment thereof comprising a CDR-H3 comprising the amino acid sequence of SEQ ID NO: 1794, and a CDR-L3 comprising the amino acid sequence of SEQ ID NO: 2065.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 710, b. CDR-H2 comprising the amino acid sequence of SEQ ID NO: 1252, c. CDR-H3 comprising the amino acid sequence of SEQ ID NO: 1794, and a VL comprising the amino acid sequence of SEQ ID NO: 439.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 981, b. CDR-L2 comprising the amino acid sequence of SEQ ID NO: 1523, c. CDR-L3 comprising the amino acid sequence of SEQ ID NO: 2065, and a VH comprising the amino acid sequence of SEQ ID NO: 168.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 168. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 168. In some embodiments, substitutions, insertions, or deletions occur in regions outside the CDRs (e.g., in the FRs). Optionally, the antibody or antigen-binding fragment thereof comprises the VH sequence SEQ ID NO: 168, including one or more post-translational modifications of that sequence. In a particular embodiment, the VH comprises one, two or three CDRs selected from: a. CDR-H1, comprising the amino acid sequence SEQ ID NO: 710, b. CDR-H2, comprising the amino acid sequence SEQ ID NO: 1252, and c. CDR-H3, comprising the amino acid sequence SEQ ID NO: 1794.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 439. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 439. In some embodiments, the substitutions, insertions, or deletions occur in regions outside the CDRs (e.g., in the FRs). Optionally, the antibody or antigen-binding fragment thereof comprises the VL sequence SEQ ID NO: 439, including one or more post-translational modifications of that sequence. In a particular embodiment, the VL comprises one, two or three CDRs selected from: a. CDR-L1, comprising the amino acid sequence SEQ ID NO: 981, b. CDR-L2, comprising the amino acid sequence SEQ ID NO: 1523, and c. CDR-L3, comprising the amino acid sequence SEQ ID NO: 2065.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 168, and the VL amino acid sequence of SEQ ID NO: 439, optionally including post-translational modifications of those sequences.
TLUS1011

In one aspect, the present disclosure provides an antibody or antigen-binding fragment thereof comprising at least one or both variable regions selected from: a. VH comprising the amino acid sequence of SEQ ID NO: 169 and b. VL comprising the amino acid sequence of SEQ ID NO: 440.

In one aspect, the present disclosure provides an antibody or antigen-binding fragment thereof comprising at least one, two, three, four, five, or six CDRs selected from: a. CDR-H1 comprising the amino acid sequence of SEQ ID NO: 711, b. CDR-H2 comprising the amino acid sequence of SEQ ID NO: 1253, c. CDR-H3 comprising the amino acid sequence of SEQ ID NO: 1795, d. CDR-L1 comprising the amino acid sequence of SEQ ID NO: 982, e. CDR-L2 comprising the amino acid sequence of SEQ ID NO: 1524, and f. CDR-L3 comprising the amino acid sequence of SEQ ID NO: 2066.

In one aspect, the present disclosure provides an antibody or antigen-binding fragment thereof comprising a CDR-H3 comprising the amino acid sequence of SEQ ID NO: 1795, and a CDR-L3 comprising the amino acid sequence of SEQ ID NO: 2066.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 711, b. CDR-H2 comprising the amino acid sequence of SEQ ID NO: 1253, c. CDR-H3 comprising the amino acid sequence of SEQ ID NO: 1795, and a VL comprising the amino acid sequence of SEQ ID NO: 440.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 982, b. CDR-L2 comprising the amino acid sequence of SEQ ID NO: 1524, c. CDR-L3 comprising the amino acid sequence of SEQ ID NO: 2066, and a VH comprising the amino acid sequence of SEQ ID NO: 169.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 169. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 169. In some embodiments, substitutions, insertions, or deletions occur in regions outside the CDRs (e.g., in the FRs). Optionally, the antibody or antigen-binding fragment thereof comprises the VH sequence SEQ ID NO: 169, including one or more post-translational modifications of that sequence. In a particular embodiment, the VH comprises one, two or three CDRs selected from: a. CDR-H1, comprising the amino acid sequence SEQ ID NO: 711, b. CDR-H2, comprising the amino acid sequence SEQ ID NO: 1253, and c. CDR-H3, comprising the amino acid sequence SEQ ID NO: 1795.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 440. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 440. In some embodiments, the substitutions, insertions, or deletions occur in regions outside the CDRs (e.g., in the FRs). Optionally, the antibody or antigen-binding fragment thereof comprises the VL sequence SEQ ID NO: 440, including one or more post-translational modifications of that sequence. In a particular embodiment, the VL comprises one, two or three CDRs selected from: a. CDR-L1, comprising the amino acid sequence SEQ ID NO: 982, b. CDR-L2, comprising the amino acid sequence SEQ ID NO: 1524, and c. CDR-L3, comprising the amino acid sequence SEQ ID NO: 2066.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 169, and the VL amino acid sequence of SEQ ID NO: 440, optionally including post-translational modifications of those sequences.

TMEL1015

In one aspect, the present disclosure provides an antibody or antigen-binding fragment thereof comprising at least one or both variable regions selected from: a. VH comprising the amino acid sequence of SEQ ID NO: 170 and b. VL comprising the amino acid sequence of SEQ ID NO: 441.

In one aspect, the present disclosure provides an antibody or antigen-binding fragment thereof comprising at least one, two, three, four, five, or six CDRs selected from: a. CDR-H1 comprising the amino acid sequence of SEQ ID NO: 712, b. CDR-H2 comprising the amino acid sequence of SEQ ID NO: 1254, c. CDR-H3 comprising the amino acid sequence of SEQ ID NO: 1796, d. CDR-L1 comprising the amino acid sequence of SEQ ID NO: 983, e. CDR-L2 comprising the amino acid sequence of SEQ ID NO: 1525, and f. CDR-L3 comprising the amino acid sequence of SEQ ID NO: 2067.

In one aspect, the present disclosure provides an antibody or antigen-binding fragment thereof comprising a CDR-H3 comprising the amino acid sequence of SEQ ID NO: 1796, and a CDR-L3 comprising the amino acid sequence of SEQ ID NO: 2067.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 712, b. CDR-H2 comprising the amino acid sequence of SEQ ID NO: 1254, c. CDR-H3 comprising the amino acid sequence of SEQ ID NO: 1796, and a VL comprising the amino acid sequence of SEQ ID NO: 441.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 983, b. CDR-L2 comprising the amino acid sequence of SEQ ID NO: 1525, c. CDR-L3 comprising the amino acid sequence of SEQ ID NO: 2067, and a VH comprising the amino acid sequence of SEQ ID NO: 170.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 170. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 170. In some embodiments, substitutions, insertions, or deletions occur in regions outside the CDRs (e.g., in the FRs). Optionally, the antibody or antigen-binding fragment thereof comprises the VH sequence SEQ ID NO: 170, including one or more post-translational modifications of that sequence. In a particular embodiment, the VH comprises one, two or three CDRs selected from: a. CDR-H1, comprising the amino acid sequence SEQ ID NO: 712, b. CDR-H2, comprising the amino acid sequence SEQ ID NO: 1254, and c. CDR-H3, comprising the amino acid sequence SEQ ID NO: 1796.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 441. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 441. In some embodiments, the substitutions, insertions, or deletions occur in regions outside the CDRs (e.g., in the FRs). Optionally, the antibody or antigen-binding fragment thereof comprises the VL sequence SEQ ID NO: 441, including one or more post-translational modifications of that sequence. In a particular embodiment, the VL comprises one, two or three CDRs selected from: a. CDR-L1, comprising the amino acid sequence SEQ ID NO: 983, b. CDR-L2, comprising the amino acid sequence SEQ ID NO: 1525, and c. CDR-L3, comprising the amino acid sequence SEQ ID NO: 2067.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 170, and the VL amino acid sequence of SEQ ID NO: 441, optionally including post-translational modifications of those sequences.

TMEL1016

In one aspect, the present disclosure provides an antibody or antigen-binding fragment thereof comprising at least one or both variable regions selected from: a. VH comprising the amino acid sequence of SEQ ID NO: 171 and b. VL comprising the amino acid sequence of SEQ ID NO: 442.

In one aspect, the present disclosure provides an antibody or antigen-binding fragment thereof comprising at least one, two, three, four, five, or six CDRs selected from: a. CDR-H1 comprising the amino acid sequence of SEQ ID NO: 713, b. CDR-H2 comprising the amino acid sequence of SEQ ID NO: 1255, c. CDR-H3 comprising the amino acid sequence of SEQ ID NO: 1797, d. CDR-L1 comprising the amino acid sequence of SEQ ID NO: 984, e. CDR-L2 comprising the amino acid sequence of SEQ ID NO: 1526, and f. CDR-L3 comprising the amino acid sequence of SEQ ID NO: 2068.

In one aspect, the present disclosure provides an antibody or antigen-binding fragment thereof comprising a CDR-H3 comprising the amino acid sequence of SEQ ID NO: 1797, and a CDR-L3 comprising the amino acid sequence of SEQ ID NO: 2068.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 713, b. CDR-H2 comprising the amino acid sequence of SEQ ID NO: 1255, c. CDR-H3 comprising the amino acid sequence of SEQ ID NO: 1797, and a VL comprising the amino acid sequence of SEQ ID NO: 442.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 984, b. CDR-L2 comprising the amino acid sequence of SEQ ID NO: 1526, c. CDR-L3 comprising the amino acid sequence of SEQ ID NO: 2068, and a VH comprising the amino acid sequence of SEQ ID NO: 171.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 171. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 171. In some embodiments, substitutions, insertions, or deletions occur in regions outside the CDRs (e.g., in the FRs). Optionally, the antibody or antigen-binding fragment thereof comprises the VH sequence SEQ ID NO: 171, including one or more post-translational modifications of that sequence. In a particular embodiment, the VH comprises one, two or three CDRs selected from: a. CDR-H1, comprising the amino acid sequence SEQ ID NO: 713, b. CDR-H2, comprising the amino acid sequence SEQ ID NO: 1255, and c. CDR-H3, comprising the amino acid sequence SEQ ID NO: 1797.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 442. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 442. In some embodiments, the substitutions, insertions, or deletions occur in regions outside the CDRs (e.g., in the FRs). Optionally, the antibody or antigen-binding fragment thereof comprises the VL sequence SEQ ID NO: 442, including one or more post-translational modifications of that sequence. In a particular embodiment, the VL comprises one, two or three CDRs selected from: a. CDR-L1, comprising the amino acid sequence SEQ ID NO: 984, b. CDR-L2, comprising the amino acid sequence SEQ ID NO: 1526, and c. CDR-L3, comprising the amino acid sequence SEQ ID NO: 2068.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 171, and the VL amino acid sequence of SEQ ID NO: 442, optionally including post-translational modifications of those sequences.
TMEL1017

In one aspect, the present disclosure provides an antibody or antigen-binding fragment thereof comprising at least one or both variable regions selected from: a. VH comprising the amino acid sequence of SEQ ID NO: 172 and b. VL comprising the amino acid sequence of SEQ ID NO: 443.

In one aspect, the present disclosure provides an antibody or antigen-binding fragment thereof comprising at least one, two, three, four, five, or six CDRs selected from: a. CDR-H1 comprising the amino acid sequence of SEQ ID NO: 714, b. CDR-H2 comprising the amino acid sequence of SEQ ID NO: 1256, c. CDR-H3 comprising the amino acid sequence of SEQ ID NO: 1798, d. CDR-L1 comprising the amino acid sequence of SEQ ID NO: 985, e. CDR-L2 comprising the amino acid sequence of SEQ ID NO: 1527, and f. CDR-L3 comprising the amino acid sequence of SEQ ID NO: 2069.

In one aspect, the present disclosure provides an antibody or antigen-binding fragment thereof comprising a CDR-H3 comprising the amino acid sequence of SEQ ID NO: 1798, and a CDR-L3 comprising the amino acid sequence of SEQ ID NO: 2069.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 714, b. CDR-H2 comprising the amino acid sequence of SEQ ID NO: 1256, c. CDR-H3 comprising the amino acid sequence of SEQ ID NO: 1798, and a VL comprising the amino acid sequence of SEQ ID NO: 443.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 985, b. CDR-L2 comprising the amino acid sequence of SEQ ID NO: 1527, c. CDR-L3 comprising the amino acid sequence of SEQ ID NO: 2069, and a VH comprising the amino acid sequence of SEQ ID NO: 172.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 172. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 172. In some embodiments, substitutions, insertions, or deletions occur in regions outside the CDRs (e.g., in the FRs). Optionally, the antibody or antigen-binding fragment thereof comprises the VH sequence SEQ ID NO: 172, including one or more post-translational modifications of that sequence. In a particular embodiment, the VH comprises one, two or three CDRs selected from: a. CDR-H1, comprising the amino acid sequence SEQ ID NO: 714, b. CDR-H2, comprising the amino acid sequence SEQ ID NO: 1256, and c. CDR-H3, comprising the amino acid sequence SEQ ID NO: 1798.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 443. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 443. In some embodiments, the substitutions, insertions, or deletions occur in regions outside the CDRs (e.g., in the FRs). Optionally, the antibody or antigen-binding fragment thereof comprises the VL sequence SEQ ID NO: 443, including one or more post-translational modifications of that sequence. In a particular embodiment, the VL comprises one, two or three CDRs selected from: a. CDR-L1, comprising the amino acid sequence SEQ ID NO: 985, b. CDR-L2, comprising the amino acid sequence SEQ ID NO: 1527, and c. CDR-L3, comprising the amino acid sequence SEQ ID NO: 2069.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 172, and the VL amino acid sequence of SEQ ID NO: 443, optionally including post-translational modifications of those sequences.
TMEL1018

In one aspect, the present disclosure provides an antibody or antigen-binding fragment thereof comprising at least one or both variable regions selected from: a. VH comprising the amino acid sequence of SEQ ID NO: 173 and b. VL comprising the amino acid sequence of SEQ ID NO: 444.

In one aspect, the present disclosure provides an antibody or antigen-binding fragment thereof comprising at least one, two, three, four, five, or six CDRs selected from: a. CDR-H1 comprising the amino acid sequence of SEQ ID NO: 715, b. CDR-H2 comprising the amino acid sequence of SEQ ID NO: 1257, c. CDR-H3 comprising the amino acid sequence of SEQ ID NO: 1799, d. CDR-L1 comprising the amino acid sequence of SEQ ID NO: 986, e. CDR-L2 comprising the amino acid sequence of SEQ ID NO: 1528, and f. CDR-L3 comprising the amino acid sequence of SEQ ID NO: 2070.

In one aspect, the present disclosure provides an antibody or antigen-binding fragment thereof comprising a CDR-H3 comprising the amino acid sequence of SEQ ID NO: 1799, and a CDR-L3 comprising the amino acid sequence of SEQ ID NO: 2070.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 715, b. CDR-H2 comprising the amino acid sequence of SEQ ID NO: 1257, c. CDR-H3 comprising the amino acid sequence of SEQ ID NO: 1799, and a VL comprising the amino acid sequence of SEQ ID NO: 444.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 986, b. CDR-L2 comprising the amino acid sequence of SEQ ID NO: 1528, c. CDR-L3 comprising the amino acid sequence of SEQ ID NO: 2070, and a VH comprising the amino acid sequence of SEQ ID NO: 173.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 173. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 173. In some embodiments, substitutions, insertions, or deletions occur in regions outside the CDRs (e.g., in the FRs). Optionally, the antibody or antigen-binding fragment thereof comprises the VH sequence SEQ ID NO: 173, including one or more post-translational modifications of that sequence. In a particular embodiment, the VH comprises one, two or three CDRs selected from: a. CDR-H1, comprising the amino acid sequence SEQ ID NO: 715, b. CDR-H2, comprising the amino acid sequence SEQ ID NO: 1257, and c. CDR-H3, comprising the amino acid sequence SEQ ID NO: 1799.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 444. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 444. In some embodiments, the substitutions, insertions, or deletions occur in regions outside the CDRs (e.g., in the FRs). Optionally, the antibody or antigen-binding fragment thereof comprises the VL sequence SEQ ID NO: 444, including one or more post-translational modifications of that sequence. In a particular embodiment, the VL comprises one, two or three CDRs selected from: a. CDR-L1, comprising the amino acid sequence SEQ ID NO: 986, b. CDR-L2, comprising the amino acid sequence SEQ ID NO: 1528, and c. CDR-L3, comprising the amino acid sequence SEQ ID NO: 2070.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 173, and the VL amino acid sequence of SEQ ID NO: 444, optionally including post-translational modifications of those sequences.
TMEL1019

In one aspect, the present disclosure provides an antibody or antigen-binding fragment thereof comprising at least one or both variable regions selected from: a. VH comprising the amino acid sequence of SEQ ID NO: 174 and b. VL comprising the amino acid sequence of SEQ ID NO: 445.

In one aspect, the present disclosure provides an antibody or antigen-binding fragment thereof comprising at least one, two, three, four, five, or six CDRs selected from: a. CDR-H1 comprising the amino acid sequence of SEQ ID NO: 716, b. CDR-H2 comprising the amino acid sequence of SEQ ID NO: 1258, c. CDR-H3 comprising the amino acid sequence of SEQ ID NO: 1800, d. CDR-L1 comprising the amino acid sequence of SEQ ID NO: 987, e. CDR-L2 comprising the amino acid sequence of SEQ ID NO: 1529, and f. CDR-L3 comprising the amino acid sequence of SEQ ID NO: 2071.

In one aspect, the present disclosure provides an antibody or antigen-binding fragment thereof comprising a CDR-H3 comprising the amino acid sequence of SEQ ID NO: 1800, and a CDR-L3 comprising the amino acid sequence of SEQ ID NO: 2071.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 716, b. CDR-H2 comprising the amino acid sequence of SEQ ID NO: 1258, c. CDR-H3 comprising the amino acid sequence of SEQ ID NO: 1800, and a VL comprising the amino acid sequence of SEQ ID NO: 445.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 987, b. CDR-L2 comprising the amino acid sequence of SEQ ID NO: 1529, c. CDR-L3 comprising the amino acid sequence of SEQ ID NO: 2071, and a VH comprising the amino acid sequence of SEQ ID NO: 174.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 174. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 174. In some embodiments, substitutions, insertions, or deletions occur in regions outside the CDRs (e.g., in the FRs). Optionally, the antibody or antigen-binding fragment thereof comprises the VH sequence SEQ ID NO: 174, including one or more post-translational modifications of that sequence. In a particular embodiment, the VH comprises one, two or three CDRs selected from: a. CDR-H1, comprising the amino acid sequence SEQ ID NO: 716, b. CDR-H2, comprising the amino acid sequence SEQ ID NO: 1258, and c. CDR-H3, comprising the amino acid sequence SEQ ID NO: 1800.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 445. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 445. In some embodiments, the substitutions, insertions, or deletions occur in regions outside the CDRs (e.g., in the FRs). Optionally, the antibody or antigen-binding fragment thereof comprises the VL sequence SEQ ID NO: 445, including one or more post-translational modifications of that sequence. In a particular embodiment, the VL comprises one, two or three CDRs selected from: a. CDR-L1, comprising the amino acid sequence SEQ ID NO: 987, b. CDR-L2, comprising the amino acid sequence SEQ ID NO: 1529, and c. CDR-L3, comprising the amino acid sequence SEQ ID NO: 2071.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 174, and the VL amino acid sequence of SEQ ID NO: 445, optionally including post-translational modifications of those sequences.

TMEL1020

In one aspect, the present disclosure provides an antibody or antigen-binding fragment thereof comprising at least one or both variable regions selected from: a. VH comprising the amino acid sequence of SEQ ID NO: 175 and b. VL comprising the amino acid sequence of SEQ ID NO: 446.

In one aspect, the present disclosure provides an antibody or antigen-binding fragment thereof comprising at least one, two, three, four, five, or six CDRs selected from: a. CDR-H1 comprising the amino acid sequence of SEQ ID NO: 717, b. CDR-H2 comprising the amino acid sequence of SEQ ID NO: 1259, c. CDR-H3 comprising the amino acid sequence of SEQ ID NO: 1801, d. CDR-L1 comprising the amino acid sequence of SEQ ID NO: 988, e. CDR-L2 comprising the amino acid sequence of SEQ ID NO: 1530, and f. CDR-L3 comprising the amino acid sequence of SEQ ID NO: 2072.

In one aspect, the present disclosure provides an antibody or antigen-binding fragment thereof comprising a CDR-H3 comprising the amino acid sequence of SEQ ID NO: 1801, and a CDR-L3 comprising the amino acid sequence of SEQ ID NO: 2072.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 717, b. CDR-H2 comprising the amino acid sequence of SEQ ID NO: 1259, c. CDR-H3 comprising the amino acid sequence of SEQ ID NO: 1801, and a VL comprising the amino acid sequence of SEQ ID NO: 446.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 988, b. CDR-L2 comprising the amino acid sequence of SEQ ID NO: 1530, c. CDR-L3 comprising the amino acid sequence of SEQ ID NO: 2072, and a VH comprising the amino acid sequence of SEQ ID NO: 175.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 175. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 175. In some embodiments, substitutions, insertions, or deletions occur in regions outside the CDRs (e.g., in the FRs). Optionally, the antibody or antigen-binding fragment thereof comprises the VH sequence SEQ ID NO: 175, including one or more post-translational modifications of that sequence. In a particular embodiment, the VH comprises one, two or three CDRs selected from: a. CDR-H1, comprising the amino acid sequence SEQ ID NO: 717, b. CDR-H2, comprising the amino acid sequence SEQ ID NO: 1259, and c. CDR-H3, comprising the amino acid sequence SEQ ID NO: 1801.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 446. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 446. In some embodiments, the substitutions, insertions, or deletions occur in regions outside the CDRs (e.g., in the FRs). Optionally, the antibody or antigen-binding fragment thereof comprises the VL sequence SEQ ID NO: 446, including one or more post-translational modifications of that sequence. In a particular embodiment, the VL comprises one, two or three CDRs selected from: a. CDR-L1, comprising the amino acid sequence SEQ ID NO: 988, b. CDR-L2, comprising the amino acid sequence SEQ ID NO: 1530, and c. CDR-L3, comprising the amino acid sequence SEQ ID NO: 2072.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 175, and the VL amino acid sequence of SEQ ID NO: 446, optionally including post-translational modifications of those sequences.

TMEL1021

In one aspect, the present disclosure provides an antibody or antigen-binding fragment thereof comprising at least one or both variable regions selected from: a. VH comprising the amino acid sequence of SEQ ID NO: 176 and b. VL comprising the amino acid sequence of SEQ ID NO: 447.

In one aspect, the present disclosure provides an antibody or antigen-binding fragment thereof comprising at least one, two, three, four, five, or six CDRs selected from: a. CDR-H1 comprising the amino acid sequence of SEQ ID NO: 718, b. CDR-H2 comprising the amino acid sequence of SEQ ID NO: 1260, c. CDR-H3 comprising the amino acid sequence of SEQ ID NO: 1802, d. CDR-L1 comprising the amino acid sequence of SEQ ID NO: 989, e. CDR-L2 comprising the amino acid sequence of SEQ ID NO: 1531, and f. CDR-L3 comprising the amino acid sequence of SEQ ID NO: 2073.

In one aspect, the present disclosure provides an antibody or antigen-binding fragment thereof comprising a CDR-H3 comprising the amino acid sequence of SEQ ID NO: 1802, and a CDR-L3 comprising the amino acid sequence of SEQ ID NO: 2073.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 718, b. CDR-H2 comprising the amino acid sequence of SEQ ID NO: 1260, c. CDR-H3 comprising the amino acid sequence of SEQ ID NO: 1802, and a VL comprising the amino acid sequence of SEQ ID NO: 447.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 989, b. CDR-L2 comprising the amino acid sequence of SEQ ID NO: 1531, c. CDR-L3 comprising the amino acid sequence of SEQ ID NO: 2073, and a VH comprising the amino acid sequence of SEQ ID NO: 176.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 176. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 176. In some embodiments, substitutions, insertions, or deletions occur in regions outside the CDRs (e.g., in the FRs). Optionally, the antibody or antigen-binding fragment thereof comprises the VH sequence SEQ ID NO: 176, including one or more post-translational modifications of that sequence. In a particular embodiment, the VH comprises one, two or three CDRs selected from: a. CDR-H1, comprising the amino acid sequence SEQ ID NO: 718, b. CDR-H2, comprising the amino acid sequence SEQ ID NO: 1260, and c. CDR-H3, comprising the amino acid sequence SEQ ID NO: 1802.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 447. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 447. In some embodiments, the substitutions, insertions, or deletions occur in regions outside the CDRs (e.g., in the FRs). Optionally, the antibody or antigen-binding fragment thereof comprises the VL sequence SEQ ID NO: 447, including one or more post-translational modifications of that sequence. In a particular embodiment, the VL comprises one, two or three CDRs selected from: a. CDR-L1, comprising the amino acid sequence SEQ ID NO: 989, b. CDR-L2, comprising the amino acid sequence SEQ ID NO: 1531, and c. CDR-L3, comprising the amino acid sequence SEQ ID NO: 2073.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 176, and the VL amino acid sequence of SEQ ID NO: 447, optionally including post-translational modifications of those sequences.

TMEL1022

In one aspect, the present disclosure provides an antibody or antigen-binding fragment thereof comprising at least one or both variable regions selected from: a. VH comprising the amino acid sequence of SEQ ID NO: 177 and b. VL comprising the amino acid sequence of SEQ ID NO: 448.

In one aspect, the present disclosure provides an antibody or antigen-binding fragment thereof comprising at least one, two, three, four, five, or six CDRs selected from: a. CDR-H1 comprising the amino acid sequence of SEQ ID NO: 719, b. CDR-H2 comprising the amino acid sequence of SEQ ID NO: 1261, c. CDR-H3 comprising the amino acid sequence of SEQ ID NO: 1803, d. CDR-L1 comprising the amino acid sequence of SEQ ID NO: 990, e. CDR-L2 comprising the amino acid sequence of SEQ ID NO: 1532, and f. CDR-L3 comprising the amino acid sequence of SEQ ID NO: 2074.

In one aspect, the present disclosure provides an antibody or antigen-binding fragment thereof comprising a CDR-H3 comprising the amino acid sequence of SEQ ID NO: 1803, and a CDR-L3 comprising the amino acid sequence of SEQ ID NO: 2074.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 719, b. CDR-H2 comprising the amino acid sequence of SEQ ID NO: 1261, c. CDR-H3 comprising the amino acid sequence of SEQ ID NO: 1803, and a VL comprising the amino acid sequence of SEQ ID NO: 448.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 990, b. CDR-L2 comprising the amino acid sequence of SEQ ID NO: 1532, c. CDR-L3 comprising the amino acid sequence of SEQ ID NO: 2074, and a VH comprising the amino acid sequence of SEQ ID NO: 177.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 177. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 177. In some embodiments, substitutions, insertions, or deletions occur in regions outside the CDRs (e.g., in the FRs). Optionally, the antibody or antigen-binding fragment thereof comprises the VH sequence SEQ ID NO: 177, including one or more post-translational modifications of that sequence. In a particular embodiment, the VH comprises one, two or three CDRs selected from: a. CDR-H1, comprising the amino acid sequence SEQ ID NO: 719, b. CDR-H2, comprising the amino acid sequence SEQ ID NO: 1261, and c. CDR-H3, comprising the amino acid sequence SEQ ID NO: 1803.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 448. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 448. In some embodiments, the substitutions, insertions, or deletions occur in regions outside the CDRs (e.g., in the FRs). Optionally, the antibody or antigen-binding fragment thereof comprises the VL sequence SEQ ID NO: 448, including one or more post-translational modifications of that sequence. In a particular embodiment, the VL comprises one, two or three CDRs selected from: a. CDR-L1, comprising the amino acid sequence SEQ ID NO: 990, b. CDR-L2, comprising the amino acid sequence SEQ ID NO: 1532, and c. CDR-L3, comprising the amino acid sequence SEQ ID NO: 2074.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 177, and the VL amino acid sequence of SEQ ID NO: 448, optionally including post-translational modifications of those sequences.

TMEL1023

In one aspect, the present disclosure provides an antibody or antigen-binding fragment thereof comprising at least one or both variable regions selected from: a. VH comprising the amino acid sequence of SEQ ID NO: 178 and b. VL comprising the amino acid sequence of SEQ ID NO: 449.

In one aspect, the present disclosure provides an antibody or antigen-binding fragment thereof comprising at least one, two, three, four, five, or six CDRs selected from: a. CDR-H1 comprising the amino acid sequence of SEQ ID NO: 720, b CDR-H2 comprising the amino acid sequence of SEQ ID NO: 1262, c. CDR-H3 comprising the amino acid sequence of SEQ ID NO: 1804, d. CDR-L1 comprising the amino acid sequence of SEQ ID NO: 991, e. CDR-L2 comprising the amino acid sequence of SEQ ID NO: 1533, and f. CDR-L3 comprising the amino acid sequence of SEQ ID NO: 2075.

In one aspect, the present disclosure provides an antibody or antigen-binding fragment thereof comprising a CDR-H3 comprising the amino acid sequence of SEQ ID NO: 1804, and a CDR-L3 comprising the amino acid sequence of SEQ ID NO: 2075.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 720, b. CDR-H2 comprising the amino acid sequence of SEQ ID NO: 1262, c. CDR-H3 comprising the amino acid sequence of SEQ ID NO: 1804, and a VL comprising the amino acid sequence of SEQ ID NO: 449.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 991, b. CDR-L2 comprising the amino acid sequence of SEQ ID NO: 1533, c. CDR-L3 comprising the amino acid sequence of SEQ ID NO: 2075, and a VH comprising the amino acid sequence of SEQ ID NO: 178.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 178. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 178. In some embodiments, substitutions, insertions, or deletions occur in regions outside the CDRs (e.g., in the FRs). Optionally, the antibody or antigen-binding fragment thereof comprises the VH sequence SEQ ID NO: 178, including one or more post-translational modifications of that sequence. In a particular embodiment, the VH comprises one, two or three CDRs selected from: a. CDR-H1, comprising the amino acid sequence SEQ ID NO: 720, b. CDR-H2, comprising the amino acid sequence SEQ ID NO: 1262, and c. CDR-H3, comprising the amino acid sequence SEQ ID NO: 1804.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 449. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 449. In some embodiments, the substitutions, insertions, or deletions occur in regions outside the CDRs (e.g., in the FRs). Optionally, the antibody or antigen-binding fragment thereof comprises the VL sequence SEQ ID NO: 449, including one or more post-translational modifications of that sequence. In a particular embodiment, the VL comprises one, two or three CDRs selected from: a. CDR-L1, comprising the amino acid sequence SEQ ID NO: 991, b. CDR-L2, comprising the amino acid sequence SEQ ID NO: 1533, and c. CDR-L3, comprising the amino acid sequence SEQ ID NO: 2075.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 178, and the VL amino acid sequence of SEQ ID NO: 449, optionally including post-translational modifications of those sequences.

TMEL1024

In one aspect, the present disclosure provides an antibody or antigen-binding fragment thereof comprising at least one or both variable regions selected from: a. VH comprising the amino acid sequence of SEQ ID NO: 179 and b. VL comprising the amino acid sequence of SEQ ID NO: 450.

In one aspect, the present disclosure provides an antibody or antigen-binding fragment thereof comprising at least one, two, three, four, five, or six CDRs selected from: a. CDR-H1 comprising the amino acid sequence of SEQ ID NO: 721, b. CDR-H2 comprising the amino acid sequence of SEQ ID NO: 1263, c. CDR-H3 comprising the amino acid sequence of SEQ ID NO: 1805, d. CDR-L1 comprising the amino acid sequence of SEQ ID NO: 992, e. CDR-L2 comprising the amino acid sequence of SEQ ID NO: 1534, and f. CDR-L3 comprising the amino acid sequence of SEQ ID NO: 2076.

In one aspect, the present disclosure provides an antibody or antigen-binding fragment thereof comprising a CDR-H3 comprising the amino acid sequence of SEQ ID NO: 1805, and a CDR-L3 comprising the amino acid sequence of SEQ ID NO: 2076.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 721, b. CDR-H2 comprising the amino acid sequence of SEQ ID NO: 1263, c. CDR-H3 comprising the amino acid sequence of SEQ ID NO: 1805, and a VL comprising the amino acid sequence of SEQ ID NO: 450.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 992, b. CDR-L2 comprising the amino acid sequence of SEQ ID NO: 1534, c. CDR-L3 comprising the amino acid sequence of SEQ ID NO: 2076, and a VH comprising the amino acid sequence of SEQ ID NO: 179.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 179. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 179. In some embodiments, substitutions, insertions, or deletions occur in regions outside the CDRs (e.g., in the FRs). Optionally, the antibody or antigen-binding fragment thereof comprises the VH sequence SEQ ID NO: 179, including one or more post-translational modifications of that sequence. In a particular embodiment, the VH comprises one, two or three CDRs selected from: a. CDR-H1, comprising the amino acid sequence SEQ ID NO: 721, b. CDR-H2, comprising the amino acid sequence SEQ ID NO: 1263, and c. CDR-H3, comprising the amino acid sequence SEQ ID NO: 1805.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 450. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 450. In some embodiments, the substitutions, insertions, or deletions occur in regions outside the CDRs (e.g., in the FRs). Optionally, the antibody or antigen-binding fragment thereof comprises the VL sequence SEQ ID NO: 450, including one or more post-translational modifications of that sequence. In a particular embodiment, the VL comprises one, two or three CDRs selected from: a. CDR-L1, comprising the amino acid sequence SEQ ID NO: 992, b. CDR-L2, comprising the amino acid sequence SEQ ID NO: 1534, and c. CDR-L3, comprising the amino acid sequence SEQ ID NO: 2076.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 179, and the VL amino acid sequence of SEQ ID NO: 450, optionally including post-translational modifications of those sequences.
TMEL1025

In one aspect, the present disclosure provides an antibody or antigen-binding fragment thereof comprising at least one or both variable regions selected from: a. VH comprising the amino acid sequence of SEQ ID NO: 180 and b. VL comprising the amino acid sequence of SEQ ID NO: 451.

In one aspect, the present disclosure provides an antibody or antigen-binding fragment thereof comprising at least one, two, three, four, five, or six CDRs selected from: a. CDR-H1 comprising the amino acid sequence of SEQ ID NO: 722, b. CDR-H2 comprising the amino acid sequence of SEQ ID NO: 1264, c. CDR-H3 comprising the amino acid sequence of SEQ ID NO: 1806, d. CDR-L1 comprising the amino acid sequence of SEQ ID NO: 993, e. CDR-L2 comprising the amino acid sequence of SEQ ID NO: 1535, and f. CDR-L3 comprising the amino acid sequence of SEQ ID NO: 2077.

In one aspect, the present disclosure provides an antibody or antigen-binding fragment thereof comprising a CDR-H3 comprising the amino acid sequence of SEQ ID NO: 1806, and a CDR-L3 comprising the amino acid sequence of SEQ ID NO: 2077.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 722, b. CDR-H2 comprising the amino acid sequence of SEQ ID NO: 1264, c. CDR-H3 comprising the amino acid sequence of SEQ ID NO: 1806, and a VL comprising the amino acid sequence of SEQ ID NO: 451.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 993, b. CDR-L2 comprising the amino acid sequence of SEQ ID NO: 1535, c. CDR-L3 comprising the amino acid sequence of SEQ ID NO: 2077, and a VH comprising the amino acid sequence of SEQ ID NO: 180.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 180. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 180. In some embodiments, substitutions, insertions, or deletions occur in regions outside the CDRs (e.g., in the FRs). Optionally, the antibody or antigen-binding fragment thereof comprises the VH sequence SEQ ID NO: 180, including one or more post-translational modifications of that sequence. In a particular embodiment, the VH comprises one, two or three CDRs selected from: a. CDR-H1, comprising the amino acid sequence SEQ ID NO: 722, b. CDR-H2, comprising the amino acid sequence SEQ ID NO: 1264, and c. CDR-H3, comprising the amino acid sequence SEQ ID NO: 1806.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 451. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 451. In some embodiments, the substitutions, insertions, or deletions occur in regions outside the CDRs (e.g., in the FRs). Optionally, the antibody or antigen-binding fragment thereof comprises the VL sequence SEQ ID NO: 451, including one or more post-translational modifications of that sequence. In a particular embodiment, the VL comprises one, two or three CDRs selected from: a. CDR-L1, comprising the amino acid sequence SEQ ID NO: 993, b. CDR-L2, comprising the amino acid sequence SEQ ID NO: 1535, and c. CDR-L3, comprising the amino acid sequence SEQ ID NO: 2077.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 180, and the VL amino acid sequence of SEQ ID NO: 451, optionally including post-translational modifications of those sequences.

TMEL1026

In one aspect, the present disclosure provides an antibody or antigen-binding fragment thereof comprising at least one or both variable regions selected from: a. VH comprising the amino acid sequence of SEQ ID NO: 181 and b. VL comprising the amino acid sequence of SEQ ID NO: 452.

In one aspect, the present disclosure provides an antibody or antigen-binding fragment thereof comprising at least one, two, three, four, five, or six CDRs selected from: a. CDR-H1 comprising the amino acid sequence of SEQ ID NO: 723, b. CDR-H2 comprising the amino acid sequence of SEQ ID NO: 1265, c. CDR-H3 comprising the amino acid sequence of SEQ ID NO: 1807, d. CDR-L1 comprising the amino acid sequence of SEQ ID NO: 994, e. CDR-L2 comprising the amino acid sequence of SEQ ID NO: 1536, and f. CDR-L3 comprising the amino acid sequence of SEQ ID NO: 2078.

In one aspect, the present disclosure provides an antibody or antigen-binding fragment thereof comprising a CDR-H3 comprising the amino acid sequence of SEQ ID NO: 1807, and a CDR-L3 comprising the amino acid sequence of SEQ ID NO: 2078.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 723, b. CDR-H2 comprising the amino acid sequence of SEQ ID NO: 1265, c CDR-H3 comprising the amino acid sequence of SEQ ID NO: 1807, and a VL comprising the amino acid sequence of SEQ ID NO: 452.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 994, b. CDR-L2 comprising the amino acid sequence of SEQ ID NO: 1536, c. CDR-L3 comprising the amino acid sequence of SEQ ID NO: 2078, and a VH comprising the amino acid sequence of SEQ ID NO: 181.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 181. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 181. In some embodiments, substitutions, insertions, or deletions occur in regions outside the CDRs (e.g., in the FRs). Optionally, the antibody or antigen-binding fragment thereof comprises the VH sequence SEQ ID NO: 181, including one or more post-translational modifications of that sequence. In a particular embodiment, the VH comprises one, two or three CDRs selected from: a. CDR-H1, comprising the amino acid sequence SEQ ID NO: 723, b. CDR-H2, comprising the amino acid sequence SEQ ID NO: 1265, and c. CDR-H3, comprising the amino acid sequence SEQ ID NO: 1807.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 452. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 452. In some embodiments, the substitutions, insertions, or deletions occur in regions outside the CDRs (e.g., in the FRs). Optionally, the antibody or antigen-binding fragment thereof comprises the VL sequence SEQ ID NO: 452, including one or more post-translational modifications of that sequence. In a particular embodiment, the VL comprises one, two or three CDRs selected from: a. CDR-L1, comprising the amino acid sequence SEQ ID NO: 994, b. CDR-L2, comprising the amino acid sequence SEQ ID NO: 1536, and CDR-L3, comprising the amino acid sequence SEQ ID NO: 2078.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 181, and the VL amino acid sequence of SEQ ID NO: 452, optionally including post-translational modifications of those sequences.

TMEL1027

In one aspect, the present disclosure provides an antibody or antigen-binding fragment thereof comprising at least one or both variable regions selected from: a. VH comprising the amino acid sequence of SEQ ID NO: 182 and b. VL comprising the amino acid sequence of SEQ ID NO: 453.

In one aspect, the present disclosure provides an antibody or antigen-binding fragment thereof comprising at least one, two, three, four, five, or six CDRs selected from: a. CDR-H1 comprising the amino acid sequence of SEQ ID NO: 724, b. CDR-H2 comprising the amino acid sequence of SEQ ID NO: 1266, c. CDR-H3 comprising the amino acid sequence of SEQ ID NO: 1808, d. CDR-L1 comprising the amino acid sequence of SEQ ID NO: 995, e. CDR-L2 comprising the amino acid sequence of SEQ ID NO: 1537, and f. CDR-L3 comprising the amino acid sequence of SEQ ID NO: 2079.

In one aspect, the present disclosure provides an antibody or antigen-binding fragment thereof comprising a CDR-H3 comprising the amino acid sequence of SEQ ID NO: 1808, and a CDR-L3 comprising the amino acid sequence of SEQ ID NO: 2079.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 724, b. CDR-H2 comprising the amino acid sequence of SEQ ID NO: 1266, c. CDR-H3 comprising the amino acid sequence of SEQ ID NO: 1808, and a VL comprising the amino acid sequence of SEQ ID NO: 453.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 995, b. CDR-L2 comprising the amino acid sequence of SEQ ID NO: 1537, c. CDR-L3 comprising the amino acid sequence of SEQ ID NO: 2079, and a VH comprising the amino acid sequence of SEQ ID NO: 182.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 182. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 182. In some embodiments, substitutions, insertions, or deletions occur in regions outside the CDRs (e.g., in the FRs). Optionally, the antibody or antigen-binding fragment thereof comprises the VH sequence SEQ ID NO: 182, including one or more post-translational modifications of that sequence. In a particular embodiment, the VH comprises one, two or three CDRs selected from: a. CDR-H1, comprising the amino acid sequence SEQ ID NO: 724, b. CDR-H2, comprising the amino acid sequence SEQ ID NO: 1266, and c. CDR-H3, comprising the amino acid sequence SEQ ID NO: 1808.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 453. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 453. In some embodiments, the substitutions, insertions, or deletions occur in regions outside the CDRs (e.g., in the FRs). Optionally, the antibody or antigen-binding fragment thereof comprises the VL sequence SEQ ID NO: 453, including one or more post-translational modifications of that sequence. In a particular embodiment, the VL comprises one, two or three CDRs selected from: a. CDR-L1, comprising the amino acid sequence SEQ ID NO: 995, b. CDR-L2, comprising the amino acid sequence SEQ ID NO: 1537, and c. CDR-L3, comprising the amino acid sequence SEQ ID NO: 2079.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 182, and the VL amino acid sequence of SEQ ID NO: 453, optionally including post-translational modifications of those sequences.
TMEL1028

In one aspect, the present disclosure provides an antibody or antigen-binding fragment thereof comprising at least one or both variable regions selected from: a. VH comprising the amino acid sequence of SEQ ID NO: 183 and b. VL comprising the amino acid sequence of SEQ ID NO: 454.

In one aspect, the present disclosure provides an antibody or antigen-binding fragment thereof comprising at least one, two, three, four, five, or six CDRs selected from: a. CDR-H1 comprising the amino acid sequence of SEQ ID NO: 725, b. CDR-H2 comprising the amino acid sequence of SEQ ID NO: 1267, c. CDR-H3 comprising the amino acid sequence of SEQ ID NO: 1809, d. CDR-L1 comprising the amino acid sequence of SEQ ID NO: 996, e. CDR-L2 comprising the amino acid sequence of SEQ ID NO: 1538, and f. CDR-L3 comprising the amino acid sequence of SEQ ID NO: 2080.

In one aspect, the present disclosure provides an antibody or antigen-binding fragment thereof comprising a CDR-H3 comprising the amino acid sequence of SEQ ID NO: 1809, and a CDR-L3 comprising the amino acid sequence of SEQ ID NO: 2080.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 725, b. CDR-H2 comprising the amino acid sequence of SEQ ID NO: 1267, c. CDR-H3 comprising the amino acid sequence of SEQ ID NO: 1809, and a VL comprising the amino acid sequence of SEQ ID NO: 454.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 996, b. CDR-L2 comprising the amino acid sequence of SEQ ID NO: 1538, c. CDR-L3 comprising the amino acid sequence of SEQ ID NO: 2080, and a VH comprising the amino acid sequence of SEQ ID NO: 183.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 183. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 183. In some embodiments, substitutions, insertions, or deletions occur in regions outside the CDRs (e.g., in the FRs). Optionally, the antibody or antigen-binding fragment thereof comprises the VH sequence SEQ ID NO: 183, including one or more post-translational modifications of that sequence. In a particular embodiment, the VH comprises one, two or three CDRs selected from: a. CDR-H1, comprising the amino acid sequence SEQ ID NO: 725, b. CDR-H2, comprising the amino acid sequence SEQ ID NO: 1267, and c. CDR-H3, comprising the amino acid sequence SEQ ID NO: 1809.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 454. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 454. In some embodiments, the substitutions, insertions, or deletions occur in regions outside the CDRs (e.g., in the FRs). Optionally, the antibody or antigen-binding fragment thereof comprises the VL sequence SEQ ID NO: 454, including one or more post-translational modifications of that sequence. In a particular embodiment, the VL comprises one, two or three CDRs selected from: a. CDR-L1, comprising the amino acid sequence SEQ ID NO: 996, b. CDR-L2, comprising the amino acid sequence SEQ ID NO: 1538, and c. CDR-L3, comprising the amino acid sequence SEQ ID NO: 2080.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 183, and the VL amino acid sequence of SEQ ID NO: 454, optionally including post-translational modifications of those sequences.

TMEL1029

In one aspect, the present disclosure provides an antibody or antigen-binding fragment thereof comprising at least one or both variable regions selected from: a. VH comprising the amino acid sequence of SEQ ID NO: 184 and b. VL comprising the amino acid sequence of SEQ ID NO: 455.

In one aspect, the present disclosure provides an antibody or antigen-binding fragment thereof comprising at least one, two, three, four, five, or six CDRs selected from: a. CDR-H1 comprising the amino acid sequence of SEQ ID NO: 726, b. CDR-H2 comprising the amino acid sequence of SEQ ID NO: 1268, c. CDR-H3 comprising the amino acid sequence of SEQ ID NO: 1810, d. CDR-L1 comprising the amino acid sequence of SEQ ID NO: 997, e. CDR-L2 comprising the amino acid sequence of SEQ ID NO: 1539, and f. CDR-L3 comprising the amino acid sequence of SEQ ID NO: 2081.

In one aspect, the present disclosure provides an antibody or antigen-binding fragment thereof comprising a CDR-H3 comprising the amino acid sequence of SEQ ID NO: 1810, and a CDR-L3 comprising the amino acid sequence of SEQ ID NO: 2081.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 726, b. CDR-H2 comprising the amino acid sequence of SEQ ID NO: 1268, c. CDR-H3 comprising the amino acid sequence of SEQ ID NO: 1810, and a VL comprising the amino acid sequence of SEQ ID NO: 455.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 997, b. CDR-L2 comprising the amino acid sequence of SEQ ID NO: 1539, c. CDR-L3 comprising the amino acid sequence of SEQ ID NO: 2081, and a VH comprising the amino acid sequence of SEQ ID NO: 184.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 184. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 184. In some embodiments, substitutions, insertions, or deletions occur in regions outside the CDRs (e.g., in the FRs). Optionally, the antibody or antigen-binding fragment thereof comprises the VH sequence SEQ ID NO: 184, including one or more post-translational modifications of that sequence. In a particular embodiment, the VH comprises one, two or three CDRs selected from: a. CDR-H1, comprising the amino acid sequence SEQ ID NO: 726, b. CDR-H2, comprising the amino acid sequence SEQ ID NO: 1268, and c. CDR-H3, comprising the amino acid sequence SEQ ID NO: 1810.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 455. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 455. In some embodiments, the substitutions, insertions, or deletions occur in regions outside the CDRs (e.g., in the FRs). Optionally, the antibody or antigen-binding fragment thereof comprises the VL sequence SEQ ID NO: 455, including one or more post-translational modifications of that sequence. In a particular embodiment, the VL comprises one, two or three CDRs selected from: a. CDR-L1, comprising the amino acid sequence SEQ ID NO: 997, b. CDR-L2, comprising the amino acid sequence SEQ ID NO: 1539, and c. CDR-L3, comprising the amino acid sequence SEQ ID NO: 2081.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 184, and the VL amino acid sequence of SEQ ID NO: 455, optionally including post-translational modifications of those sequences.

TMEL1030

In one aspect, the present disclosure provides an antibody or antigen-binding fragment thereof comprising at least one or both variable regions selected from: a. VH comprising the amino acid sequence of SEQ ID NO: 185 and b. VL comprising the amino acid sequence of SEQ ID NO: 456.

In one aspect, the present disclosure provides an antibody or antigen-binding fragment thereof comprising at least one, two, three, four, five, or six CDRs selected from: a. CDR-H1 comprising the amino acid sequence of SEQ ID NO: 727, b. CDR-H2 comprising the amino acid sequence of SEQ ID NO: 1269, c. CDR-H3 comprising the amino acid sequence of SEQ ID NO: 1811, d. CDR-L1 comprising the amino acid sequence of SEQ ID NO: 998, e. CDR-L2 comprising the amino acid sequence of SEQ ID NO: 1540, and f. CDR-L3 comprising the amino acid sequence of SEQ ID NO: 2082.

In one aspect, the present disclosure provides an antibody or antigen-binding fragment thereof comprising a CDR-H3 comprising the amino acid sequence of SEQ ID NO: 1811, and a CDR-L3 comprising the amino acid sequence of SEQ ID NO: 2082.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 727, b. CDR-H2 comprising the amino acid sequence of SEQ ID NO: 1269, c. CDR-H3 comprising the amino acid sequence of SEQ ID NO: 1811, and a VL comprising the amino acid sequence of SEQ ID NO: 456.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 998, b. CDR-L2 comprising the amino acid sequence of SEQ ID NO: 1540, c. CDR-L3 comprising the amino acid sequence of SEQ ID NO: 2082, and a VH comprising the amino acid sequence of SEQ ID NO: 185.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 185. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 185. In some embodiments, substitutions, insertions, or deletions occur in regions outside the CDRs (e.g., in the FRs). Optionally, the antibody or antigen-binding fragment thereof comprises the VH sequence SEQ ID NO: 185, including one or more post-translational modifications of that sequence. In a particular embodiment, the VH comprises one, two or three CDRs selected from: a. CDR-H1, comprising the amino acid sequence SEQ ID NO: 727, b. CDR-H2, comprising the amino acid sequence SEQ ID NO: 1269, and c. CDR-H3, comprising the amino acid sequence SEQ ID NO: 1811.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 456. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 456. In some embodiments, the substitutions, insertions, or deletions occur in regions outside the CDRs (e.g., in the FRs). Optionally, the antibody or antigen-binding fragment thereof comprises the VL sequence SEQ ID NO: 456, including one or more post-translational modifications of that sequence. In a particular embodiment, the VL comprises one, two or three CDRs selected from: a. CDR-L1, comprising the amino acid sequence SEQ ID NO: 998, b. CDR-L2, comprising the amino acid sequence SEQ ID NO: 1540, and c. CDR-L3, comprising the amino acid sequence SEQ ID NO: 2082.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 185, and the VL amino acid sequence of SEQ ID NO: 456, optionally including post-translational modifications of those sequences.

TMEL1031

In one aspect, the present disclosure provides an antibody or antigen-binding fragment thereof comprising at least one or both variable regions selected from: a. VH comprising the amino acid sequence of SEQ ID NO: 186 and b. VL comprising the amino acid sequence of SEQ ID NO: 457.

In one aspect, the present disclosure provides an antibody or antigen-binding fragment thereof comprising at least one, two, three, four, five, or six CDRs selected from: a. CDR-H1 comprising the amino acid sequence of SEQ ID NO: 728, b. CDR-H2 comprising the amino acid sequence of SEQ ID NO: 1270, c. CDR-H3 comprising the amino acid sequence of SEQ ID NO: 1812, d. CDR-L1 comprising the amino acid sequence of SEQ ID NO: 999, e. CDR-L2 comprising the amino acid sequence of SEQ ID NO: 1541, and f. CDR-L3 comprising the amino acid sequence of SEQ ID NO: 2083.

In one aspect, the present disclosure provides an antibody or antigen-binding fragment thereof comprising a CDR-H3 comprising the amino acid sequence of SEQ ID NO: 1812, and a CDR-L3 comprising the amino acid sequence of SEQ ID NO: 2083.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 728, b. CDR-H2 comprising the amino acid sequence of SEQ ID NO: 1270, c. CDR-H3 comprising the amino acid sequence of SEQ ID NO: 1812, and a VL comprising the amino acid sequence of SEQ ID NO: 457.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 999, b. CDR-L2 comprising the amino acid sequence of SEQ ID NO: 1541, c. CDR-L3 comprising the amino acid sequence of SEQ ID NO: 2083, and a VH comprising the amino acid sequence of SEQ ID NO: 186.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 186. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 186. In some embodiments, substitutions, insertions, or deletions occur in regions outside the CDRs (e.g., in the FRs). Optionally, the antibody or antigen-binding fragment thereof comprises the VH sequence SEQ ID NO: 186, including one or more post-translational modifications of that sequence. In a particular embodiment, the VH comprises one, two or three CDRs selected from: a. CDR-H1, comprising the amino acid sequence SEQ ID NO: 728, b. CDR-H2, comprising the amino acid sequence SEQ ID NO: 1270, and c. CDR-H3, comprising the amino acid sequence SEQ ID NO: 1812.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 457. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 457. In some embodiments, the substitutions, insertions, or deletions occur in regions outside the CDRs (e.g., in the FRs). Optionally, the antibody or antigen-binding fragment thereof comprises the VL sequence SEQ ID NO: 457, including one or more post-translational modifications of that sequence. In a particular embodiment, the VL comprises one, two or three CDRs selected from: a. CDR-L1, comprising the amino acid sequence SEQ ID NO: 999, b. CDR-L2, comprising the amino acid sequence SEQ ID NO: 1541, and c. CDR-L3, comprising the amino acid sequence SEQ ID NO: 2083.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 186, and the VL amino acid sequence of SEQ ID NO: 457, optionally including post-translational modifications of those sequences.

TMEL1032

In one aspect, the present disclosure provides an antibody or antigen-binding fragment thereof comprising at least one or both variable regions selected from: a. VH comprising the amino acid sequence of SEQ ID NO: 187 and b. VL comprising the amino acid sequence of SEQ ID NO: 458.

In one aspect, the present disclosure provides an antibody or antigen-binding fragment thereof comprising at least one, two, three, four, five, or six CDRs selected from: a. CDR-H1 comprising the amino acid sequence of SEQ ID NO: 729, b. CDR-H2 comprising the amino acid sequence of SEQ ID NO: 1271, c. CDR-H3 comprising the amino acid sequence of SEQ ID NO: 1813, d. CDR-L1 comprising the amino acid sequence of SEQ ID NO: 1000, e. CDR-L2 comprising the amino acid sequence of SEQ ID NO: 1542, and f. CDR-L3 comprising the amino acid sequence of SEQ ID NO: 2084.

In one aspect, the present disclosure provides an antibody or antigen-binding fragment thereof comprising a CDR-H3 comprising the amino acid sequence of SEQ ID NO: 1813, d. CDR-L1 comprising the amino acid sequence of SEQ ID NO: 1000 and a CDR-L3 comprising the amino acid sequence of SEQ ID NO: 2084.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 729, b. CDR-H2 comprising the amino acid sequence of SEQ ID NO: 1271, c. CDR-H3 comprising the amino acid sequence of SEQ ID NO: 1813, and a VL comprising the amino acid sequence of SEQ ID NO: 458.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1000, b. CDR-L2 comprising the amino acid sequence of SEQ ID NO: 1542, c. CDR-L3 comprising the amino acid sequence of SEQ ID NO: 2084, and a VH comprising the amino acid sequence of SEQ ID NO: 187.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 187. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 187. In some embodiments, substitutions, insertions, or deletions occur in regions outside the CDRs (e.g., in the FRs). Optionally, the antibody or antigen-binding fragment thereof comprises the VH sequence SEQ ID NO: 187, including one or more post-translational modifications of that sequence. In a particular embodiment, the VH comprises one, two or three CDRs selected from: a. CDR-H1, comprising the amino acid sequence SEQ ID NO: 729, b. CDR-H2, comprising the amino acid sequence SEQ ID NO: 1271, and c. CDR-H3, comprising the amino acid sequence SEQ ID NO: 1813.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 458. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 458. In some embodiments, the substitutions, insertions, or deletions occur in regions outside the CDRs (e.g., in the FRs). Optionally, the antibody or antigen-binding fragment thereof comprises the VL sequence SEQ ID NO: 458, including one or more post-translational modifications of that sequence. In a particular embodiment, the VL comprises one, two or three CDRs selected from: a. CDR-L1, comprising the amino acid sequence SEQ ID NO: 1000, b. CDR-L2, comprising the amino acid sequence SEQ ID NO: 1542, and c. CDR-L3, comprising the amino acid sequence SEQ ID NO: 2084.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 187, and the VL amino acid sequence of SEQ ID NO: 458, optionally including post-translational modifications of those sequences.

TMEL1033

In one aspect, the present disclosure provides an antibody or antigen-binding fragment thereof comprising at least one or both variable regions selected from: a. VH comprising the amino acid sequence of SEQ ID NO: 188 and b. VL comprising the amino acid sequence of SEQ ID NO: 459.

In one aspect, the present disclosure provides an antibody or antigen-binding fragment thereof comprising at least one, two, three, four, five, or six CDRs selected from: a. CDR-H1 comprising the amino acid sequence of SEQ ID NO: 730, b. CDR-H2 comprising the amino acid sequence of SEQ ID NO: 1272, c. CDR-H3 comprising the amino acid sequence of SEQ ID NO: 1814, d. CDR-L1 comprising the amino acid sequence of SEQ ID NO: 1001, e. CDR-L2 comprising the amino acid sequence of SEQ ID NO: 1543, and f. CDR-L3 comprising the amino acid sequence of SEQ ID NO: 2085.

In one aspect, the present disclosure provides an antibody or antigen-binding fragment thereof comprising a CDR-H3 comprising the amino acid sequence of SEQ ID NO: 1814, and a CDR-L3 comprising the amino acid sequence of SEQ ID NO: 2085.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 730, b. CDR-H2 comprising the amino acid sequence of SEQ ID NO: 1272, c. CDR-H3 comprising the amino acid sequence of SEQ ID NO: 1814, and a VL comprising the amino acid sequence of SEQ ID NO: 459.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1001, b. CDR-L2 comprising the amino acid sequence of SEQ ID NO: 1543, c. CDR-L3 comprising the amino acid sequence of SEQ ID NO: 2085, and a VH comprising the amino acid sequence of SEQ ID NO: 188.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 188. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 188. In some embodiments, substitutions, insertions, or deletions occur in regions outside the CDRs (e.g., in the FRs). Optionally, the antibody or antigen-binding fragment thereof comprises the VH sequence SEQ ID NO: 188, including one or more post-translational modifications of that sequence. In a particular embodiment, the VH comprises one, two or three CDRs selected from: a. CDR-H1, comprising the amino acid sequence SEQ ID NO: 730, b. CDR-H2, comprising the amino acid sequence SEQ ID NO: 1272, and c. CDR-H3, comprising the amino acid sequence SEQ ID NO: 1814.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 459. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 459. In some embodiments, the substitutions, insertions, or deletions occur in regions outside the CDRs (e.g., in the FRs). Optionally, the antibody or antigen-binding fragment thereof comprises the VL sequence SEQ ID NO: 459, including one or more post-translational modifications of that sequence. In a particular embodiment, the VL comprises one, two or three CDRs selected from: a. CDR-L1, comprising the amino acid sequence SEQ ID NO: 1001, b. CDR-L2, comprising the amino acid sequence SEQ ID NO: 1543, and c. CDR-L3, comprising the amino acid sequence SEQ ID NO: 2085.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 188, and the VL amino acid sequence of SEQ ID NO: 459, optionally including post-translational modifications of those sequences.

TMEL1034

In one aspect, the present disclosure provides an antibody or antigen-binding fragment thereof comprising at least one or both variable regions selected from: a. VH comprising the amino acid sequence of SEQ ID NO: 189 and b. VL comprising the amino acid sequence of SEQ ID NO: 460.

In one aspect, the present disclosure provides an antibody or antigen-binding fragment thereof comprising at least one, two, three, four, five, or six CDRs selected from: a. CDR-H1 comprising the amino acid sequence of SEQ ID NO: 731, b. CDR-H2 comprising the amino acid sequence of SEQ ID NO: 1273, c. CDR-H3 comprising the amino acid sequence of SEQ ID NO: 1815, d. CDR-L1 comprising the amino acid sequence of SEQ ID NO: 1002, e. CDR-L2 comprising the amino acid sequence of SEQ ID NO: 1544, and f. CDR-L3 comprising the amino acid sequence of SEQ ID NO: 2086.

In one aspect, the present disclosure provides an antibody or antigen-binding fragment thereof comprising a CDR-H3 comprising the amino acid sequence of SEQ ID NO: 1815, and a CDR-L3 comprising the amino acid sequence of SEQ ID NO: 2086.

In one aspect, the present disclosure provides an antibody or antigen-binding fragment thereof comprising at least one, at least two, or all three VH CDR sequences selected from:

a. CDR-H1 comprising the amino acid sequence of SEQ ID NO: 731, b. CDR-H2 comprising the amino acid sequence of SEQ ID NO: 1273, c. CDR-H3 comprising the amino acid sequence of SEQ ID NO: 1815, and a VL comprising the amino acid sequence of SEQ ID NO: 460.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1002, b. CDR-L2 comprising the amino acid sequence of SEQ ID NO: 1544, c. CDR-L3 comprising the amino acid sequence of SEQ ID NO: 2086, and a VH comprising the amino acid sequence of SEQ ID NO: 189.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 189. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 189. In some embodiments, substitutions, insertions, or deletions occur in regions outside the CDRs (e.g., in the FRs). Optionally, the antibody or antigen-binding fragment thereof comprises the VH sequence SEQ ID NO: 189, including one or more post-translational modifications of that sequence. In a particular embodiment, the VH comprises one, two or three CDRs selected from: a. CDR-H1, comprising the amino acid sequence SEQ ID NO: 731, b. CDR-H2, comprising the amino acid sequence SEQ ID NO: 1273, and c. CDR-H3, comprising the amino acid sequence SEQ ID NO: 1815.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 460. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 460. In some embodiments, the substitutions, insertions, or deletions occur in regions outside the CDRs (e.g., in the FRs). Optionally, the antibody or antigen-binding fragment thereof comprises the VL sequence SEQ ID NO: 460, including one or more post-translational modifications of that sequence. In a particular embodiment, the VL comprises one, two or three CDRs selected from: a. CDR-L1, comprising the amino acid sequence SEQ ID NO: 1002, b. CDR-L2, comprising the amino acid sequence SEQ ID NO: 1544, and c. CDR-L3, comprising the amino acid sequence SEQ ID NO: 2086.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 189, and the VL amino acid sequence of SEQ ID NO: 460, optionally including post-translational modifications of those sequences.
TMEL1035

In one aspect, the present disclosure provides an antibody or antigen-binding fragment thereof comprising at least one or both variable regions selected from: a. VH comprising the amino acid sequence of SEQ ID NO: 190 and b. VL comprising the amino acid sequence of SEQ ID NO: 461.

In one aspect, the present disclosure provides an antibody or antigen-binding fragment thereof comprising at least one, two, three, four, five, or six CDRs selected from: a. CDR-H1 comprising the amino acid sequence of SEQ ID NO: 732, b. CDR-H2 comprising the amino acid sequence of SEQ ID NO: 1274, c. CDR-H3 comprising the amino acid sequence of SEQ ID NO: 1816, d. CDR-L1 comprising the amino acid sequence of SEQ ID NO: 1003, e. CDR-L2 comprising the amino acid sequence of SEQ ID NO: 1545, and f. CDR-L3 comprising the amino acid sequence of SEQ ID NO: 2087.

In one aspect, the present disclosure provides an antibody or antigen-binding fragment thereof comprising a CDR-H3 comprising the amino acid sequence of SEQ ID NO: 1816, and a CDR-L3 comprising the amino acid sequence of SEQ ID NO: 2087.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 732, b. CDR-H2 comprising the amino acid sequence of SEQ ID NO: 1274, c. CDR-H3 comprising the amino acid sequence of SEQ ID NO: 1816, and a VL comprising the amino acid sequence of SEQ ID NO: 461.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1003, b. CDR-L2 comprising the amino acid sequence of SEQ ID NO: 1545, c. CDR-L3 comprising the amino acid sequence of SEQ ID NO: 2087, and a VH comprising the amino acid sequence of SEQ ID NO: 190.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 190. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 190. In some embodiments, substitutions, insertions, or deletions occur in regions outside the CDRs (e.g., in the FRs). Optionally, the antibody or antigen-binding fragment thereof comprises the VH sequence SEQ ID NO: 190, including one or more post-translational modifications of that sequence. In a particular embodiment, the VH comprises one, two or three CDRs selected from: a. CDR-H1, comprising the amino acid sequence SEQ ID NO: 732, b. CDR-H2, comprising the amino acid sequence SEQ ID NO: 1274, and c. CDR-H3, comprising the amino acid sequence SEQ ID NO: 1816.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 461. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 461. In some embodiments, the substitutions, insertions, or deletions occur in regions outside the CDRs (e.g., in the FRs). Optionally, the antibody or antigen-binding fragment thereof comprises the VL sequence SEQ ID NO: 461, including one or more post-translational modifications of that sequence. In a particular embodiment, the VL comprises one, two or three CDRs selected from: a. CDR-L1, comprising the amino acid sequence SEQ ID NO: 1003, b. CDR-L2, comprising the amino acid sequence SEQ ID NO: 1545, and c. CDR-L3, comprising the amino acid sequence SEQ ID NO: 2087.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 190, and the VL amino acid sequence of SEQ ID NO: 461, optionally including post-translational modifications of those sequences.

TMEL1036

In one aspect, the present disclosure provides an antibody or antigen-binding fragment thereof comprising at least one or both variable regions selected from: a. VH comprising the amino acid sequence of SEQ ID NO: 191 and b. VL comprising the amino acid sequence of SEQ ID NO: 462.

In one aspect, the present disclosure provides an antibody or antigen-binding fragment thereof comprising at least one, two, three, four, five, or six CDRs selected from: a. CDR-H1 comprising the amino acid sequence of SEQ ID NO: 733, b. CDR-H2 comprising the amino acid sequence of SEQ ID NO: 1275, c. CDR-H3 comprising the amino acid sequence of SEQ ID NO: 1817, d. CDR-L1 comprising the amino acid sequence of SEQ ID NO: 1004, e. CDR-L2 comprising the amino acid sequence of SEQ ID NO: 1546, and f. CDR-L3 comprising the amino acid sequence of SEQ ID NO: 2088.

In one aspect, the present disclosure provides an antibody or antigen-binding fragment thereof comprising a CDR-H3 comprising the amino acid sequence of SEQ ID NO: 1817, and a CDR-L3 comprising the amino acid sequence of SEQ ID NO: 2088.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 733, b. CDR-H2 comprising the amino acid sequence of SEQ ID NO: 1275, c. CDR-H3 comprising the amino acid sequence of SEQ ID NO: 1817, and a VL comprising the amino acid sequence of SEQ ID NO: 462.

In one aspect, the present disclosure provides an antibody or antigen-binding fragment thereof comprising at least one, at least two, or all three VL CDR sequences selected from: a CDR-L1 comprising the amino acid sequence of SEQ ID NO: 1004, b CDR-L2 comprising the amino acid sequence of SEQ ID NO: 1546, c. CDR-L3 comprising the amino acid sequence of SEQ ID NO: 2088, and a VH comprising the amino acid sequence of SEQ ID NO: 191.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 191. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 191. In some embodiments, substitutions, insertions, or deletions occur in regions outside the CDRs (e.g., in the FRs). Optionally, the antibody or antigen-binding fragment thereof comprises the VH sequence SEQ ID NO: 191, including one or more post-translational modifications of that sequence. In a particular embodiment, the VH comprises one, two or three CDRs selected from: a. CDR-H1, comprising the amino acid sequence SEQ ID NO: 733, b. CDR-H2, comprising the amino acid sequence SEQ ID NO: 1275, and c. CDR-H3, comprising the amino acid sequence SEQ ID NO: 1817.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 462. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 462. In some embodiments, the substitutions, insertions, or deletions occur in regions outside the CDRs (e.g., in the FRs). Optionally, the antibody or antigen-binding fragment thereof comprises the VL sequence SEQ ID NO: 462, including one or more post-translational modifications of that sequence. In a particular embodiment, the VL comprises one, two or three CDRs selected from: a. CDR-L1, comprising the amino acid sequence SEQ ID NO: 1004, b. CDR-L2, comprising the amino acid sequence SEQ ID NO: 1546, and c. CDR-L3, comprising the amino acid sequence SEQ ID NO: 2088.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 191, and the VL amino acid sequence of SEQ ID NO: 462, optionally including post-translational modifications of those sequences.

TMEL1037

In one aspect, the present disclosure provides an antibody or antigen-binding fragment thereof comprising at least one or both variable regions selected from: a. VH comprising the amino acid sequence of SEQ ID NO: 192 and b. VL comprising the amino acid sequence of SEQ ID NO: 463.

In one aspect, the present disclosure provides an antibody or antigen-binding fragment thereof comprising at least one, two, three, four, five, or six CDRs selected from: a. CDR-H1 comprising the amino acid sequence of SEQ ID NO: 734, b. CDR-H2 comprising the amino acid sequence of SEQ ID NO: 1276, c. CDR-H3 comprising the amino acid sequence of SEQ ID NO: 1818, d. CDR-L1 comprising the amino acid sequence of SEQ ID NO: 1005, e. CDR-L2 comprising the amino acid sequence of SEQ ID NO: 1547, and f. CDR-L3 comprising the amino acid sequence of SEQ ID NO: 2089.

In one aspect, the present disclosure provides an antibody or antigen-binding fragment thereof comprising a CDR-H3 comprising the amino acid sequence of SEQ ID NO: 1818, and a CDR-L3 comprising the amino acid sequence of SEQ ID NO: 2089.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 734, b. CDR-H2 comprising the amino acid sequence of SEQ ID NO: 1276, c. CDR-H3 comprising the amino acid sequence of SEQ ID NO: 1818, and d. VL comprising the amino acid sequence of SEQ ID NO: 463.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1005, b. CDR-L2 comprising the amino acid sequence of SEQ ID NO: 1547, c. CDR-L3 comprising the amino acid sequence of SEQ ID NO: 2089, and a VH comprising the amino acid sequence of SEQ ID NO: 192.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 192. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 192. In some embodiments, substitutions, insertions, or deletions occur in regions outside the CDRs (e.g., in the FRs). Optionally, the antibody or antigen-binding fragment thereof comprises the VH sequence SEQ ID NO: 192, including one or more post-translational modifications of that sequence. In a particular embodiment, the VH comprises one, two or three CDRs selected from: a. CDR-H1, comprising the amino acid sequence SEQ ID NO: 734, b. CDR-H2, comprising the amino acid sequence SEQ ID NO: 1276, and c. CDR-H3, comprising the amino acid sequence SEQ ID NO: 1818.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 463. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 463. In some embodiments, the substitutions, insertions, or deletions occur in regions outside the CDRs (e.g., in the FRs). Optionally, the antibody or antigen-binding fragment thereof comprises the VL sequence SEQ ID NO: 463, including one or more post-translational modifications of that sequence. In a particular embodiment, the VL comprises one, two or three CDRs selected from: a. CDR-L1, comprising the amino acid sequence SEQ ID NO: 1005, b. CDR-L2, comprising the amino acid sequence SEQ ID NO: 1547, and c. CDR-L3, comprising the amino acid sequence SEQ ID NO: 2089.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 192, and the VL amino acid sequence of SEQ ID NO: 463, optionally including post-translational modifications of those sequences.

TMEL1038

In one aspect, the present disclosure provides an antibody or antigen-binding fragment thereof comprising at least one or both variable regions selected from: a. VH comprising the amino acid sequence of SEQ ID NO: 193 and b. VL comprising the amino acid sequence of SEQ ID NO: 464.

In one aspect, the present disclosure provides an antibody or antigen-binding fragment thereof comprising at least one, two, three, four, five, or six CDRs selected from: a. CDR-H1 comprising the amino acid sequence of SEQ ID NO: 735, b. CDR-H2 comprising the amino acid sequence of SEQ ID NO: 1277, c. CDR-H3 comprising the amino acid sequence of SEQ ID NO: 1819, d. CDR-L1 comprising the amino acid sequence of SEQ ID NO: 1006, e. CDR-L2 comprising the amino acid sequence of SEQ ID NO: 1548, and f. CDR-L3 comprising the amino acid sequence of SEQ ID NO: 2090.

In one aspect, the present disclosure provides an antibody or antigen-binding fragment thereof comprising a CDR-H3 comprising the amino acid sequence of SEQ ID NO: 1819, and a CDR-L3 comprising the amino acid sequence of SEQ ID NO: 2090.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 735, b. CDR-H2 comprising the amino acid sequence of SEQ ID NO: 1277, c. CDR-H3 comprising the amino acid sequence of SEQ ID NO: 1819, and a VL comprising the amino acid sequence of SEQ ID NO: 464.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1006, b. CDR-L2 comprising the amino acid sequence of SEQ ID NO: 1548, c. CDR-L3 comprising the amino acid sequence of SEQ ID NO: 2090, and a VH comprising the amino acid sequence of SEQ ID NO: 193.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 193. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 193. In some embodiments, substitutions, insertions, or deletions occur in regions outside the CDRs (e.g., in the FRs). Optionally, the antibody or antigen-binding fragment thereof comprises the VH sequence SEQ ID NO: 193, including one or more post-translational modifications of that sequence. In a particular embodiment, the VH comprises one, two or three CDRs selected from: a. CDR-H1, comprising the amino acid sequence SEQ ID NO: 735, b. CDR-H2, comprising the amino acid sequence SEQ ID NO: 1277, and c. CDR-H3, comprising the amino acid sequence SEQ ID NO: 1819.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 464. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 464. In some embodiments, the substitutions, insertions, or deletions occur in regions outside the CDRs (e.g., in the FRs). Optionally, the antibody or antigen-binding fragment thereof comprises the VL sequence SEQ ID NO: 464, including one or more post-translational modifications of that sequence. In a particular embodiment, the VL comprises one, two or three CDRs selected from: a. CDR-L1, comprising the amino acid sequence SEQ ID NO: 1006, b. CDR-L2, comprising the amino acid sequence SEQ ID NO: 1548, and c. CDR-L3, comprising the amino acid sequence SEQ ID NO: 2090.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 193, and the VL amino acid sequence of SEQ ID NO: 464, optionally including post-translational modifications of those sequences.
TMEL1039

In one aspect, the present disclosure provides an antibody or antigen-binding fragment thereof comprising at least one or both variable regions selected from: a. VH comprising the amino acid sequence of SEQ ID NO: 194 and b. VL comprising the amino acid sequence of SEQ ID NO: 465.

In one aspect, the present disclosure provides an antibody or antigen-binding fragment thereof comprising at least one, two, three, four, five, or six CDRs selected from: a. CDR-H1 comprising the amino acid sequence of SEQ ID NO: 736, b. CDR-H2 comprising the amino acid sequence of SEQ ID NO: 1278, c. CDR-H3 comprising the amino acid sequence of SEQ ID NO: 1820, d. CDR-L1 comprising the amino acid sequence of SEQ ID NO: 1007, e. CDR-L2 comprising the amino acid sequence of SEQ ID NO: 1549, and f. CDR-L3 comprising the amino acid sequence of SEQ ID NO: 2091.

In one aspect, the present disclosure provides an antibody or antigen-binding fragment thereof comprising a CDR-H3 comprising the amino acid sequence of SEQ ID NO: 1820, and a CDR-L3 comprising the amino acid sequence of SEQ ID NO: 2091.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 736, b. CDR-H2 comprising the amino acid sequence of SEQ ID NO: 1278, c. CDR-H3 comprising the amino acid sequence of SEQ ID NO: 1820, and a VL comprising the amino acid sequence of SEQ ID NO: 465.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1007, b. CDR-L2 comprising the amino acid sequence of SEQ ID NO: 1549, c. CDR-L3 comprising the amino acid sequence of SEQ ID NO: 2091, and a VH comprising the amino acid sequence of SEQ ID NO: 194.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 194. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 194. In some embodiments, substitutions, insertions, or deletions occur in regions outside the CDRs (e.g., in the FRs). Optionally, the antibody or antigen-binding fragment thereof comprises the VH sequence SEQ ID NO: 194, including one or more post-translational modifications of that sequence. In a particular embodiment, the VH comprises one, two or three CDRs selected from: CDR-H1, comprising the amino acid sequence SEQ ID NO: 736, b. CDR-H2, comprising the amino acid sequence SEQ ID NO: 1278, and c. CDR-H3, comprising the amino acid sequence SEQ ID NO: 1820.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 465. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 465. In some embodiments, the substitutions, insertions, or deletions occur in regions outside the CDRs (e.g., in the FRs). Optionally, the antibody or antigen-binding fragment thereof comprises the VL sequence SEQ ID NO: 465, including one or more post-translational modifications of that sequence. In a particular embodiment, the VL comprises one, two or three CDRs selected from: a. CDR-L1, comprising the amino acid sequence SEQ ID NO: 1007, b. CDR-L2, comprising the amino acid sequence SEQ ID NO: 1549, and c. CDR-L3, comprising the amino acid sequence SEQ ID NO: 2091.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 194, and the VL amino acid sequence of SEQ ID NO: 465, optionally including post-translational modifications of those sequences.

TMEL1040

In one aspect, the present disclosure provides an antibody or antigen-binding fragment thereof comprising at least one or both variable regions selected from: a. VH comprising the amino acid sequence of SEQ ID NO: 195 and b. VL comprising the amino acid sequence of SEQ ID NO: 466.

In one aspect, the present disclosure provides an antibody or antigen-binding fragment thereof comprising at least one, two, three, four, five, or six CDRs selected from: a. CDR-H1 comprising the amino acid sequence of SEQ ID NO: 737, b. CDR-H2 comprising the amino acid sequence of SEQ ID NO: 1279, c. CDR-H3 comprising the amino acid sequence of SEQ ID NO: 1821, d. CDR-L1 comprising the amino acid sequence of SEQ ID NO: 1008, e. CDR-L2 comprising the amino acid sequence of SEQ ID NO: 1550, and f. CDR-L3 comprising the amino acid sequence of SEQ ID NO: 2092.

In one aspect, the present disclosure provides an antibody or antigen-binding fragment thereof comprising a CDR-H3 comprising the amino acid sequence of SEQ ID NO: 1821, and a CDR-L3 comprising the amino acid sequence of SEQ ID NO: 2092.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 737, b. CDR-H2 comprising the amino acid sequence of SEQ ID NO: 1279, c. CDR-H3 comprising the amino acid sequence of SEQ ID NO: 1821, and a VL comprising the amino acid sequence of SEQ ID NO: 466.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1008, b. CDR-L2 comprising the amino acid sequence of SEQ ID NO: 1550, c. CDR-L3 comprising the amino acid sequence of SEQ ID NO: 2092, and a VH comprising the amino acid sequence of SEQ ID NO: 195.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 195. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 195. In some embodiments, substitutions, insertions, or deletions occur in regions outside the CDRs (e.g., in the FRs). Optionally, the antibody or antigen-binding fragment thereof comprises the VH sequence SEQ ID NO: 195, including one or more post-translational modifications of that sequence. In a particular embodiment, the VH comprises one, two or three CDRs selected from: a. CDR-H1, comprising the amino acid sequence SEQ ID NO: 737, b. CDR-H2, comprising the amino acid sequence SEQ ID NO: 1279, and c. CDR-H3, comprising the amino acid sequence SEQ ID NO: 1821.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 466. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 466. In some embodiments, the substitutions, insertions, or deletions occur in regions outside the CDRs (e.g., in the FRs). Optionally, the antibody or antigen-binding fragment thereof comprises the VL sequence SEQ ID NO: 466, including one or more post-translational modifications of that sequence. In a particular embodiment, the VL comprises one, two or three CDRs selected from: a. CDR-L1, comprising the amino acid sequence SEQ ID NO: 1008, b. CDR-L2, comprising the amino acid sequence SEQ ID NO: 1550, and c. CDR-L3, comprising the amino acid sequence SEQ ID NO: 2092.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 195, and the VL amino acid sequence of SEQ ID NO: 466, optionally including post-translational modifications of those sequences.

TMEL1041

In one aspect, the present disclosure provides an antibody or antigen-binding fragment thereof comprising at least one or both variable regions selected from: a. VH comprising the amino acid sequence of SEQ ID NO: 196 and b. VL comprising the amino acid sequence of SEQ ID NO: 467.

In one aspect, the present disclosure provides an antibody or antigen-binding fragment thereof comprising at least one, two, three, four, five, or six CDRs selected from: a. CDR-H1 comprising the amino acid sequence of SEQ ID NO: 738, b. CDR-H2 comprising the amino acid sequence of SEQ ID NO: 1280, c. CDR-H3 comprising the amino acid sequence of SEQ ID NO: 1822, d. CDR-L1 comprising the amino acid sequence of SEQ ID NO: 1009, e. CDR-L2 comprising the amino acid sequence of SEQ ID NO: 1551, and f. CDR-L3 comprising the amino acid sequence of SEQ ID NO: 2093.

In one aspect, the present disclosure provides an antibody or antigen-binding fragment thereof comprising a CDR-H3 comprising the amino acid sequence of SEQ ID NO: 1822, and a CDR-L3 comprising the amino acid sequence of SEQ ID NO: 2093.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 738, b. CDR-H2 comprising the amino acid sequence of SEQ ID NO: 1280, c. CDR-H3 comprising the amino acid sequence of SEQ ID NO: 1822, and a VL comprising the amino acid sequence of SEQ ID NO: 467.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1009, b. CDR-L2 comprising the amino acid sequence of SEQ ID NO: 1551, c. CDR-L3 comprising the amino acid sequence of SEQ ID NO: 2093, and a VH comprising the amino acid sequence of SEQ ID NO: 196.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 196. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 196. In some embodiments, substitutions, insertions, or deletions occur in regions outside the CDRs (e.g., in the FRs). Optionally, the antibody or antigen-binding fragment thereof comprises the VH sequence SEQ ID NO: 196, including one or more post-translational modifications of that sequence. In a particular embodiment, the VH comprises one, two or three CDRs selected from: a. CDR-H1, comprising the amino acid sequence SEQ ID NO: 738, b. CDR-H2, comprising the amino acid sequence SEQ ID NO: 1280, and c. CDR-H3, comprising the amino acid sequence SEQ ID NO: 1822.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 467. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 467. In some embodiments, the substitutions, insertions, or deletions occur in regions outside the CDRs (e.g., in the FRs). Optionally, the antibody or antigen-binding fragment thereof comprises the VL sequence SEQ ID NO: 467, including one or more post-translational modifications of that sequence. In a particular embodiment, the VL comprises one, two or three CDRs selected from: a. CDR-L1, comprising the amino acid sequence SEQ ID NO: 1009, b. CDR-L2, comprising the amino acid sequence SEQ ID NO: 1551, and a. CDR-L3, comprising the amino acid sequence SEQ ID NO: 2093.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 196, and the VL amino acid sequence of SEQ ID NO: 467, optionally including post-translational modifications of those sequences.
TMES1001

In one aspect, the present disclosure provides an antibody or antigen-binding fragment thereof comprising at least one or both variable regions selected from: a. VH comprising the amino acid sequence of SEQ ID NO: 197 and b. VL comprising the amino acid sequence of SEQ ID NO: 468.

In one aspect, the present disclosure provides an antibody or antigen-binding fragment thereof comprising at least one, two, three, four, five, or six CDRs selected from: a. CDR-H1 comprising the amino acid sequence of SEQ ID NO: 739, b. CDR-H2 comprising the amino acid sequence of SEQ ID NO: 1281, c. CDR-H3 comprising the amino acid sequence of SEQ ID NO: 1823, d. CDR-L1 comprising the amino acid sequence of SEQ ID NO: 1010, e. CDR-L2 comprising the amino acid sequence of SEQ ID NO: 1552, and f. CDR-L3 comprising the amino acid sequence of SEQ ID NO: 2094.

In one aspect, the present disclosure provides an antibody or antigen-binding fragment thereof comprising a CDR-H3 comprising the amino acid sequence of SEQ ID NO: 1823 and a CDR-L3 comprising the amino acid sequence of SEQ ID NO: 2094.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 739, b. CDR-H2 comprising the amino acid sequence of SEQ ID NO: 1281, c. CDR-H3 comprising the amino acid sequence of SEQ ID NO: 1823, and a VL comprising the amino acid sequence of SEQ ID NO: 468.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1010, b. CDR-L2 comprising the amino acid sequence of SEQ ID NO: 1552, c. CDR-L3 comprising the amino acid sequence of SEQ ID NO: 2094, and a VH comprising the amino acid sequence of SEQ ID NO: 197.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 197. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 197. In some embodiments, substitutions, insertions, or deletions occur in regions outside the CDRs (e.g., in the FRs). Optionally, the antibody or antigen-binding fragment thereof comprises the VH sequence SEQ ID NO: 197, including one or more post-translational modifications of that sequence. In a particular embodiment, the VH comprises one, two or three CDRs selected from: a. CDR-H1, comprising the amino acid sequence SEQ ID NO: 739, b. CDR-H2, comprising the amino acid sequence SEQ ID NO: 1281, and c. CDR-H3, comprising the amino acid sequence SEQ ID NO: 1823.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 468. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 468. In some embodiments, the substitutions, insertions, or deletions occur in regions outside the CDRs (e.g., in the FRs). Optionally, the antibody or antigen-binding fragment thereof comprises the VL sequence SEQ ID NO: 468, including one or more post-translational modifications of that sequence. In a particular embodiment, the VL comprises one, two or three CDRs selected from: a. CDR-L1, comprising the amino acid sequence SEQ ID NO: 1010, b. CDR-L2, comprising the amino acid sequence SEQ ID NO: 1552, and c. CDR-L3, comprising the amino acid sequence SEQ ID NO: 2094.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 197, and the VL amino acid sequence of SEQ ID NO: 468, optionally including post-translational modifications of those sequences.

TMES1002

In one aspect, the present disclosure provides an antibody or antigen-binding fragment thereof comprising at least one or both variable regions selected from: a. VH comprising the amino acid sequence of SEQ ID NO: 198 and b. VL comprising the amino acid sequence of SEQ ID NO: 469.

In one aspect, the present disclosure provides an antibody or antigen-binding fragment thereof comprising at least one, two, three, four, five, or six CDRs selected from: a. CDR-H1 comprising the amino acid sequence of SEQ ID NO: 740, b. CDR-H2 comprising the amino acid sequence of SEQ ID NO: 1282, c. CDR-H3 comprising the amino acid sequence of SEQ ID NO: 1824, d. CDR-L1 comprising the amino acid sequence of SEQ ID NO: 1011, e. CDR-L2 comprising the amino acid sequence of SEQ ID NO: 1553, and f. CDR-L3 comprising the amino acid sequence of SEQ ID NO: 2095.

In one aspect, the present disclosure provides an antibody or antigen-binding fragment thereof comprising a CDR-H3 comprising the amino acid sequence of SEQ ID NO: 1824, and a CDR-L3 comprising the amino acid sequence of SEQ ID NO: 2095.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 740, b. CDR-H2 comprising the amino acid sequence of SEQ ID NO: 1282, c. CDR-H3 comprising the amino acid sequence of SEQ ID NO: 1824, and a VL comprising the amino acid sequence of SEQ ID NO: 469.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1011, b. CDR-L2 comprising the amino acid sequence of SEQ ID NO: 1553, c. CDR-L3 comprising the amino acid sequence of SEQ ID NO: 2095, and a VH comprising the amino acid sequence of SEQ ID NO: 198.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 198. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 198. In some embodiments, substitutions, insertions, or deletions occur in regions outside the CDRs (e.g., in the FRs). Optionally, the antibody or antigen-binding fragment thereof comprises the VH sequence SEQ ID NO: 198, including one or more post-translational modifications of that sequence. In a particular embodiment, the VH comprises one, two or three CDRs selected from: a. CDR-H1, comprising the amino acid sequence SEQ ID NO: 740, b. CDR-H2, comprising the amino acid sequence SEQ ID NO: 1282, and c. CDR-H3, comprising the amino acid sequence SEQ ID NO: 1824.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 469. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 469. In some embodiments, the substitutions, insertions, or deletions occur in regions outside the CDRs (e.g., in the FRs). Optionally, the antibody or antigen-binding fragment thereof comprises the VL sequence SEQ ID NO: 469, including one or more post-translational modifications of that sequence. In a particular embodiment, the VL comprises one, two or three CDRs selected from: a. CDR-L1, comprising the amino acid sequence SEQ ID NO: 1011, b. CDR-L2, comprising the amino acid sequence SEQ ID NO: 1553, and c. CDR-L3, comprising the amino acid sequence SEQ ID NO: 2095.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 198, and the VL amino acid sequence of SEQ ID NO: 469, optionally including post-translational modifications of those sequences.
TMES1003

In one aspect, the present disclosure provides an antibody or antigen-binding fragment thereof comprising at least one or both variable regions selected from: a. VH comprising the amino acid sequence of SEQ ID NO: 199 and b. VL comprising the amino acid sequence of SEQ ID NO: 470.

In one aspect, the present disclosure provides an antibody or antigen-binding fragment thereof comprising at least one, two, three, four, five, or six CDRs selected from: a. CDR-H1 comprising the amino acid sequence of SEQ ID NO: 741, b. CDR-H2 comprising the amino acid sequence of SEQ ID NO: 1283, c. CDR-H3 comprising the amino acid sequence of SEQ ID NO: 1825, d. CDR-L1 comprising the amino acid sequence of SEQ ID NO: 1012, e. CDR-L2 comprising the amino acid sequence of SEQ ID NO: 1554, and f. CDR-L3 comprising the amino acid sequence of SEQ ID NO: 2096.

In one aspect, the present disclosure provides an antibody or antigen-binding fragment thereof comprising a CDR-H3 comprising the amino acid sequence of SEQ ID NO: 1825, and a CDR-L3 comprising the amino acid sequence of SEQ ID NO: 2096.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 741, b. CDR-H2 comprising the amino acid sequence of SEQ ID NO: 1283, c. CDR-H3 comprising the amino acid sequence of SEQ ID NO: 1825, and a VL comprising the amino acid sequence of SEQ ID NO: 470.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1012, b. CDR-L2 comprising the amino acid sequence of SEQ ID NO: 1554, c. CDR-L3 comprising the amino acid sequence of SEQ ID NO: 2096, and a VH comprising the amino acid sequence of SEQ ID NO: 199.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 199. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 199. In some embodiments, substitutions, insertions, or deletions occur in regions outside the CDRs (e.g., in the FRs). Optionally, the antibody or antigen-binding fragment thereof comprises the VH sequence SEQ ID NO: 199, including one or more post-translational modifications of that sequence. In a particular embodiment, the VH comprises one, two or three CDRs selected from: a. CDR-H1, comprising the amino acid sequence SEQ ID NO: 741, b. CDR-H2, comprising the amino acid sequence SEQ ID NO: 1283, and c. CDR-H3, comprising the amino acid sequence SEQ ID NO: 1825.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 470. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 470. In some embodiments, the substitutions, insertions, or deletions occur in regions outside the CDRs (e.g., in the FRs). Optionally, the antibody or antigen-binding fragment thereof comprises the VL sequence SEQ ID NO: 470, including one or more post-translational modifications of that sequence. In a particular embodiment, the VL comprises one, two or three CDRs selected from: a. CDR-L1, comprising the amino acid sequence SEQ ID NO: 1012, b. CDR-L2, comprising the amino acid sequence SEQ ID NO: 1554, and c. CDR-L3, comprising the amino acid sequence SEQ ID NO: 2096.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 199, and the VL amino acid sequence of SEQ ID NO: 470, optionally including post-translational modifications of those sequences.
TMES1004

In one aspect, the present disclosure provides an antibody or antigen-binding fragment thereof comprising at least one or both variable regions selected from: a. VH comprising the amino acid sequence of SEQ ID NO: 200 and b. VL comprising the amino acid sequence of SEQ ID NO: 471.

In one aspect, the present disclosure provides an antibody or antigen-binding fragment thereof comprising at least one, two, three, four, five, or six CDRs selected from: a. CDR-H1 comprising the amino acid sequence of SEQ ID NO: 742, b. CDR-H2 comprising the amino acid sequence of SEQ ID NO: 1284, c. CDR-H3 comprising the amino acid sequence of SEQ ID NO: 1826, d. CDR-L1 comprising the amino acid sequence of SEQ ID NO: 1013, e. CDR-L2 comprising the amino acid sequence of SEQ ID NO: 1555, and f. CDR-L3 comprising the amino acid sequence of SEQ ID NO: 2097.

In one aspect, the present disclosure provides an antibody or antigen-binding fragment thereof comprising a CDR-H3 comprising the amino acid sequence of SEQ ID NO: 1826, and a CDR-L3 comprising the amino acid sequence of SEQ ID NO: 2097.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 742, b. CDR-H2 comprising the amino acid sequence of SEQ ID NO: 1284, c. CDR-H3 comprising the amino acid sequence of SEQ ID NO: 1826, and a VL comprising the amino acid sequence of SEQ ID NO: 471.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1013, b. CDR-L2 comprising the amino acid sequence of SEQ ID NO: 1555, c. CDR-L3 comprising the amino acid sequence of SEQ ID NO: 2097, and a VH comprising the amino acid sequence of SEQ ID NO: 200.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 200. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 200. In some embodiments, substitutions, insertions, or deletions occur in regions outside the CDRs (e.g., in the FRs). Optionally, the antibody or antigen-binding fragment thereof comprises the VH sequence SEQ ID NO: 200, including one or more post-translational modifications of that sequence. In a particular embodiment, the VH comprises one, two or three CDRs selected from: a. CDR-H1, comprising the amino acid sequence SEQ ID NO: 742, b. CDR-H2, comprising the amino acid sequence SEQ ID NO: 1284, and c. CDR-H3, comprising the amino acid sequence SEQ ID NO: 1826.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 471. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 471. In some embodiments, the substitutions, insertions, or deletions occur in regions outside the CDRs (e.g., in the FRs). Optionally, the antibody or antigen-binding fragment thereof comprises the VL sequence SEQ ID NO: 471, including one or more post-translational modifications of that sequence. In a particular embodiment, the VL comprises one, two or three CDRs selected from: a. CDR-L1, comprising the amino acid sequence SEQ ID NO: 1013, b. CDR-L2, comprising the amino acid sequence SEQ ID NO: 1555, and c. CDR-L3, comprising the amino acid sequence SEQ ID NO: 2097.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 200, and the VL amino acid sequence of SEQ ID NO: 471, optionally including post-translational modifications of those sequences.

TOVA1001

In one aspect, the present disclosure provides an antibody or antigen-binding fragment thereof comprising at least one or both variable regions selected from: a. VH comprising the amino acid sequence of SEQ ID NO: 201 and b. VL comprising the amino acid sequence of SEQ ID NO: 472.

In one aspect, the present disclosure provides an antibody or antigen-binding fragment thereof comprising at least one, two, three, four, five, or six CDRs selected from: a. CDR-H1 comprising the amino acid sequence of SEQ ID NO: 743, b. CDR-H2 comprising the amino acid sequence of SEQ ID NO: 1285, c. CDR-H3 comprising the amino acid sequence of SEQ ID NO: 1827, d. CDR-L1 comprising the amino acid sequence of SEQ ID NO: 1014, e. CDR-L2 comprising the amino acid sequence of SEQ ID NO: 1556, and f. CDR-L3 comprising the amino acid sequence of SEQ ID NO: 2098.

In one aspect, the present disclosure provides an antibody or antigen-binding fragment thereof comprising a CDR-H3 comprising the amino acid sequence of SEQ ID NO: 1827, and a CDR-L3 comprising the amino acid sequence of SEQ ID NO: 2098.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 743, b. CDR-H2 comprising the amino acid sequence of SEQ ID NO: 1285, c. CDR-H3 comprising the amino acid sequence of SEQ ID NO: 1827, and a VL comprising the amino acid sequence of SEQ ID NO: 472.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1014, b. CDR-L2 comprising the amino acid sequence of SEQ ID NO: 1556, c. CDR-L3 comprising the amino acid sequence of SEQ ID NO: 2098, and a VH comprising the amino acid sequence of SEQ ID NO: 201.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 201. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 201. In some embodiments, substitutions, insertions, or deletions occur in regions outside the CDRs (e.g., in the FRs). Optionally, the antibody or antigen-binding fragment thereof comprises the VH sequence SEQ ID NO: 201, including one or more post-translational modifications of that sequence. In a particular embodiment, the VH comprises one, two or three CDRs selected from: a. CDR-H1, comprising the amino acid sequence SEQ ID NO: 743, b. CDR-H2, comprising the amino acid sequence SEQ ID NO: 1285, and c. CDR-H3, comprising the amino acid sequence SEQ ID NO: 1827.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 472. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 472. In some embodiments, the substitutions, insertions, or deletions occur in regions outside the CDRs (e.g., in the FRs). Optionally, the antibody or antigen-binding fragment thereof comprises the VL sequence SEQ ID NO: 472, including one or more post-translational modifications of that sequence. In a particular embodiment, the VL comprises one, two or three CDRs selected from: a. CDR-L1, comprising the amino acid sequence SEQ ID NO: 1014, b. CDR-L2, comprising the amino acid sequence SEQ ID NO: 1556, and c. CDR-L3, comprising the amino acid sequence SEQ ID NO: 2098.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 201, and the VL amino acid sequence of SEQ ID NO: 472, optionally including post-translational modifications of those sequences.

TOVA1002

In one aspect, the present disclosure provides an antibody or antigen-binding fragment thereof comprising at least one or both variable regions selected from: a. VH comprising the amino acid sequence of SEQ ID NO: 202 and b. VL comprising the amino acid sequence of SEQ ID NO: 473.

In one aspect, the present disclosure provides an antibody or antigen-binding fragment thereof comprising at least one, two, three, four, five, or six CDRs selected from: a. CDR-H1 comprising the amino acid sequence of SEQ ID NO: 744, b. CDR-H2 comprising the amino acid sequence of SEQ ID NO: 1286, c. CDR-H3 comprising the amino acid sequence of SEQ ID NO: 1828, d. CDR-L1 comprising the amino acid sequence of SEQ ID NO: 1015, e. CDR-L2 comprising the amino acid sequence of SEQ ID NO: 1557, and f. CDR-L3 comprising the amino acid sequence of SEQ ID NO: 2099.

In one aspect, the present disclosure provides an antibody or antigen-binding fragment thereof comprising a CDR-H3 comprising the amino acid sequence of SEQ ID NO: 1828, and a CDR-L3 comprising the amino acid sequence of SEQ ID NO: 2099.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 744, b. CDR-H2 comprising the amino acid sequence of SEQ ID NO: 1286, c. CDR-H3 comprising the amino acid sequence of SEQ ID NO: 1828, and a VL comprising the amino acid sequence of SEQ ID NO: 473.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1015, b. CDR-L2 comprising the amino acid sequence of SEQ ID NO: 1557, c. CDR-L3 comprising the amino acid sequence of SEQ ID NO: 2099, and a VH comprising the amino acid sequence of SEQ ID NO: 202.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 202. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 202. In some embodiments, substitutions, insertions, or deletions occur in regions outside the CDRs (e.g., in the FRs). Optionally, the antibody or antigen-binding fragment thereof comprises the VH sequence SEQ ID NO: 202, including one or more post-translational modifications of that sequence. In a particular embodiment, the VH comprises one, two or three CDRs selected from: a. CDR-H1, comprising the amino acid sequence SEQ ID NO: 744, b. CDR-H2, comprising the amino acid sequence SEQ ID NO: 1286, and c. CDR-H3, comprising the amino acid sequence SEQ ID NO: 1828.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 473. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 473. In some embodiments, the substitutions, insertions, or deletions occur in regions outside the CDRs (e.g., in the FRs). Optionally, the antibody or antigen-binding fragment thereof comprises the VL sequence SEQ ID NO: 473, including one or more post-translational modifications of that sequence. In a particular embodiment, the VL comprises one, two or three CDRs selected from: a. CDR-L1, comprising the amino acid sequence SEQ ID NO: 1015, b. CDR-L2, comprising the amino acid sequence SEQ ID NO: 1557, and c. CDR-L3, comprising the amino acid sequence SEQ ID NO: 2099.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 202, and the VL amino acid sequence of SEQ ID NO: 473, optionally including post-translational modifications of those sequences.

TOVA1003

In one aspect, the present disclosure provides an antibody or antigen-binding fragment thereof comprising at least one or both variable regions selected from: a. VH comprising the amino acid sequence of SEQ ID NO: 203 and b. VL comprising the amino acid sequence of SEQ ID NO: 474.

In one aspect, the present disclosure provides an antibody or antigen-binding fragment thereof comprising at least one, two, three, four, five, or six CDRs selected from: a. CDR-H1 comprising the amino acid sequence of SEQ ID NO: 745, b. CDR-H2 comprising the amino acid sequence of SEQ ID NO: 1287, c. CDR-H3 comprising the amino acid sequence of SEQ ID NO: 1829, d. CDR-L1 comprising the amino acid sequence of SEQ ID NO: 1016, e. CDR-L2 comprising the amino acid sequence of SEQ ID NO: 1558, and f. CDR-L3 comprising the amino acid sequence of SEQ ID NO: 2100.

In one aspect, the present disclosure provides an antibody or antigen-binding fragment thereof comprising a CDR-H3 comprising the amino acid sequence of SEQ ID NO: 1829, and a CDR-L3 comprising the amino acid sequence of SEQ ID NO: 2100.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 745, b. CDR-H2 comprising the amino acid sequence of SEQ ID NO: 1287, c. CDR-H3 comprising the amino acid sequence of SEQ ID NO: 1829, and a VL comprising the amino acid sequence of SEQ ID NO: 474.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1016, b. CDR-L2 comprising the amino acid sequence of SEQ ID NO: 1558, c. CDR-L3 comprising the amino acid sequence of SEQ ID NO: 2100, and a VH comprising the amino acid sequence of SEQ ID NO: 203.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 203. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 203. In some embodiments, substitutions, insertions, or deletions occur in regions outside the CDRs (e.g., in the FRs). Optionally, the antibody or antigen-binding fragment thereof comprises the VH sequence SEQ ID NO: 203, including one or more post-translational modifications of that sequence. In a particular embodiment, the VH comprises one, two or three CDRs selected from: a. CDR-H1, comprising the amino acid sequence SEQ ID NO: 745, b. CDR-H2, comprising the amino acid sequence SEQ ID NO: 1287, and c. CDR-H3, comprising the amino acid sequence SEQ ID NO: 1829.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 474. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 474. In some embodiments, the substitutions, insertions, or deletions occur in regions outside the CDRs (e.g., in the FRs). Optionally, the antibody or antigen-binding fragment thereof comprises the VL sequence SEQ ID NO: 474, including one or more post-translational modifications of that sequence. In a particular embodiment, the VL comprises one, two or three CDRs selected from: a. CDR-L1, comprising the amino acid sequence SEQ ID NO: 1016, b. CDR-L2, comprising the amino acid sequence SEQ ID NO: 1558, and c. CDR-L3, comprising the amino acid sequence SEQ ID NO: 2100.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 203, and the VL amino acid sequence of SEQ ID NO: 474, optionally including post-translational modifications of those sequences.

TOVA1004

In one aspect, the present disclosure provides an antibody or antigen-binding fragment thereof comprising at least one or both variable regions selected from: a. VH comprising the amino acid sequence of SEQ ID NO: 204 and b. VL comprising the amino acid sequence of SEQ ID NO: 475.

In one aspect, the present disclosure provides an antibody or antigen-binding fragment thereof comprising at least one, two, three, four, five, or six CDRs selected from: a. CDR-H1 comprising the amino acid sequence of SEQ ID NO: 746, b. CDR-H2 comprising the amino acid sequence of SEQ ID NO: 1288, c. CDR-H3 comprising the amino acid sequence of SEQ ID NO: 1830, d. CDR-L1 comprising the amino acid sequence of SEQ ID NO: 1017, e. CDR-L2 comprising the amino acid sequence of SEQ ID NO: 1559, and f. CDR-L3 comprising the amino acid sequence of SEQ ID NO: 2101.

In one aspect, the present disclosure provides an antibody or antigen-binding fragment thereof comprising a CDR-H3 comprising the amino acid sequence of SEQ ID NO: 1830, and a CDR-L3 comprising the amino acid sequence of SEQ ID NO: 2101.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 746, b. CDR-H2 comprising the amino acid sequence of SEQ ID NO: 1288, c. CDR-H3 comprising the amino acid sequence of SEQ ID NO: 1830, and a VL comprising the amino acid sequence of SEQ ID NO: 475.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1017, b. CDR-L2 comprising the amino acid sequence of SEQ ID NO: 1559, c. CDR-L3 comprising the amino acid sequence of SEQ ID NO: 2101, and a VH comprising the amino acid sequence of SEQ ID NO: 204.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 204. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 204. In some embodiments, substitutions, insertions, or deletions occur in regions outside the CDRs (e.g., in the FRs). Optionally, the antibody or antigen-binding fragment thereof comprises the VH sequence SEQ ID NO: 204, including one or more post-translational modifications of that sequence. In a particular embodiment, the VH comprises one, two or three CDRs selected from: a. CDR-H1, comprising the amino acid sequence SEQ ID NO: 746, b. CDR-H2, comprising the amino acid sequence SEQ ID NO: 1288, and c. CDR-H3, comprising the amino acid sequence SEQ ID NO: 1830.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 475. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 475. In some embodiments, the substitutions, insertions, or deletions occur in regions outside the CDRs (e.g., in the FRs). Optionally, the antibody or antigen-binding fragment thereof comprises the VL sequence SEQ ID NO: 475, including one or more post-translational modifications of that sequence. In a particular embodiment, the VL comprises one, two or three CDRs selected from: a. CDR-L1, comprising the amino acid sequence SEQ ID NO: 1017, b. CDR-L2, comprising the amino acid sequence SEQ ID NO: 1559, and c. CDR-L3, comprising the amino acid sequence SEQ ID NO: 2101.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 204, and the VL amino acid sequence of SEQ ID NO: 475, optionally including post-translational modifications of those sequences.
TOVA1005

In one aspect, the present disclosure provides an antibody or antigen-binding fragment thereof comprising at least one or both variable regions selected from: a. VH comprising the amino acid sequence of SEQ ID NO: 205 and b. VL comprising the amino acid sequence of SEQ ID NO: 476.

In one aspect, the present disclosure provides an antibody or antigen-binding fragment thereof comprising at least one, two, three, four, five, or six CDRs selected from: a. CDR-H1 comprising the amino acid sequence of SEQ ID NO: 747, b. CDR-H2 comprising the amino acid sequence of SEQ ID NO: 1289, c. CDR-H3 comprising the amino acid sequence of SEQ ID NO: 1831, d. CDR-L1 comprising the amino acid sequence of SEQ ID NO: 1018, e. CDR-L2 comprising the amino acid sequence of SEQ ID NO: 1560, and f. CDR-L3 comprising the amino acid sequence of SEQ ID NO: 2102.

In one aspect, the present disclosure provides an antibody or antigen-binding fragment thereof comprising a CDR-H3 comprising the amino acid sequence of SEQ ID NO: 1831, and a CDR-L3 comprising the amino acid sequence of SEQ ID NO: 2102.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 747, b. CDR-H2 comprising the amino acid sequence of SEQ ID NO: 1289, c. CDR-H3 comprising the amino acid sequence of SEQ ID NO: 1831, and a VL comprising the amino acid sequence of SEQ ID NO: 476.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1018, b. CDR-L2 comprising the amino acid sequence of SEQ ID NO: 1560, c. CDR-L3 comprising the amino acid sequence of SEQ ID NO: 2102, and d. VH comprising the amino acid sequence of SEQ ID NO: 205.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 205. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 205. In some embodiments, substitutions, insertions, or deletions occur in regions outside the CDRs (e.g., in the FRs). Optionally, the antibody or antigen-binding fragment thereof comprises the VH sequence SEQ ID NO: 205, including one or more post-translational modifications of that sequence. In a particular embodiment, the VH comprises one, two or three CDRs selected from: a. CDR-H1, comprising the amino acid sequence SEQ ID NO: 747, b. CDR-H2, comprising the amino acid sequence SEQ ID NO: 1289, and c. CDR-H3, comprising the amino acid sequence SEQ ID NO: 1831.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 476. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 476. In some embodiments, the substitutions, insertions, or deletions occur in regions outside the CDRs (e.g., in the FRs). Optionally, the antibody or antigen-binding fragment thereof comprises the VL sequence SEQ ID NO: 476, including one or more post-translational modifications of that sequence. In a particular embodiment, the VL comprises one, two or three CDRs selected from: a. CDR-L1, comprising the amino acid sequence SEQ ID NO: 1018, b. CDR-L2, comprising the amino acid sequence SEQ ID NO: 1560, and c. CDR-L3, comprising the amino acid sequence SEQ ID NO: 2102.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 205, and the VL amino acid sequence of SEQ ID NO: 476, optionally including post-translational modifications of those sequences.

TOVA1006

In one aspect, the present disclosure provides an antibody or antigen-binding fragment thereof comprising at least one or both variable regions selected from: a. VH comprising the amino acid sequence of SEQ ID NO: 206 and b. VL comprising the amino acid sequence of SEQ ID NO: 477.

In one aspect, the present disclosure provides an antibody or antigen-binding fragment thereof comprising at least one, two, three, four, five, or six CDRs selected from: a. CDR-H1 comprising the amino acid sequence of SEQ ID NO: 748, b. CDR-H2 comprising the amino acid sequence of SEQ ID NO: 1290, c. CDR-H3 comprising the amino acid sequence of SEQ ID NO: 1832, d. CDR-L1 comprising the amino acid sequence of SEQ ID NO: 1019, e. CDR-L2 comprising the amino acid sequence of SEQ ID NO: 1561, and f. CDR-L3 comprising the amino acid sequence of SEQ ID NO: 2103.

In one aspect, the present disclosure provides an antibody or antigen-binding fragment thereof comprising a CDR-H3 comprising the amino acid sequence of SEQ ID NO: 1832, and a CDR-L3 comprising the amino acid sequence of SEQ ID NO: 2103.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 748, b. CDR-H2 comprising the amino acid sequence of SEQ ID NO: 1290, c. CDR-H3 comprising the amino acid sequence of SEQ ID NO: 1832, and a VL comprising the amino acid sequence of SEQ ID NO: 477.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 748, b. CDR-H2 comprising the amino acid sequence of SEQ ID NO: 1290, c. CDR-H3 comprising the amino acid sequence of SEQ ID NO: 1832, and a VL comprising the amino acid sequence of SEQ ID NO: 477.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1019, b. CDR-L2 comprising the amino acid sequence of SEQ ID NO: 1561, c. CDR-L3 comprising the amino acid sequence of SEQ ID NO: 2103, and a VH comprising the amino acid sequence of SEQ ID NO: 206.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 206. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 206. In some embodiments, substitutions, insertions, or deletions occur in regions outside the CDRs (e.g., in the FRs). Optionally, the antibody or antigen-binding fragment thereof comprises the VH sequence SEQ ID NO: 206, including one or more post-translational modifications of that sequence. In a particular embodiment, the VH comprises one, two or three CDRs selected from: a. CDR-H1, comprising the amino acid sequence SEQ ID NO: 748, b. CDR-H2, comprising the amino acid sequence SEQ ID NO: 1290, and c. CDR-H3, comprising the amino acid sequence SEQ ID NO: 1832.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 477. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 477. In some embodiments, the substitutions, insertions, or deletions occur in regions outside the CDRs (e.g., in the FRs). Optionally, the antibody or antigen-binding fragment thereof comprises the VL sequence SEQ ID NO: 477, including one or more post-translational modifications of that sequence. In a particular embodiment, the VL comprises one, two or three CDRs selected from: a. CDR-L1, comprising the amino acid sequence SEQ ID NO: 1019, b. CDR-L2, comprising the amino acid sequence SEQ ID NO: 1561, and c. CDR-L3, comprising the amino acid sequence SEQ ID NO: 2103.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 206, and the VL amino acid sequence of SEQ ID NO: 477, optionally including post-translational modifications of those sequences.

TOVA1007

In one aspect, the present disclosure provides an antibody or antigen-binding fragment thereof comprising at least one or both variable regions selected from: a. VH comprising the amino acid sequence of SEQ ID NO: 207 and b. VL comprising the amino acid sequence of SEQ ID NO: 478.

In one aspect, the present disclosure provides an antibody or antigen-binding fragment thereof comprising at least one, two, three, four, five, or six CDRs selected from: a. CDR-H1 comprising the amino acid sequence of SEQ ID NO: 749, b. CDR-H2 comprising the amino acid sequence of SEQ ID NO: 1291, c. CDR-H3 comprising the amino acid sequence of SEQ ID NO: 1833, d. CDR-L1 comprising the amino acid sequence of SEQ ID NO: 1020, e. CDR-L2 comprising the amino acid sequence of SEQ ID NO: 1562, and f. CDR-L3 comprising the amino acid sequence of SEQ ID NO: 2104.

In one aspect, the present disclosure provides an antibody or antigen-binding fragment thereof comprising a CDR-H3 and a CDR-L3 comprising the amino acid sequence of SEQ ID NO: 2104.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 749, b. CDR-H2 comprising the amino acid sequence of SEQ ID NO: 1291, c. CDR-H3 comprising the amino acid sequence of SEQ ID NO: 1833, and a VL comprising the amino acid sequence of SEQ ID NO: 478.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1020, b. CDR-L2 comprising the amino acid sequence of SEQ ID NO: 1562, c. CDR-L3 comprising the amino acid sequence of SEQ ID NO: 2104, and a VH comprising the amino acid sequence of SEQ ID NO: 207.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 207. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 207. In some embodiments, substitutions, insertions, or deletions occur in regions outside the CDRs (e.g., in the FRs). Optionally, the antibody or antigen-binding fragment thereof comprises the VH sequence SEQ ID NO: 207, including one or more post-translational modifications of that sequence. In a particular embodiment, the VH comprises one, two or three CDRs selected from: a. CDR-H1, comprising the amino acid sequence SEQ ID NO: 749, b. CDR-H2, comprising the amino acid sequence SEQ ID NO: 1291, and c. CDR-H3, comprising the amino acid sequence SEQ ID NO: 1833.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 478. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 478. In some embodiments, the substitutions, insertions, or deletions occur in regions outside the CDRs (e.g., in the FRs). Optionally, the antibody or antigen-binding fragment thereof comprises the VL sequence SEQ ID NO: 478, including one or more post-translational modifications of that sequence. In a particular embodiment, the VL comprises one, two or three CDRs selected from: a. CDR-L1, comprising the amino acid sequence SEQ ID NO: 1020, b. CDR-L2, comprising the amino acid sequence SEQ ID NO: 1562, and c. CDR-L3, comprising the amino acid sequence SEQ ID NO: 2104.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 207, and the VL amino acid sequence of SEQ ID NO: 478, optionally including post-translational modifications of those sequences.

TOVA1008

In one aspect, the present disclosure provides an antibody or antigen-binding fragment thereof comprising at least one or both variable regions selected from: a. VH comprising the amino acid sequence of SEQ ID NO: 208 and b. VL comprising the amino acid sequence of SEQ ID NO: 479.

In one aspect, the present disclosure provides an antibody or antigen-binding fragment thereof comprising at least one, two, three, four, five, or six CDRs selected from: a. CDR-H1 comprising the amino acid sequence of SEQ ID NO: 750, b. CDR-H2 comprising the amino acid sequence of SEQ ID NO: 1292, c. CDR-H3 comprising the amino acid sequence of SEQ ID NO: 1834, d. CDR-L1 comprising the amino acid sequence of SEQ ID NO: 1021, e. CDR-L2 comprising the amino acid sequence of SEQ ID NO: 1563, and f. CDR-L3 comprising the amino acid sequence of SEQ ID NO: 2105.

In one aspect, the present disclosure provides an antibody or antigen-binding fragment thereof comprising a CDR-H3 comprising the amino acid sequence of SEQ ID NO: 1834, and a CDR-L3 comprising the amino acid sequence of SEQ ID NO: 2105.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 750, b. CDR-H2 comprising the amino acid sequence of SEQ ID NO: 1292, c. CDR-H3 comprising the amino acid sequence of SEQ ID NO: 1834, and a VL comprising the amino acid sequence of SEQ ID NO: 479.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1021, b. CDR-L2 comprising the amino acid sequence of SEQ ID NO: 1563, c. CDR-L3 comprising the amino acid sequence of SEQ ID NO: 2105, and a VH comprising the amino acid sequence of SEQ ID NO: 208.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 208. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 208. In some embodiments, substitutions, insertions, or deletions occur in regions outside the CDRs (e.g., in the FRs). Optionally, the antibody or antigen-binding fragment thereof comprises the VH sequence SEQ ID NO: 208, including one or more post-translational modifications of that sequence. In a particular embodiment, the VH comprises one, two or three CDRs selected from: a. CDR-H1, comprising the amino acid sequence SEQ ID NO: 750, b. CDR-H2, comprising the amino acid sequence SEQ ID NO: 1292, and c. CDR-H3, comprising the amino acid sequence SEQ ID NO: 1834.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 479. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 479. In some embodiments, the substitutions, insertions, or deletions occur in regions outside the CDRs (e.g., in the FRs). Optionally, the antibody or antigen-binding fragment thereof comprises the VL sequence SEQ ID NO: 479, including one or more post-translational modifications of that sequence. In a particular embodiment, the VL comprises one, two or three CDRs selected from: a. CDR-L1, comprising the amino acid sequence SEQ ID NO: 1021, b. CDR-L2, comprising the amino acid sequence SEQ ID NO: 1563, and c. CDR-L3, comprising the amino acid sequence SEQ ID NO: 2105.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 208, and the VL amino acid sequence of SEQ ID NO: 479, optionally including post-translational modifications of those sequences.

TPAN1001

In one aspect, the present disclosure provides an antibody or antigen-binding fragment thereof comprising at least one or both variable regions selected from: a. VH comprising the amino acid sequence of SEQ ID NO: 209 and b. VL comprising the amino acid sequence of SEQ ID NO: 480.

In one aspect, the present disclosure provides an antibody or antigen-binding fragment thereof comprising at least one, two, three, four, five, or six CDRs selected from: a. CDR-H1 comprising the amino acid sequence of SEQ ID NO: 751, b. CDR-H2 comprising the amino acid sequence of SEQ ID NO: 1293, c. CDR-H3 comprising the amino acid sequence of SEQ ID NO: 1835, d. CDR-L1 comprising the amino acid sequence of SEQ ID NO: 1022, e. CDR-L2 comprising the amino acid sequence of SEQ ID NO: 1564, and f. CDR-L3 comprising the amino acid sequence of SEQ ID NO: 2106.

In one aspect, the present disclosure provides an antibody or antigen-binding fragment thereof comprising a CDR-H3 comprising the amino acid sequence of SEQ ID NO: 1835, and a CDR-L3 comprising the amino acid sequence of SEQ ID NO: 2106.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 751, b. CDR-H2 comprising the amino acid sequence of SEQ ID NO: 1293, c. CDR-H3 comprising the amino acid sequence of SEQ ID NO: 1835, and a VL comprising the amino acid sequence of SEQ ID NO: 480.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1022, b. CDR-L2 comprising the amino acid sequence of SEQ ID NO: 1564, c. CDR-L3 comprising the amino acid sequence of SEQ ID NO: 2106, and a VH comprising the amino acid sequence of SEQ ID NO: 209.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 209. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 209. In some embodiments, substitutions, insertions, or deletions occur in regions outside the CDRs (e.g., in the FRs). Optionally, the antibody or antigen-binding fragment thereof comprises the VH sequence SEQ ID NO: 209, including one or more post-translational modifications of that sequence. In a particular embodiment, the VH comprises one, two or three CDRs selected from: a. CDR-H1, comprising the amino acid sequence SEQ ID NO: 751, b. CDR-H2, comprising the amino acid sequence SEQ ID NO: 1293, and c. CDR-H3, comprising the amino acid sequence SEQ ID NO: 1835.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 480. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 480. In some embodiments, the substitutions, insertions, or deletions occur in regions outside the CDRs (e.g., in the FRs). Optionally, the antibody or antigen-binding fragment thereof comprises the VL sequence SEQ ID NO: 480, including one or more post-translational modifications of that sequence. In a particular embodiment, the VL comprises one, two or three CDRs selected from: a. CDR-L1, comprising the amino acid sequence SEQ ID NO: 1022, b. CDR-L2, comprising the amino acid sequence SEQ ID NO: 1564, and c. CDR-L3, comprising the amino acid sequence SEQ ID NO: 2106.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 209, and the VL amino acid sequence of SEQ ID NO: 480, optionally including post-translational modifications of those sequences.

TPAN1002

In one aspect, the present disclosure provides an antibody or antigen-binding fragment thereof comprising at least one or both variable regions selected from: a. VH comprising the amino acid sequence of SEQ ID NO: 210 and b. VL comprising the amino acid sequence of SEQ ID NO: 481.

In one aspect, the present disclosure provides an antibody or antigen-binding fragment thereof comprising at least one, two, three, four, five, or six CDRs selected from: a. CDR-H1 comprising the amino acid sequence of SEQ ID NO: 752, b. CDR-H2 comprising the amino acid sequence of SEQ ID NO: 1294, c. CDR-H3 comprising the amino acid sequence of SEQ ID NO: 1836, d. CDR-L1 comprising the amino acid sequence of SEQ ID NO: 1023, e. CDR-L2 comprising the amino acid sequence of SEQ ID NO: 1565, and f. CDR-L3 comprising the amino acid sequence of SEQ ID NO: 2107.

In one aspect, the present disclosure provides an antibody or antigen-binding fragment thereof comprising a CDR-H3 comprising the amino acid sequence of SEQ ID NO: 1836, and a CDR-L3 comprising the amino acid sequence of SEQ ID NO: 2107.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 752, b. CDR-H2 comprising the amino acid sequence of SEQ ID NO: 1294, c. CDR-H3 comprising the amino acid sequence of SEQ ID NO: 1836, and a VL comprising the amino acid sequence of SEQ ID NO: 481.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1023, b. CDR-L2 comprising the amino acid sequence of SEQ ID NO: 1565, c. CDR-L3 comprising the amino acid sequence of SEQ ID NO: 2107, and a VH comprising the amino acid sequence of SEQ ID NO: 210.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 210. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 210. In some embodiments, substitutions, insertions, or deletions occur in regions outside the CDRs (e.g., in the FRs). Optionally, the antibody or antigen-binding fragment thereof comprises the VH sequence SEQ ID NO: 210, including one or more post-translational modifications of that sequence. In a particular embodiment, the VH comprises one, two or three CDRs selected from: a. CDR-H1, comprising the amino acid sequence SEQ ID NO: 752, b. CDR-H2, comprising the amino acid sequence SEQ ID NO: 1294, and c. CDR-H3, comprising the amino acid sequence SEQ ID NO: 1836.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 481. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 481. In some embodiments, the substitutions, insertions, or deletions occur in regions outside the CDRs (e.g., in the FRs). Optionally, the antibody or antigen-binding fragment thereof comprises the VL sequence SEQ ID NO: 481, including one or more post-translational modifications of that sequence. In a particular embodiment, the VL comprises one, two or three CDRs selected from: a. CDR-L1, comprising the amino acid sequence SEQ ID NO: 1023, b. CDR-L2, comprising the amino acid sequence SEQ ID NO: 1565, and c. CDR-L3, comprising the amino acid sequence SEQ ID NO: 2107.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 210, and the VL amino acid sequence of SEQ ID NO: 481, optionally including post-translational modifications of those sequences.

TPAN1003

In one aspect, the present disclosure provides an antibody or antigen-binding fragment thereof comprising at least one or both variable regions selected from: a. VH comprising the amino acid sequence of SEQ ID NO: 211 and b. VL comprising the amino acid sequence of SEQ ID NO: 482.

In one aspect, the present disclosure provides an antibody or antigen-binding fragment thereof comprising at least one, two, three, four, five, or six CDRs selected from: a. CDR-H1 comprising the amino acid sequence of SEQ ID NO: 753, b. CDR-H2 comprising the amino acid sequence of SEQ ID NO: 1295, c. CDR-H3 comprising the amino acid sequence of SEQ ID NO: 1837, d. CDR-L1 comprising the amino acid sequence of SEQ ID NO: 1024, e. CDR-L2 comprising the amino acid sequence of SEQ ID NO: 1566, and f. CDR-L3 comprising the amino acid sequence of SEQ ID NO: 2108.

In one aspect, the present disclosure provides an antibody or antigen-binding fragment thereof comprising a CDR-H3 comprising the amino acid sequence of SEQ ID NO: 1837, and a CDR-L3 comprising the amino acid sequence of SEQ ID NO: 2108.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 753, b. CDR-H2 comprising the amino acid sequence of SEQ ID NO: 1295, c. CDR-H3 comprising the amino acid sequence of SEQ ID NO: 1837, and a VL comprising the amino acid sequence of SEQ ID NO: 482.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1024, b. CDR-L2 comprising the amino acid sequence of SEQ ID NO: 1566, c. CDR-L3 comprising the amino acid sequence of SEQ ID NO: 2108, and a VH comprising the amino acid sequence of SEQ ID NO: 211.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 211. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 211. In some embodiments, substitutions, insertions, or deletions occur in regions outside the CDRs (e.g., in the FRs). Optionally, the antibody or antigen-binding fragment thereof comprises the VH sequence SEQ ID NO: 211, including one or more post-translational modifications of that sequence. In a particular embodiment, the VH comprises one, two or three CDRs selected from: a. CDR-H1, comprising the amino acid sequence SEQ ID NO: 753, b. CDR-H2, comprising the amino acid sequence SEQ ID NO: 1295, and c. CDR-H3, comprising the amino acid sequence SEQ ID NO: 1837.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 482. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 482. In some embodiments, the substitutions, insertions, or deletions occur in regions outside the CDRs (e.g., in the FRs). Optionally, the antibody or antigen-binding fragment thereof comprises the VL sequence SEQ ID NO: 482, including one or more post-translational modifications of that sequence. In a particular embodiment, the VL comprises one, two or three CDRs selected from: a. CDR-L1, comprising the amino acid sequence SEQ ID NO: 1024, b. CDR-L2, comprising the amino acid sequence SEQ ID NO: 1566, and c. CDR-L3, comprising the amino acid sequence SEQ ID NO: 2108.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 211, and the VL amino acid sequence of SEQ ID NO: 482, optionally including post-translational modifications of those sequences.

TPAN1004

In one aspect, the present disclosure provides an antibody or antigen-binding fragment thereof comprising at least one or both variable regions selected from: a. VH comprising the amino acid sequence of SEQ ID NO: 212 and b. VL comprising the amino acid sequence of SEQ ID NO: 483.

In one aspect, the present disclosure provides an antibody or antigen-binding fragment thereof comprising at least one, two, three, four, five, or six CDRs selected from: a. CDR-H1 comprising the amino acid sequence of SEQ ID NO: 754, b. CDR-H2 comprising the amino acid sequence of SEQ ID NO: 1296, c. CDR-H3 comprising the amino acid sequence of SEQ ID NO: 1838, d. CDR-L1 comprising the amino acid sequence of SEQ ID NO: 1025, e. CDR-L2 comprising the amino acid sequence of SEQ ID NO: 1567, and f. CDR-L3 comprising the amino acid sequence of SEQ ID NO: 2109.

In one aspect, the present disclosure provides an antibody or antigen-binding fragment thereof comprising a CDR-H3 comprising the amino acid sequence of SEQ ID NO: 1838, and a CDR-L3 comprising the amino acid sequence of SEQ ID NO: 2109.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 754, b. CDR-H2 comprising the amino acid sequence of SEQ ID NO: 1296, c. CDR-H3 comprising the amino acid sequence of SEQ ID NO: 1838, and a VL comprising the amino acid sequence of SEQ ID NO: 483.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1025, b. CDR-L2 comprising the amino acid sequence of SEQ ID NO: 1567, c. CDR-L3 comprising the amino acid sequence of SEQ ID NO: 2109, and a VH comprising the amino acid sequence of SEQ ID NO: 212.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 212. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 212. In some embodiments, substitutions, insertions, or deletions occur in regions outside the CDRs (e.g., in the FRs). Optionally, the antibody or antigen-binding fragment thereof comprises the VH sequence SEQ ID NO: 212, including one or more post-translational modifications of that sequence. In a particular embodiment, the VH comprises one, two or three CDRs selected from: a. CDR-H1, comprising the amino acid sequence SEQ ID NO: 754, b. CDR-H2, comprising the amino acid sequence SEQ ID NO: 1296, and c. CDR-H3, comprising the amino acid sequence SEQ ID NO: 1838.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 483. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 483. In some embodiments, the substitutions, insertions, or deletions occur in regions outside the CDRs (e.g., in the FRs). Optionally, the antibody or antigen-binding fragment thereof comprises the VL sequence SEQ ID NO: 483, including one or more post-translational modifications of that sequence. In a particular embodiment, the VL comprises one, two or three CDRs selected from: a. CDR-L1, comprising the amino acid sequence SEQ ID NO: 1025, b. CDR-L2, comprising the amino acid sequence SEQ ID NO: 1567, and c. CDR-L3, comprising the amino acid sequence SEQ ID NO: 2109.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 212, and the VL amino acid sequence of SEQ ID NO: 483, optionally including post-translational modifications of those sequences.
TPAN1005

In one aspect, the present disclosure provides an antibody or antigen-binding fragment thereof comprising at least one or both variable regions selected from: a. VH comprising the amino acid sequence of SEQ ID NO: 213 and b. VL comprising the amino acid sequence of SEQ ID NO: 484.

In one aspect, the present disclosure provides an antibody or antigen-binding fragment thereof comprising at least one, two, three, four, five, or six CDRs selected from: a. CDR-H1 comprising the amino acid sequence of SEQ ID NO: 755, b. CDR-H2 comprising the amino acid sequence of SEQ ID NO: 1297, c. CDR-H3 comprising the amino acid sequence of SEQ ID NO: 1839, d. CDR-L1 comprising the amino acid sequence of SEQ ID NO: 1026, e. CDR-L2 comprising the amino acid sequence of SEQ ID NO: 1568, and f. CDR-L3 comprising the amino acid sequence of SEQ ID NO: 2110.

In one aspect, the present disclosure provides an antibody or antigen-binding fragment thereof comprising a CDR-H3 comprising the amino acid sequence of SEQ ID NO: 1839, and a CDR-L3 comprising the amino acid sequence of SEQ ID NO: 2110.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 755, b. CDR-H2 comprising the amino acid sequence of SEQ ID NO: 1297, c. CDR-H3 comprising the amino acid sequence of SEQ ID NO: 1839, and a VL comprising the amino acid sequence of SEQ ID NO: 484.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1026, b. CDR-L2 comprising the amino acid sequence of SEQ ID NO: 1568, c. CDR-L3 comprising the amino acid sequence of SEQ ID NO: 2110, and a VH comprising the amino acid sequence of SEQ ID NO: 213.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 213. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 213. In some embodiments, substitutions, insertions, or deletions occur in regions outside the CDRs (e.g., in the FRs). Optionally, the antibody or antigen-binding fragment thereof comprises the VH sequence SEQ ID NO: 213, including one or more post-translational modifications of that sequence. In a particular embodiment, the VH comprises one, two or three CDRs selected from: a. CDR-H1, comprising the amino acid sequence SEQ ID NO: 755, b. CDR-H2, comprising the amino acid sequence SEQ ID NO: 1297, and c. CDR-H3, comprising the amino acid sequence SEQ ID NO: 1839.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 484. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 484. In some embodiments, the substitutions, insertions, or deletions occur in regions outside the CDRs (e.g., in the FRs). Optionally, the antibody or antigen-binding fragment thereof comprises the VL sequence SEQ ID NO: 484, including one or more post-translational modifications of that sequence. In a particular embodiment, the VL comprises one, two or three CDRs selected from: a. CDR-L1, comprising the amino acid sequence SEQ ID NO: 1026, b. CDR-L2, comprising the amino acid sequence SEQ ID NO: 1568, and c. CDR-L3, comprising the amino acid sequence SEQ ID NO: 2110.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 213, and the VL amino acid sequence of SEQ ID NO: 484, optionally including post-translational modifications of those sequences.

TPAN1006

In one aspect, the present disclosure provides an antibody or antigen-binding fragment thereof comprising at least one or both variable regions selected from: a. VH comprising the amino acid sequence of SEQ ID NO: 214 and b. VL comprising the amino acid sequence of SEQ ID NO: 485.

In one aspect, the present disclosure provides an antibody or antigen-binding fragment thereof comprising at least one, two, three, four, five, or six CDRs selected from: a. CDR-H1 comprising the amino acid sequence of SEQ ID NO: 756, b. CDR-H2 comprising the amino acid sequence of SEQ ID NO: 1298, c. CDR-H3 comprising the amino acid sequence of SEQ ID NO: 1840, d. CDR-L1 comprising the amino acid sequence of SEQ ID NO: 1027, e. CDR-L2 comprising the amino acid sequence of SEQ ID NO: 1569, and f. CDR-L3 comprising the amino acid sequence of SEQ ID NO: 2111.

In one aspect, the present disclosure provides an antibody or antigen-binding fragment thereof comprising a CDR-H3 comprising the amino acid sequence of SEQ ID NO: 1840, and a CDR-L3 comprising the amino acid sequence of SEQ ID NO: 2111.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 756, b. CDR-H2 comprising the amino acid sequence of SEQ ID NO: 1298, c. CDR-H3 comprising the amino acid sequence of SEQ ID NO: 1840, and a VL comprising the amino acid sequence of SEQ ID NO: 485.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1027, b. CDR-L2 comprising the amino acid sequence of SEQ ID NO: 1569, c. CDR-L3 comprising the amino acid sequence of SEQ ID NO: 2111, and a VH comprising the amino acid sequence of SEQ ID NO: 214.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 214. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 214. In some embodiments, substitutions, insertions, or deletions occur in regions outside the CDRs (e.g., in the FRs). Optionally, the antibody or antigen-binding fragment thereof comprises the VH sequence SEQ ID NO: 214, including one or more post-translational modifications of that sequence. In a particular embodiment, the VH comprises one, two or three CDRs selected from: a. CDR-H1, comprising the amino acid sequence SEQ ID NO: 756, b. CDR-H2, comprising the amino acid sequence SEQ ID NO: 1298, and c. CDR-H3, comprising the amino acid sequence SEQ ID NO: 1840.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 485. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 485. In some embodiments, the substitutions, insertions, or deletions occur in regions outside the CDRs (e.g., in the FRs). Optionally, the antibody or antigen-binding fragment thereof comprises the VL sequence SEQ ID NO: 485, including one or more post-translational modifications of that sequence. In a particular embodiment, the VL comprises one, two or three CDRs selected from: a. CDR-L1, comprising the amino acid sequence SEQ ID NO: 1027, b. CDR-L2, comprising the amino acid sequence SEQ ID NO: 1569, and c. CDR-L3, comprising the amino acid sequence SEQ ID NO: 2111.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 214, and the VL amino acid sequence of SEQ ID NO: 485, optionally including post-translational modifications of those sequences.

TPAN1007

In one aspect, the present disclosure provides an antibody or antigen-binding fragment thereof comprising at least one or both variable regions selected from: a. VH comprising the amino acid sequence of SEQ ID NO: 215 and b. VL comprising the amino acid sequence of SEQ ID NO: 486.

In one aspect, the present disclosure provides an antibody or antigen-binding fragment thereof comprising at least one, two, three, four, five, or six CDRs selected from: a. CDR-H1 comprising the amino acid sequence of SEQ ID NO: 757, b. CDR-H2 comprising the amino acid sequence of SEQ ID NO: 1299, c. CDR-H3 comprising the amino acid sequence of SEQ ID NO: 1841, d. CDR-L1 comprising the amino acid sequence of SEQ ID NO: 1028, e. CDR-L2 comprising the amino acid sequence of SEQ ID NO: 1570, and f. CDR-L3 comprising the amino acid sequence of SEQ ID NO: 2112.

In one aspect, the present disclosure provides an antibody or antigen-binding fragment thereof comprising a CDR-H3 comprising the amino acid sequence of SEQ ID NO: 1841, and a CDR-L3 comprising the amino acid sequence of SEQ ID NO: 2112.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 757, b. CDR-H2 comprising the amino acid sequence of SEQ ID NO: 1299, c. CDR-H3 comprising the amino acid sequence of SEQ ID NO: 1841, and a VL comprising the amino acid sequence of SEQ ID NO: 486.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1028, b. CDR-L2 comprising the amino acid sequence of SEQ ID NO: 1570, c. CDR-L3 comprising the amino acid sequence of SEQ ID NO: 2112, and a VH comprising the amino acid sequence of SEQ ID NO: 215.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 215. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 215. In some embodiments, substitutions, insertions, or deletions occur in regions outside the CDRs (e.g., in the FRs). Optionally, the antibody or antigen-binding fragment thereof comprises the VH sequence SEQ ID NO: 215, including one or more post-translational modifications of that sequence. In a particular embodiment, the VH comprises one, two or three CDRs selected from: a. CDR-H1, comprising the amino acid sequence SEQ ID NO: 757, b. CDR-H2, comprising the amino acid sequence SEQ ID NO: 1299, and c. CDR-H3, comprising the amino acid sequence SEQ ID NO: 1841.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 486. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 486. In some embodiments, the substitutions, insertions, or deletions occur in regions outside the CDRs (e.g., in the FRs). Optionally, the antibody or antigen-binding fragment thereof comprises the VL sequence SEQ ID NO: 486, including one or more post-translational modifications of that sequence. In a particular embodiment, the VL comprises one, two or three CDRs selected from: a. CDR-L1, comprising the amino acid sequence SEQ ID NO: 1028, b. CDR-L2, comprising the amino acid sequence SEQ ID NO: 1570, and c. CDR-L3, comprising the amino acid sequence SEQ ID NO: 2112.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 215, and the VL amino acid sequence of SEQ ID NO: 486, optionally including post-translational modifications of those sequences.

TPHE1001

In one aspect, the present disclosure provides an antibody or antigen-binding fragment thereof comprising at least one or both variable regions selected from: a. VH comprising the amino acid sequence of SEQ ID NO: 216 and b. VL comprising the amino acid sequence of SEQ ID NO: 487.

In one aspect, the present disclosure provides an antibody or antigen-binding fragment thereof comprising at least one, two, three, four, five, or six CDRs selected from: a. CDR-H1 comprising the amino acid sequence of SEQ ID NO: 758, b. CDR-H2 comprising the amino acid sequence of SEQ ID NO: 1300, c. CDR-H3 comprising the amino acid sequence of SEQ ID NO: 1842, d. CDR-L1 comprising the amino acid sequence of SEQ ID NO: 1029, e. CDR-L2 comprising the amino acid sequence of SEQ ID NO: 1571, and f. CDR-L3 comprising the amino acid sequence of SEQ ID NO: 2113.

In one aspect, the present disclosure provides an antibody or antigen-binding fragment thereof comprising a CDR-H3 comprising the amino acid sequence of SEQ ID NO: 1842, and a CDR-L3 comprising the amino acid sequence of SEQ ID NO: 2113.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 758, b. CDR-H2 comprising the amino acid sequence of SEQ ID NO: 1300, c. CDR-H3 comprising the amino acid sequence of SEQ ID NO: 1842, and a VL comprising the amino acid sequence of SEQ ID NO: 487.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1029, b. CDR-L2 comprising the amino acid sequence of SEQ ID NO: 1571, c. CDR-L3 comprising the amino acid sequence of SEQ ID NO: 2113, and a VH comprising the amino acid sequence of SEQ ID NO: 216.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 216. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 216. In some embodiments, substitutions, insertions, or deletions occur in regions outside the CDRs (e.g., in the FRs). Optionally, the antibody or antigen-binding fragment thereof comprises the VH sequence SEQ ID NO: 216, including one or more post-translational modifications of that sequence. In a particular embodiment, the VH comprises one, two or three CDRs selected from: a. CDR-H1, comprising the amino acid sequence SEQ ID NO: 758, b. CDR-H2, comprising the amino acid sequence SEQ ID NO: 1300, and c. CDR-H3, comprising the amino acid sequence SEQ ID NO: 1842.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 487. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 487. In some embodiments, the substitutions, antigen-binding fragment thereof comprises the VL sequence SEQ ID NO: 487, including one or more post-translational modifications of that sequence. In a particular embodiment, the VL comprises one, two or three CDRs selected from: a. CDR-L1, comprising the amino acid sequence SEQ ID NO: 1029, b. CDR-L2, comprising the amino acid sequence SEQ ID NO: 1571, and c. CDR-L3, comprising the amino acid sequence SEQ ID NO: 2113.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 216, and the VL amino acid sequence of SEQ ID NO: 487, optionally including post-translational modifications of those sequences.

TPRO1001

In one aspect, the present disclosure provides an antibody or antigen-binding fragment thereof comprising at least one or both variable regions selected from: a. VH comprising the amino acid sequence of SEQ ID NO: 217 and b. VL comprising the amino acid sequence of SEQ ID NO: 488.

In one aspect, the present disclosure provides an antibody or antigen-binding fragment thereof comprising at least one, two, three, four, five, or six CDRs selected from: a. CDR-H1 comprising the amino acid sequence of SEQ ID NO: 759, b. CDR-H2 comprising the amino acid sequence of SEQ ID NO: 1301, c. CDR-H3 comprising the amino acid sequence of SEQ ID NO: 1843, d. CDR-L1 comprising the amino acid sequence of SEQ ID NO: 1030, e. CDR-L2 comprising the amino acid sequence of SEQ ID NO: 1572, and f. CDR-L3 comprising the amino acid sequence of SEQ ID NO: 2114.

In one aspect, the present disclosure provides an antibody or antigen-binding fragment thereof comprising a CDR-H3 comprising the amino acid sequence of SEQ ID NO: 1843, and a CDR-L3 comprising the amino acid sequence of SEQ ID NO: 2114.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 759, b. CDR-H2 comprising the amino acid sequence of SEQ ID NO: 1301, c. CDR-H3 comprising the amino acid sequence of SEQ ID NO: 1843, and a VL comprising the amino acid sequence of SEQ ID NO: 488.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1030, b. CDR-L2 comprising the amino acid sequence of SEQ ID NO: 1572, c. CDR-L3 comprising the amino acid sequence of SEQ ID NO: 2114, and a VH comprising the amino acid sequence of SEQ ID NO: 217.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 217. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 217. In some embodiments, substitutions, insertions, or deletions occur in regions outside the CDRs (e.g., in the FRs). Optionally, the antibody or antigen-binding fragment thereof comprises the VH sequence SEQ ID NO: 217, including one or more post-translational modifications of that sequence. In a particular embodiment, the VH comprises one, two or three CDRs selected from: a. CDR-H1, comprising the amino acid sequence SEQ ID NO: 759, b. CDR-H2, comprising the amino acid sequence SEQ ID NO: 1301, and c. CDR-H3, comprising the amino acid sequence SEQ ID NO: 1843.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 488. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 488. In some embodiments, the substitutions, insertions, or deletions occur in regions outside the CDRs (e.g., in the FRs). Optionally, the antibody or antigen-binding fragment thereof comprises the VL sequence SEQ ID NO: 488, including one or more post-translational modifications of that sequence. In a particular embodiment, the VL comprises one, two or three CDRs selected from: a. CDR-L1, comprising the amino acid sequence SEQ ID NO: 1030, b. CDR-L2, comprising the amino acid sequence SEQ ID NO: 1572, and c. CDR-L3, comprising the amino acid sequence SEQ ID NO: 2114.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 217, and the VL amino acid sequence of SEQ ID NO: 488, optionally including post-translational modifications of those sequences.

TPRO1002

In one aspect, the present disclosure provides an antibody or antigen-binding fragment thereof comprising at least one or both variable regions selected from: a. VH comprising the amino acid sequence of SEQ ID NO: 218 and b. VL comprising the amino acid sequence of SEQ ID NO: 489.

In one aspect, the present disclosure provides an antibody or antigen-binding fragment thereof comprising at least one, two, three, four, five, or six CDRs selected from: a. CDR-H1 comprising the amino acid sequence of SEQ ID NO: 760, b. CDR-H2 comprising the amino acid sequence of SEQ ID NO: 1302, c. CDR-H3 comprising the amino acid sequence of SEQ ID NO: 1844, d. CDR-L1 comprising the amino acid sequence of SEQ ID NO: 1031, e. CDR-L2 comprising the amino acid sequence of SEQ ID NO: 1573, f. CDR-L3 comprising the amino acid sequence of SEQ ID NO: 2115.

In one aspect, the present disclosure provides an antibody or antigen-binding fragment thereof comprising a CDR-H3 comprising the amino acid sequence of SEQ ID NO: 1844, and a CDR-L3 comprising the amino acid sequence of SEQ ID NO: 2115.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 760, b. CDR-H2 comprising the amino acid sequence of SEQ ID NO: 1302, c. CDR-H3 comprising the amino acid sequence of SEQ ID NO: 1844, and d. VL comprising the amino acid sequence of SEQ ID NO: 489.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1031, b. CDR-L2 comprising the amino acid sequence of SEQ ID NO: 1573, c. CDR-L3 comprising the amino acid sequence of SEQ ID NO: 2115, and a VH comprising the amino acid sequence of SEQ ID NO: 218.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 218. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 218. In some embodiments, substitutions, insertions, or deletions occur in regions outside the CDRs (e.g., in the FRs). Optionally, the antibody or antigen-binding fragment thereof comprises the VH sequence SEQ ID NO: 218, including one or more post-translational modifications of that sequence. In a particular embodiment, the VH comprises one, two or three CDRs selected from: a. CDR-H1, comprising the amino acid sequence SEQ ID NO: 760, b. CDR-H2, comprising the amino acid sequence SEQ ID NO: 1302, and c. CDR-H3, comprising the amino acid sequence SEQ ID NO: 1844.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 489. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 489. In some embodiments, the substitutions, insertions, or deletions occur in regions outside the CDRs (e.g., in the FRs). Optionally, the antibody or antigen-binding fragment thereof comprises the VL sequence SEQ ID NO: 489, including one or more post-translational modifications of that sequence. In a particular embodiment, the VL comprises one, two or three CDRs selected from: a. CDR-L1, comprising the amino acid sequence SEQ ID NO: 1031, b. CDR-L2, comprising the amino acid sequence SEQ ID NO: 1573, and c. CDR-L3, comprising the amino acid sequence SEQ ID NO: 2115.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 218, and the VL amino acid sequence of SEQ ID NO: 489, optionally including post-translational modifications of those sequences.
TPRO1003

In one aspect, the present disclosure provides an antibody or antigen-binding fragment thereof comprising at least one or both variable regions selected from: a. VH comprising the amino acid sequence of SEQ ID NO: 219 and b. VL comprising the amino acid sequence of SEQ ID NO: 490.

In one aspect, the present disclosure provides an antibody or antigen-binding fragment thereof comprising at least one, two, three, four, five, or six CDRs selected from: a. CDR-H1 comprising the amino acid sequence of SEQ ID NO: 761, b. CDR-H2 comprising the amino acid sequence of SEQ ID NO: 1303, c. CDR-H3 comprising the amino acid sequence of SEQ ID NO: 1845, d. CDR-L1 comprising the amino acid sequence of SEQ ID NO: 1032, e. CDR-L2 comprising the amino acid sequence of SEQ ID NO: 1574, and f. CDR-L3 comprising the amino acid sequence of SEQ ID NO: 2116.

In one aspect, the present disclosure provides an antibody or antigen-binding fragment thereof comprising a CDR-H3 comprising the amino acid sequence of SEQ ID NO: 1845, and a CDR-L3 comprising the amino acid sequence of SEQ ID NO: 2116.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 761, b. CDR-H2 comprising the amino acid sequence of SEQ ID NO: 1303, c. CDR-H3 comprising the amino acid sequence of SEQ ID NO: 1845, and a VL comprising the amino acid sequence of SEQ ID NO: 490.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1032, b. CDR-L2 comprising the amino acid sequence of SEQ ID NO: 1574, c. CDR-L3 comprising the amino acid sequence of SEQ ID NO: 2116, and a VH comprising the amino acid sequence of SEQ ID NO: 219.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 219. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 219. In some embodiments, substitutions, insertions, or deletions occur in regions outside the CDRs (e.g., in the FRs). Optionally, the antibody or antigen-binding fragment thereof comprises the VH sequence SEQ ID NO: 219, including one or more post-translational modifications of that sequence. In a particular embodiment, the VH comprises one, two or three CDRs selected from: a. CDR-H1, comprising the amino acid sequence SEQ ID NO: 761, b. CDR-H2, comprising the amino acid sequence SEQ ID NO: 1303, and c. CDR-H3, comprising the amino acid sequence SEQ ID NO: 1845.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 490. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 490. In some embodiments, the substitutions, insertions, or deletions occur in regions outside the CDRs (e.g., in the FRs). Optionally, the antibody or antigen-binding fragment thereof comprises the VL sequence SEQ ID NO: 490, including one or more post-translational modifications of that sequence. In a particular embodiment, the VL comprises one, two or three CDRs selected from: a. CDR-L1, comprising the amino acid sequence SEQ ID NO: 1032, b. CDR-L2, comprising the amino acid sequence SEQ ID NO: 1574, and c. CDR-L3, comprising the amino acid sequence SEQ ID NO: 2116.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 219, and the VL amino acid sequence of SEQ ID NO: 490, optionally including post-translational modifications of those sequences.
TREC1001

In one aspect, the present disclosure provides an antibody or antigen-binding fragment thereof comprising at least one or both variable regions selected from: a. VH comprising the amino acid sequence of SEQ ID NO: 220 and b. VL comprising the amino acid sequence of SEQ ID NO: 491.

In one aspect, the present disclosure provides an antibody or antigen-binding fragment thereof comprising at least one, two, three, four, five, or six CDRs selected from: a. CDR-H1 comprising the amino acid sequence of SEQ ID NO: 762, b. CDR-H2 comprising the amino acid sequence of SEQ ID NO: 1304, c. CDR-H3 comprising the amino acid sequence of SEQ ID NO: 1846, d. CDR-L1 comprising the amino acid sequence of SEQ ID NO: 1033, e. CDR-L2 comprising the amino acid sequence of SEQ ID NO: 1575, and f. CDR-L3 comprising the amino acid sequence of SEQ ID NO: 2117.

In one aspect, the present disclosure provides an antibody or antigen-binding fragment thereof comprising a CDR-H3 comprising the amino acid sequence of SEQ ID NO: 1846, and a CDR-L3 comprising the amino acid sequence of SEQ ID NO: 2117.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 762, b. CDR-H2 comprising the amino acid sequence of SEQ ID NO: 1304, c. CDR-H3 comprising the amino acid sequence of SEQ ID NO: 1846, and a VL comprising the amino acid sequence of SEQ ID NO: 491.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1033, b. CDR-L2 comprising the amino acid sequence of SEQ ID NO: 1575, c. CDR-L3 comprising the amino acid sequence of SEQ ID NO: 2117, and a VH comprising the amino acid sequence of SEQ ID NO: 220.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 220. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 220. In some embodiments, substitutions, insertions, or deletions occur in regions outside the CDRs (e.g., in the FRs). Optionally, the antibody or antigen-binding fragment thereof comprises the VH sequence SEQ ID NO: 220, including one or more post-translational modifications of that sequence. In a particular embodiment, the VH comprises one, two or three CDRs selected from: a. CDR-H1, comprising the amino acid sequence SEQ ID NO: 762, b. CDR-H2, comprising the amino acid sequence SEQ ID NO: 1304, and c. CDR-H3, comprising the amino acid sequence SEQ ID NO: 1846.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 491. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 491. In some embodiments, the substitutions, insertions, or deletions occur in regions outside the CDRs (e.g., in the FRs). Optionally, the antibody or antigen-binding fragment thereof comprises the VL sequence SEQ ID NO: 491, including one or more post-translational modifications of that sequence. In a particular embodiment, the VL comprises one, two or three CDRs selected from: a. CDR-L1, comprising the amino acid sequence SEQ ID NO: 1033, b. CDR-L2, comprising the amino acid sequence SEQ ID NO: 1575, and c. CDR-L3, comprising the amino acid sequence SEQ ID NO: 2117.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 220, and the VL amino acid sequence of SEQ ID NO: 491, optionally including post-translational modifications of those sequences.

TREC1002

In one aspect, the present disclosure provides an antibody or antigen-binding fragment thereof comprising at least one or both variable regions selected from: a. VH comprising the amino acid sequence of SEQ ID NO: 221 and b. VL comprising the amino acid sequence of SEQ ID NO: 492.

In one aspect, the present disclosure provides an antibody or antigen-binding fragment thereof comprising at least one, two, three, four, five, or six CDRs selected from: a. CDR-H1 comprising the amino acid sequence of SEQ ID NO: 763, b. CDR-H2 comprising the amino acid sequence of SEQ ID NO: 1305, c. CDR-H3 comprising the amino acid sequence of SEQ ID NO: 1847, d. CDR-L1 comprising the amino acid sequence of SEQ ID NO: 1034, e. CDR-L2 comprising the amino acid sequence of SEQ ID NO: 1576, and f. CDR-L3 comprising the amino acid sequence of SEQ ID NO: 2118.

In one aspect, the present disclosure provides an antibody or antigen-binding fragment thereof comprising a CDR-H3 comprising the amino acid sequence of SEQ ID NO: 1847, and a CDR-L3 comprising the amino acid sequence of SEQ ID NO: 2118.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 763, b. CDR-H2 comprising the amino acid sequence of SEQ ID NO: 1305, c. CDR-H3 comprising the amino acid sequence of SEQ ID NO: 1847, and d. VL comprising the amino acid sequence of SEQ ID NO: 492.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1034, b. CDR-L2 comprising the amino acid sequence of SEQ ID NO: 1576, c. CDR-L3 comprising the amino acid sequence of SEQ ID NO: 2118, and a VH comprising the amino acid sequence of SEQ ID NO: 221.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 221. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 221. In some embodiments, substitutions, insertions, or deletions occur in regions outside the CDRs (e.g., in the FRs). Optionally, the antibody or antigen-binding fragment thereof comprises the VH sequence SEQ ID NO: 221, including one or more post-translational modifications of that sequence. In a particular embodiment, the VH comprises one, two or three CDRs selected from: a. CDR-H1, comprising the amino acid sequence SEQ ID NO: 763, b. CDR-H2, comprising the amino acid sequence SEQ ID NO: 1305, and c. CDR-H3, comprising the amino acid sequence SEQ ID NO: 1847.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 492. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 492. In some embodiments, the substitutions, insertions, or deletions occur in regions outside the CDRs (e.g., in the FRs). Optionally, the antibody or antigen-binding fragment thereof comprises the VL sequence SEQ ID NO: 492, including one or more post-translational modifications of that sequence. In a particular embodiment, the VL comprises one, two or three CDRs selected from: a. CDR-L1, comprising the amino acid sequence SEQ ID NO: 1034, b. CDR-L2, comprising the amino acid sequence SEQ ID NO: 1576, and c. CDR-L3, comprising the amino acid sequence SEQ ID NO: 2118.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 221, and the VL amino acid sequence of SEQ ID NO: 492, optionally including post-translational modifications of those sequences.

TREC1003

In one aspect, the present disclosure provides an antibody or antigen-binding fragment thereof comprising at least one or both variable regions selected from: a. VH comprising the amino acid sequence of SEQ ID NO: 222 and b. VL comprising the amino acid sequence of SEQ ID NO: 493.

In one aspect, the present disclosure provides an antibody or antigen-binding fragment thereof comprising at least one, two, three, four, five, or six CDRs selected from: a. CDR-H1 comprising the amino acid sequence of SEQ ID NO: 764, b. CDR-H2 comprising the amino acid sequence of SEQ ID NO: 1306, c. CDR-H3 comprising the amino acid sequence of SEQ ID NO: 1848, d. CDR-L1 comprising the amino acid sequence of SEQ ID NO: 1035, e. CDR-L2 comprising the amino acid sequence of SEQ ID NO: 1577, and f. CDR-L3 comprising the amino acid sequence of SEQ ID NO: 2119.

In one aspect, the present disclosure provides an antibody or antigen-binding fragment thereof comprising a CDR-H3 comprising the amino acid sequence of SEQ ID NO: 1848, and a CDR-L3 comprising the amino acid sequence of SEQ ID NO: 2119.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 764, b. CDR-H2 comprising the amino acid sequence of SEQ ID NO: 1306, c. CDR-H3 comprising the amino acid sequence of SEQ ID NO: 1848, and a VL comprising the amino acid sequence of SEQ ID NO: 493.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1035, b. CDR-L2 comprising the amino acid sequence of SEQ ID NO: 1577, c. CDR-L3 comprising the amino acid sequence of SEQ ID NO: 2119, and a VH comprising the amino acid sequence of SEQ ID NO: 222.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 222. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 222. In some embodiments, substitutions, insertions, or deletions occur in regions outside the CDRs (e.g., in the FRs). Optionally, the antibody or antigen-binding fragment thereof comprises the VH sequence SEQ ID NO: 222, including one or more post-translational modifications of that sequence. In a particular embodiment, the VH comprises one, two or three CDRs selected from: a. CDR-H1, comprising the amino acid sequence SEQ ID NO: 764, b. CDR-H2, comprising the amino acid sequence SEQ ID NO: 1306, and c. CDR-H3, comprising the amino acid sequence SEQ ID NO: 1848.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 493. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 493. In some embodiments, the substitutions, insertions, or deletions occur in regions outside the CDRs (e.g., in the FRs). Optionally, the antibody or antigen-binding fragment thereof comprises the VL sequence SEQ ID NO: 493, including one or more post-translational modifications of that sequence. In a particular embodiment, the VL comprises one, two or three CDRs selected from: a. CDR-L1, comprising the amino acid sequence SEQ ID NO: 1035, b. CDR-L2, comprising the amino acid sequence SEQ ID NO: 1577, and c. CDR-L3, comprising the amino acid sequence SEQ ID NO: 2119.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 222, and the VL amino acid sequence of SEQ ID NO: 493, optionally including post-translational modifications of those sequences.
TSAR1001

In one aspect, the present disclosure provides an antibody or antigen-binding fragment thereof comprising at least one or both variable regions selected from: a. VH comprising the amino acid sequence of SEQ ID NO: 223 and b. VL comprising the amino acid sequence of SEQ ID NO: 494.

In one aspect, the present disclosure provides an antibody or antigen-binding fragment thereof comprising at least one, two, three, four, five, or six CDRs selected from: a. CDR-H1 comprising the amino acid sequence of SEQ ID NO: 765, b. CDR-H2 comprising the amino acid sequence of SEQ ID NO: 1307, c. CDR-H3 comprising the amino acid sequence of SEQ ID NO: 1849, d. CDR-L1 comprising the amino acid sequence of SEQ ID NO: 1036, e. CDR-L2 comprising the amino acid sequence of SEQ ID NO: 1578, and f. CDR-L3 comprising the amino acid sequence of SEQ ID NO: 2120.

In one aspect, the present disclosure provides an antibody or antigen-binding fragment thereof comprising a CDR-H3 comprising the amino acid sequence of SEQ ID NO: 1849, and a CDR-L3 comprising the amino acid sequence of SEQ ID NO: 2120.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 765, b. CDR-H2 comprising the amino acid sequence of SEQ ID NO: 1307, c. CDR-H3 comprising the amino acid sequence of SEQ ID NO: 1849, and a VL comprising the amino acid sequence of SEQ ID NO: 494.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1036, b. CDR-L2 comprising the amino acid sequence of SEQ ID NO: 1578, c. CDR-L3 comprising the amino acid sequence of SEQ ID NO: 2120, and a VH comprising the amino acid sequence of SEQ ID NO: 223.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 223. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 223. In some embodiments, substitutions, insertions, or deletions occur in regions outside the CDRs (e.g., in the FRs). Optionally, the antibody or antigen-binding fragment thereof comprises the VH sequence SEQ ID NO: 223, including one or more post-translational modifications of that sequence. In a particular embodiment, the VH comprises one, two or three CDRs selected from: a. CDR-H1, comprising the amino acid sequence SEQ ID NO: 765, b. CDR-H2, comprising the amino acid sequence SEQ ID NO: 1307, and c. CDR-H3, comprising the amino acid sequence SEQ ID NO: 1849.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 494. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 494. In some embodiments, the substitutions, insertions, or deletions occur in regions outside the CDRs (e.g., in the FRs). Optionally, the antibody or antigen-binding fragment thereof comprises the VL sequence SEQ ID NO: 494, including one or more post-translational modifications of that sequence. In a particular embodiment, the VL comprises one, two or three CDRs selected from: a. CDR-L1, comprising the amino acid sequence SEQ ID NO: 1036, b. CDR-L2, comprising the amino acid sequence SEQ ID NO: 1578, and c. CDR-L3, comprising the amino acid sequence SEQ ID NO: 2120.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 223, and the VL amino acid sequence of SEQ ID NO: 494, optionally including post-translational modifications of those sequences.

TSAR1002

In one aspect, the present disclosure provides an antibody or antigen-binding fragment thereof comprising at least one or both variable regions selected from: a. VH comprising the amino acid sequence of SEQ ID NO: 224 and b. VL comprising the amino acid sequence of SEQ ID NO: 495.

In one aspect, the present disclosure provides an antibody or antigen-binding fragment thereof comprising at least one, two, three, four, five, or six CDRs selected from: a. CDR-H1 comprising the amino acid sequence of SEQ ID NO: 766, b. CDR-H2 comprising the amino acid sequence of SEQ ID NO: 1308, c. CDR-H3 comprising the amino acid sequence of SEQ ID NO: 1850, d. CDR-L1 comprising the amino acid sequence of SEQ ID NO: 1037, e. CDR-L2 comprising the amino acid sequence of SEQ ID NO: 1579, and f. CDR-L3 comprising the amino acid sequence of SEQ ID NO: 2121.

In one aspect, the present disclosure provides an antibody or antigen-binding fragment thereof comprising a CDR-H3 comprising the amino acid sequence of SEQ ID NO: 1850, and a CDR-L3 comprising the amino acid sequence of SEQ ID NO: 2121.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 766, b. CDR-H2 comprising the amino acid sequence of SEQ ID NO: 1308, c. CDR-H3 comprising the amino acid sequence of SEQ ID NO: 1850, and a VL comprising the amino acid sequence of SEQ ID NO: 495.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1037, b. CDR-L2 comprising the amino acid sequence of SEQ ID NO: 1579, c. CDR-L3 comprising the amino acid sequence of SEQ ID NO: 2121, and a VH comprising the amino acid sequence of SEQ ID NO: 224.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 224. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 224. In some embodiments, substitutions, insertions, or deletions occur in regions outside the CDRs (e.g., in the FRs). Optionally, the antibody or antigen-binding fragment thereof comprises the VH sequence SEQ ID NO: 224, including one or more post-translational modifications of that sequence. In a particular embodiment, the VH comprises one, two or three CDRs selected from: a. CDR-H1, comprising the amino acid sequence SEQ ID NO: 766, b. CDR-H2, comprising the amino acid sequence SEQ ID NO: 1308, and c. CDR-H3, comprising the amino acid sequence SEQ ID NO: 1850.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 495. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 495. In some embodiments, the substitutions, insertions, or deletions occur in regions outside the CDRs (e.g., in the FRs). Optionally, the antibody or antigen-binding fragment thereof comprises the VL sequence SEQ ID NO: 495, including one or more post-translational modifications of that sequence. In a particular embodiment, the VL comprises one, two or three CDRs selected from: a. CDR-L1, comprising the amino acid sequence SEQ ID NO: 1037, b. CDR-L2, comprising the amino acid sequence SEQ ID NO: 1579, and c. CDR-L3, comprising the amino acid sequence SEQ ID NO: 2121.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 224, and the VL amino acid sequence of SEQ ID NO: 495, optionally including post-translational modifications of those sequences.

TSAR1003

In one aspect, the present disclosure provides an antibody or antigen-binding fragment thereof comprising at least one or both variable regions selected from: a. VH comprising the amino acid sequence of SEQ ID NO: 225 and b. VL comprising the amino acid sequence of SEQ ID NO: 496.

In one aspect, the present disclosure provides an antibody or antigen-binding fragment thereof comprising at least one, two, three, four, five, or six CDRs selected from: a. CDR-H1 comprising the amino acid sequence of SEQ ID NO: 767, b. CDR-H2 comprising the amino acid sequence of SEQ ID NO: 1309, c. CDR-H3 comprising the amino acid sequence of SEQ ID NO: 1851, d. CDR-L1 comprising the amino acid sequence of SEQ ID NO: 1038, e. CDR-L2 comprising the amino acid sequence of SEQ ID NO: 1580, and f CDR-L3 comprising the amino acid sequence of SEQ ID NO: 2122.

In one aspect, the present disclosure provides an antibody or antigen-binding fragment thereof comprising a CDR-H3 comprising the amino acid sequence of SEQ ID NO: 1851, and a CDR-L3 comprising the amino acid sequence of SEQ ID NO: 2122.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 767, b. CDR-H2 comprising the amino acid sequence of SEQ ID NO: 1309, c. CDR-H3 comprising the amino acid sequence of SEQ ID NO: 1851, and a VL comprising the amino acid sequence of SEQ ID NO: 496.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1038, b. CDR-L2 comprising the amino acid sequence of SEQ ID NO: 1580, c. CDR-L3 comprising the amino acid sequence of SEQ ID NO: 2122, and a VH comprising the amino acid sequence of SEQ ID NO: 225.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 225. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 225. In some embodiments, substitutions, insertions, or deletions occur in regions outside the CDRs (e.g., in the FRs). Optionally, the antibody or antigen-binding fragment thereof comprises the VH sequence SEQ ID NO: 225, including one or more post-translational modifications of that sequence. In a particular embodiment, the VH comprises one, two or three CDRs selected from: a. CDR-H1, comprising the amino acid sequence SEQ ID NO: 767, b. CDR-H2, comprising the amino acid sequence SEQ ID NO: 1309, and c. CDR-H3, comprising the amino acid sequence SEQ ID NO: 1851.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 496. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 496. In some embodiments, the substitutions, insertions, or deletions occur in regions outside the CDRs (e.g., in the FRs). Optionally, the antibody or antigen-binding fragment thereof comprises the VL sequence SEQ ID NO: 496, including one or more post-translational modifications of that sequence. In a particular embodiment, the VL comprises one, two or three CDRs selected from: a. CDR-L1, comprising the amino acid sequence SEQ ID NO: 1038, b. CDR-L2, comprising the amino acid sequence SEQ ID NO: 1580, and c. CDR-L3, comprising the amino acid sequence SEQ ID NO: 2122.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 225, and the VL amino acid sequence of SEQ ID NO: 496, optionally including post-translational modifications of those sequences.

TSAR1004

In one aspect, the present disclosure provides an antibody or antigen-binding fragment thereof comprising at least one or both variable regions selected from: a. VH comprising the amino acid sequence of SEQ ID NO: 226 and b. VL comprising the amino acid sequence of SEQ ID NO: 497.

In one aspect, the present disclosure provides an antibody or antigen-binding fragment thereof comprising at least one, two, three, four, five, or six CDRs selected from: a. CDR-H1 comprising the amino acid sequence of SEQ ID NO: 768, b. CDR-H2 comprising the amino acid sequence of SEQ ID NO: 1310, c. CDR-H3 comprising the amino acid sequence of SEQ ID NO: 1852, d. CDR-L1 comprising the amino acid sequence of SEQ ID NO: 1039, e. CDR-L2 comprising the amino acid sequence of SEQ ID NO: 1581, and f. CDR-L3 comprising the amino acid sequence of SEQ ID NO: 2123.

In one aspect, the present disclosure provides an antibody or antigen-binding fragment thereof comprising a CDR-H3 comprising the amino acid sequence of SEQ ID NO: 1852, and a CDR-L3 comprising the amino acid sequence of SEQ ID NO: 2123.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 768, b. CDR-H2 comprising the amino acid sequence of SEQ ID NO: 1310, c. CDR-H3 comprising the amino acid sequence of SEQ ID NO: 1852, and a VL comprising the amino acid sequence of SEQ ID NO: 497.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1039, b. CDR-L2 comprising the amino acid sequence of SEQ ID NO: 1581, c. CDR-L3 comprising the amino acid sequence of SEQ ID NO: 2123, and a VH comprising the amino acid sequence of SEQ ID NO: 226.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 226. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 226. In some embodiments, substitutions, insertions, or deletions occur in regions outside the CDRs (e.g., in the FRs). Optionally, the antibody or antigen-binding fragment thereof comprises the VH sequence SEQ ID NO: 226, including one or more post-translational modifications of that sequence. In a particular embodiment, the VH comprises one, two or three CDRs selected from: a. CDR-H1, comprising the amino acid sequence SEQ ID NO: 768, b. CDR-H2, comprising the amino acid sequence SEQ ID NO: 1310, and c. CDR-H3, comprising the amino acid sequence SEQ ID NO: 1852.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 497. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 497. In some embodiments, the substitutions, insertions, or deletions occur in regions outside the CDRs (e.g., in the FRs). Optionally, the antibody or antigen-binding fragment thereof comprises the VL sequence SEQ ID NO: 497, including one or more post-translational modifications of that sequence. In a particular embodiment, the VL comprises one, two or three CDRs selected from: a. CDR-L1, comprising the amino acid sequence SEQ ID NO: 1039, b. CDR-L2, comprising the amino acid sequence SEQ ID NO: 1581, and c. CDR-L3, comprising the amino acid sequence SEQ ID NO: 2123.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 226, and the VL amino acid sequence of SEQ ID NO: 497, optionally including post-translational modifications of those sequences.

TSAR1005

In one aspect, the present disclosure provides an antibody or antigen-binding fragment thereof comprising at least one or both variable regions selected from: a. VH comprising the amino acid sequence of SEQ ID NO: 227 and b. VL comprising the amino acid sequence of SEQ ID NO: 498.

In one aspect, the present disclosure provides an antibody or antigen-binding fragment thereof comprising at least one, two, three, four, five, or six CDRs selected from: a. CDR-H1 comprising the amino acid sequence of SEQ ID NO: 769, b. CDR-H2 comprising the amino acid sequence of SEQ ID NO: 1311, c. CDR-H3 comprising the amino acid sequence of SEQ ID NO: 1853, d. CDR-L1 comprising the amino acid sequence of SEQ ID NO: 1040, e. CDR-L2 comprising the amino acid sequence of SEQ ID NO: 1582, and f. CDR-L3 comprising the amino acid sequence of SEQ ID NO: 2124.

In one aspect, the present disclosure provides an antibody or antigen-binding fragment thereof comprising a CDR-H3 comprising the amino acid sequence of SEQ ID NO: 1853, and a CDR-L3 comprising the amino acid sequence of SEQ ID NO: 2124.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 769, b. CDR-H2 comprising the amino acid sequence of SEQ ID NO: 1311, c. CDR-H3 comprising the amino acid sequence of SEQ ID NO: 1853, and a VL comprising the amino acid sequence of SEQ ID NO: 498.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1040, b. CDR-L2 comprising the amino acid sequence of SEQ ID NO: 1582, c. CDR-L3 comprising the amino acid sequence of SEQ ID NO: 2124, and a VH comprising the amino acid sequence of SEQ ID NO: 227.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 227. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 227. In some embodiments, substitutions, insertions, or deletions occur in regions outside the CDRs (e.g., in the FRs). Optionally, the antibody or antigen-binding fragment thereof comprises the VH sequence SEQ ID NO: 227, including one or more post-translational modifications of that sequence. In a particular embodiment, the VH comprises one, two or three CDRs selected from: a. CDR-H1, comprising the amino acid sequence SEQ ID NO: 769, b. CDR-H2, comprising the amino acid sequence SEQ ID NO: 1311, and c. CDR-H3, comprising the amino acid sequence SEQ ID NO: 1853.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 498. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 498. In some embodiments, the substitutions, insertions, or deletions occur in regions outside the CDRs (e.g., in the FRs). Optionally, the antibody or antigen-binding fragment thereof comprises the VL sequence SEQ ID NO: 498, including one or more post-translational modifications of that sequence. In a particular embodiment, the VL comprises one, two or three CDRs selected from: a. CDR-L1, comprising the amino acid sequence SEQ ID NO: 1040, b. CDR-L2, comprising the amino acid sequence SEQ ID NO: 1582, and c. CDR-L3, comprising the amino acid sequence SEQ ID NO: 2124.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 227, and the VL amino acid sequence of SEQ ID NO: 498, optionally including post-translational modifications of those sequences.
TSAR1006

In one aspect, the present disclosure provides an antibody or antigen-binding fragment thereof comprising at least one or both variable regions selected from: a. VH comprising the amino acid sequence of SEQ ID NO: 228 and b. VL comprising the amino acid sequence of SEQ ID NO: 499.

In one aspect, the present disclosure provides an antibody or antigen-binding fragment thereof comprising at least one, two, three, four, five, or six CDRs selected from: a. CDR-H1 comprising the amino acid sequence of SEQ ID NO: 770, b. CDR-H2 comprising the amino acid sequence of SEQ ID NO: 1312, c. CDR-H3 comprising the amino acid sequence of SEQ ID NO: 1854, d. CDR-L1 comprising the amino acid sequence of SEQ ID NO: 1041, e. CDR-L2 comprising the amino acid sequence of SEQ ID NO: 1583, and f. CDR-L3 comprising the amino acid sequence of SEQ ID NO: 2125.

In one aspect, the present disclosure provides an antibody or antigen-binding fragment thereof comprising CDR-H3 comprising the amino acid sequence of SEQ ID NO: 1854, and a CDR-L3 comprising the amino acid sequence of SEQ ID NO: 2125.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 770, b. CDR-H2 comprising the amino acid sequence of SEQ ID NO: 1312, c. CDR-H3 comprising the amino acid sequence of SEQ ID NO: 1854, and a VL comprising the amino acid sequence of SEQ ID NO: 499.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1041, b. CDR-L2 comprising the amino acid sequence of SEQ ID NO: 1583, c. CDR-L3 comprising the amino acid sequence of SEQ ID NO: 2125, and a VH comprising the amino acid sequence of SEQ ID NO: 228.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 228. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 228. In some embodiments, substitutions, insertions, or deletions occur in regions outside the CDRs (e.g., in the FRs). Optionally, the antibody or antigen-binding fragment thereof comprises the VH sequence SEQ ID NO: 228, including one or more post-translational modifications of that sequence. In a particular embodiment, the VH comprises one, two or three CDRs selected from: a. CDR-H1, comprising the amino acid sequence SEQ ID NO: 770, b. CDR-H2, comprising the amino acid sequence SEQ ID NO: 1312, and c. CDR-H3, comprising the amino acid sequence SEQ ID NO: 1854.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 499. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 499. In some embodiments, the substitutions, insertions, or deletions occur in regions outside the CDRs (e.g., in the FRs). Optionally, the antibody or antigen-binding fragment thereof comprises the VL sequence SEQ ID NO: 499, including one or more post-translational modifications of that sequence. In a particular embodiment, the VL comprises one, two or three CDRs selected from: a. CDR-L1, comprising the amino acid sequence SEQ ID NO: 1041, b. CDR-L2, comprising the amino acid sequence SEQ ID NO: 1583, and c. CDR-L3, comprising the amino acid sequence SEQ ID NO: 2125.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 228, and the VL amino acid sequence of SEQ ID NO: 499, optionally including post-translational modifications of those sequences.
TSAR1007

In one aspect, the present disclosure provides an antibody or antigen-binding fragment thereof comprising at least one or both variable regions selected from: a. VH comprising the amino acid sequence of SEQ ID NO: 229 and b. VL comprising the amino acid sequence of SEQ ID NO: 500.

In one aspect, the present disclosure provides an antibody or antigen-binding fragment thereof comprising at least one, two, three, four, five, or six CDRs selected from: a. CDR-H1 comprising the amino acid sequence of SEQ ID NO: 771, b. CDR-H2 comprising the amino acid sequence of SEQ ID NO: 1313, c. CDR-H3 comprising the amino acid sequence of SEQ ID NO: 1855, d. CDR-L1 comprising the amino acid sequence of SEQ ID NO: 1042, e. CDR-L2 comprising the amino acid sequence of SEQ ID NO: 1584, and f. CDR-L3 comprising the amino acid sequence of SEQ ID NO: 2126.

In one aspect, the present disclosure provides an antibody or antigen-binding fragment thereof comprising a CDR-H3 comprising the amino acid sequence of SEQ ID NO: 1855, and a CDR-L3 comprising the amino acid sequence of SEQ ID NO: 2126.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 771, b. CDR-H2 comprising the amino acid sequence of SEQ ID NO: 1313, c. CDR-H3 comprising the amino acid sequence of SEQ ID NO: 1855, and a VL comprising the amino acid sequence of SEQ ID NO: 500.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1042, b. CDR-L2 comprising the amino acid sequence of SEQ ID NO: 1584, c. CDR-L3 comprising the amino acid sequence of SEQ ID NO: 2126, and a VH comprising the amino acid sequence of SEQ ID NO: 229.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 229. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 229. In some embodiments, substitutions, insertions, or deletions occur in regions outside the CDRs (e.g., in the FRs). Optionally, the antibody or antigen-binding fragment thereof comprises the VH sequence SEQ ID NO: 229, including one or more post-translational modifications of that sequence. In a particular embodiment, the VH comprises one, two or three CDRs selected from: a. CDR-H1, comprising the amino acid sequence SEQ ID NO: 771, b. CDR-H2, comprising the amino acid sequence SEQ ID NO: 1313, and c. CDR-H3, comprising the amino acid sequence SEQ ID NO: 1855.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 500. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 500. In some embodiments, the substitutions, insertions, or deletions occur in regions outside the CDRs (e.g., in the FRs). Optionally, the antibody or antigen-binding fragment thereof comprises the VL sequence SEQ ID NO: 500, including one or more post-translational modifications of that sequence. In a particular embodiment, the VL comprises one, two or three CDRs selected from: a. CDR-L1, comprising the amino acid sequence SEQ ID NO: 1042, b CDR-L2, comprising the amino acid sequence SEQ ID NO: 1584, and c. CDR-L3, comprising the amino acid sequence SEQ ID NO: 2126.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 229, and the VL amino acid sequence of SEQ ID NO: 500, optionally including post-translational modifications of those sequences.

TSAR1008

In one aspect, the present disclosure provides an antibody or antigen-binding fragment thereof comprising at least one or both variable regions selected from: a. VH comprising the amino acid sequence of SEQ ID NO: 230 and b. VL comprising the amino acid sequence of SEQ ID NO: 501.

In one aspect, the present disclosure provides an antibody or antigen-binding fragment thereof comprising at least one, two, three, four, five, or six CDRs selected from: a. CDR-H1 comprising the amino acid sequence of SEQ ID NO: 772, b. CDR-H2 comprising the amino acid sequence of SEQ ID NO: 1314, c. CDR-H3 comprising the amino acid sequence of SEQ ID NO: 1856, d. CDR-L1 comprising the amino acid sequence of SEQ ID NO: 1043, e. CDR-L2 comprising the amino acid sequence of SEQ ID NO: 1585, and f. CDR-L3 comprising the amino acid sequence of SEQ ID NO: 2127.

In one aspect, the present disclosure provides an antibody or antigen-binding fragment thereof comprising a CDR-H3 comprising the amino acid sequence of SEQ ID NO: 1856, and a CDR-L3 comprising the amino acid sequence of SEQ ID NO: 2127.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 772, b. CDR-H2 comprising the amino acid sequence of SEQ ID NO: 1314, c. CDR-H3 comprising the amino acid sequence of SEQ ID NO: 1856, and a VL comprising the amino acid sequence of SEQ ID NO: 501.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1043, b. CDR-L2 comprising the amino acid sequence of SEQ ID NO: 1585, c. CDR-L3 comprising the amino acid sequence of SEQ ID NO: 2127, and a VH comprising the amino acid sequence of SEQ ID NO: 230.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 230. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 230. In some embodiments, substitutions, insertions, or deletions occur in regions outside the CDRs (e.g., in the FRs). Optionally, the antibody or antigen-binding fragment thereof comprises the VH sequence SEQ ID NO: 230, including one or more post-translational modifications of that sequence. In a particular embodiment, the VH comprises one, two or three CDRs selected from: a. CDR-H1, comprising the amino acid sequence SEQ ID NO: 772, b. CDR-H2, comprising the amino acid sequence SEQ ID NO: 1314, and c. CDR-H3, comprising the amino acid sequence SEQ ID NO: 1856.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 501. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 501. In some embodiments, the substitutions, insertions, or deletions occur in regions outside the CDRs (e.g., in the FRs). Optionally, the antibody or antigen-binding fragment thereof comprises the VL sequence SEQ ID NO: 501, including one or more post-translational modifications of that sequence. In a particular embodiment, the VL comprises one, two or three CDRs selected from: a. CDR-L1, comprising the amino acid sequence SEQ ID NO: 1043, b. CDR-L2, comprising the amino acid sequence SEQ ID NO: 1585, and c. CDR-L3, comprising the amino acid sequence SEQ ID NO: 2127.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 230, and the VL amino acid sequence of SEQ ID NO: 501, optionally including post-translational modifications of those sequences.
TSTO1001

In one aspect, the present disclosure provides an antibody or antigen-binding fragment thereof comprising at least one or both variable regions selected from: a. VH comprising the amino acid sequence of SEQ ID NO: 231 and b. VL comprising the amino acid sequence of SEQ ID NO: 502.

In one aspect, the present disclosure provides an antibody or antigen-binding fragment thereof comprising at least one, two, three, four, five, or six CDRs selected from: a. CDR-H1 comprising the amino acid sequence of SEQ ID NO: 773, b. CDR-H2 comprising the amino acid sequence of SEQ ID NO: 1315, c. CDR-H3 comprising the amino acid sequence of SEQ ID NO: 1857, d. CDR-L1 comprising the amino acid sequence of SEQ ID NO: 1044, e. CDR-L2 comprising the amino acid sequence of SEQ ID NO: 1586, and f. CDR-L3 comprising the amino acid sequence of SEQ ID NO: 2128.

In one aspect, the present disclosure provides an antibody or antigen-binding fragment thereof comprising a CDR-H3 comprising the amino acid sequence of SEQ ID NO: 1857, and a CDR-L3 comprising the amino acid sequence of SEQ ID NO: 2128.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 773, b. CDR-H2 comprising the amino acid sequence of SEQ ID NO: 1315, c. CDR-H3 comprising the amino acid sequence of SEQ ID NO: 1857, and a VL comprising the amino acid sequence of SEQ ID NO: 502.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1044, b. CDR-L2 comprising the amino acid sequence of SEQ ID NO: 1586, c. CDR-L3 comprising the amino acid sequence of SEQ ID NO: 2128, and a VH comprising the amino acid sequence of SEQ ID NO: 231.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 231. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 231. In some embodiments, substitutions, insertions, or deletions occur in regions outside the CDRs (e.g., in the FRs). Optionally, the antibody or antigen-binding fragment thereof comprises the VH sequence SEQ ID NO: 231, including one or more post-translational modifications of that sequence. In a particular embodiment, the VH comprises one, two or three CDRs selected from: a. CDR-H1, comprising the amino acid sequence SEQ ID NO: 773, b. CDR-H2, comprising the amino acid sequence SEQ ID NO: 1315, and c. CDR-H3, comprising the amino acid sequence SEQ ID NO: 1857.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 502. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 502. In some embodiments, the substitutions, insertions, or deletions occur in regions outside the CDRs (e.g., in the FRs). Optionally, the antibody or antigen-binding fragment thereof comprises the VL sequence SEQ ID NO: 502, including one or more post-translational modifications of that sequence. In a particular embodiment, the VL comprises one, two or three CDRs selected from: a. CDR-L1, comprising the amino acid sequence SEQ ID NO: 1044, b. CDR-L2, comprising the amino acid sequence SEQ ID NO: 1586, and c. CDR-L3, comprising the amino acid sequence SEQ ID NO: 2128.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 231, and the VL amino acid sequence of SEQ ID NO: 502, optionally including post-translational modifications of those sequences.

TSTO1002

In one aspect, the present disclosure provides an antibody or antigen-binding fragment thereof comprising at least one or both variable regions selected from: a. VH comprising the amino acid sequence of SEQ ID NO: 232 and b. VL comprising the amino acid sequence of SEQ ID NO: 503.

In one aspect, the present disclosure provides an antibody or antigen-binding fragment thereof comprising at least one, two, three, four, five, or six CDRs selected from: a. CDR-H1 comprising the amino acid sequence of SEQ ID NO: 774, b. CDR-H2 comprising the amino acid sequence of SEQ ID NO: 1316, c. CDR-H3 comprising the amino acid sequence of SEQ ID NO: 1858, d. CDR-L1 comprising the amino acid sequence of SEQ ID NO: 1045, e. CDR-L2 comprising the amino acid sequence of SEQ ID NO: 1587, and f. CDR-L3 comprising the amino acid sequence of SEQ ID NO: 2129.

In one aspect, the present disclosure provides an antibody or antigen-binding fragment thereof comprising a CDR-H3 comprising the amino acid sequence of SEQ ID NO: 1858, and a CDR-L3 comprising the amino acid sequence of SEQ ID NO: 2129.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 774, b. CDR-H2 comprising the amino acid sequence of SEQ ID NO: 1316, c. CDR-H3 comprising the amino acid sequence of SEQ ID NO: 1858, and a VL comprising the amino acid sequence of SEQ ID NO: 503.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1045, b. CDR-L2 comprising the amino acid sequence of SEQ ID NO: 1587, c. CDR-L3 comprising the amino acid sequence of SEQ ID NO: 2129, and a VH comprising the amino acid sequence of SEQ ID NO: 232.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 232. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 232. In some embodiments, substitutions, insertions, or deletions occur in regions outside the CDRs (e.g., in the FRs). Optionally, the antibody or antigen-binding fragment thereof comprises the VH sequence SEQ ID NO: 232, including one or more post-translational modifications of that sequence. In a particular embodiment, the VH comprises one, two or three CDRs selected from: a. CDR-H1, comprising the amino acid sequence SEQ ID NO: 774, b. CDR-H2, comprising the amino acid sequence SEQ ID NO: 1316, and c. CDR-H3, comprising the amino acid sequence SEQ ID NO: 1858.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 503. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 503. In some embodiments, the substitutions, insertions, or deletions occur in regions outside the CDRs (e.g., in the FRs). Optionally, the antibody or antigen-binding fragment thereof comprises the VL sequence SEQ ID NO: 503, including one or more post-translational modifications of that sequence. In a particular embodiment, the VL comprises one, two or three CDRs selected from: a. CDR-L1, comprising the amino acid sequence SEQ ID NO: 1045, b. CDR-L2, comprising the amino acid sequence SEQ ID NO: 1587, and c. CDR-L3, comprising the amino acid sequence SEQ ID NO: 2129.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 232, and the VL amino acid sequence of SEQ ID NO: 503, optionally including post-translational modifications of those sequences.

TSTO1003

In one aspect, the present disclosure provides an antibody or antigen-binding fragment thereof comprising at least one or both variable regions selected from: a. VH comprising the amino acid sequence of SEQ ID NO: 233 and b. VL comprising the amino acid sequence of SEQ ID NO: 504.

In one aspect, the present disclosure provides an antibody or antigen-binding fragment thereof comprising at least one, two, three, four, five, or six CDRs selected from: a. CDR-H1 comprising the amino acid sequence of SEQ ID NO: 775, b. CDR-H2 comprising the amino acid sequence of SEQ ID NO: 1317, c. CDR-H3 comprising the amino acid sequence of SEQ ID NO: 1859, d. CDR-L1 comprising the amino acid sequence of SEQ ID NO: 1046, e. CDR-L2 comprising the amino acid sequence of SEQ ID NO: 1588, and f. CDR-L3 comprising the amino acid sequence of SEQ ID NO: 2130.

In one aspect, the present disclosure provides an antibody or antigen-binding fragment thereof comprising a CDR-H3 comprising the amino acid sequence of SEQ ID NO: 1859, and a CDR-L3 comprising the amino acid sequence of SEQ ID NO: 2130.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 775, b. CDR-H2 comprising the amino acid sequence of SEQ ID NO: 1317, c. CDR-H3 comprising the amino acid sequence of SEQ ID NO: 1859, and d VL comprising the amino acid sequence of SEQ ID NO: 504.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1046, b. CDR-L2 comprising the amino acid sequence of SEQ ID NO: 1588, c. CDR-L3 comprising the amino acid sequence of SEQ ID NO: 2130, and a VH comprising the amino acid sequence of SEQ ID NO: 233.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 233. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 233. In some embodiments, substitutions, insertions, or deletions occur in regions outside the CDRs (e.g., in the FRs). Optionally, the antibody or antigen-binding fragment thereof comprises the VH sequence SEQ ID NO: 233, including one or more post-translational modifications of that sequence. In a particular embodiment, the VH comprises one, two or three CDRs selected from: a. CDR-H1, comprising the amino acid sequence SEQ ID NO: 775, b. CDR-H2, comprising the amino acid sequence SEQ ID NO: 1317, and c. CDR-H3, comprising the amino acid sequence SEQ ID NO: 1859.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 504. In some embodiments, a VL sequence having at least 90%, 91%, 92%, 93%, 94%, 95%, 96%, 97%, 98%, or 99% identity contains substitutions (e.g., conservative substitutions), thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 504. In some embodiments, the substitutions, insertions, or deletions occur in regions outside the CDRs (e.g., in the FRs). Optionally, the antibody or antigen-binding fragment thereof comprises the VL sequence SEQ ID NO: 504, including one or more post-translational modifications of that sequence. In a particular embodiment, the VL comprises one, two or three CDRs selected from: a. CDR-L1, comprising the amino acid sequence SEQ ID NO: 1046, b. CDR-L2, comprising the amino acid sequence SEQ ID NO: 1588, and c. CDR-L3, comprising the amino acid sequence SEQ ID NO: 2130.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 233, and the VL amino acid sequence of SEQ ID NO: 504, optionally including post-translational modifications of those sequences.
TSTO1004

In one aspect, the present disclosure provides an antibody or antigen-binding fragment thereof comprising at least one or both variable regions selected from: a. VH comprising the amino acid sequence of SEQ ID NO: 234 and b. VL comprising the amino acid sequence of SEQ ID NO: 505.

In one aspect, the present disclosure provides an antibody or antigen-binding fragment thereof comprising at least one, two, three, four, five, or six CDRs selected from: a. CDR-H1 comprising the amino acid sequence of SEQ ID NO: 776, b. CDR-H2 comprising the amino acid sequence of SEQ ID NO: 1318, c. CDR-H3 comprising the amino acid sequence of SEQ ID NO: 1860, d. CDR-L1 comprising the amino acid sequence of SEQ ID NO: 1047, e. CDR-L2 comprising the amino acid sequence of SEQ ID NO: 1589, and f. CDR-L3 comprising the amino acid sequence of SEQ ID NO: 2131.

In one aspect, the present disclosure provides an antibody or antigen-binding fragment thereof comprising a CDR-H3 comprising the amino acid sequence of SEQ ID NO: 1860, and a CDR-L3 comprising the amino acid sequence of SEQ ID NO: 2131.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 776, b. CDR-H2 comprising the amino acid sequence of SEQ ID NO: 1318, c. CDR-H3 comprising the amino acid sequence of SEQ ID NO: 1860, and a VL comprising the amino acid sequence of SEQ ID NO: 505.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 104, b. CDR-L2 comprising the amino acid sequence of SEQ ID NO: 1589, c. CDR-L3 comprising the amino acid sequence of SEQ ID NO: 2131, and a VH comprising the amino acid sequence of SEQ ID NO: 234.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 234. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 234. In some embodiments, substitutions, insertions, or deletions occur in regions outside the CDRs (e.g., in the FRs). Optionally, the antibody or antigen-binding fragment thereof comprises the VH sequence SEQ ID NO: 234, including one or more post-translational modifications of that sequence. In a particular embodiment, the VH comprises one, two or three CDRs selected from: a. CDR-H1, comprising the amino acid sequence SEQ ID NO: 776, b. CDR-H2, comprising the amino acid sequence SEQ ID NO: 1318, and c. CDR-H3, comprising the amino acid sequence SEQ ID NO: 1860.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 505. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 505. In some embodiments, the substitutions, insertions, or deletions occur in regions outside the CDRs (e.g., in the FRs). Optionally, the antibody or antigen-binding fragment thereof comprises the VL sequence SEQ ID NO: 505, including one or more post-translational modifications of that sequence. In a particular embodiment, the VL comprises one, two or three CDRs selected from: a. CDR-L1, comprising the amino acid sequence SEQ ID NO: 1047, b. CDR-L2, comprising the amino acid sequence SEQ ID NO: 1589, and c. CDR-L3, comprising the amino acid sequence SEQ ID NO: 2131.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 234, and the VL amino acid sequence of SEQ ID NO: 505, optionally including post-translational modifications of those sequences.

TSTO1005

In one aspect, the present disclosure provides an antibody or antigen-binding fragment thereof comprising at least one or both variable regions selected from: a. VH comprising the amino acid sequence of SEQ ID NO: 235 and b. VL comprising the amino acid sequence of SEQ ID NO: 506.

In one aspect, the present disclosure provides an antibody or antigen-binding fragment thereof comprising at least one, two, three, four, five, or six CDRs selected from: a. CDR-H1 comprising the amino acid sequence of SEQ ID NO: 777, b. CDR-H2 comprising the amino acid sequence of SEQ ID NO: 1319, c. CDR-H3 comprising the amino acid sequence of SEQ ID NO: 1861, d. CDR-L1 comprising the amino acid sequence of SEQ ID NO: 1048, e. CDR-L2 comprising the amino acid sequence of SEQ ID NO: 1590, and f. CDR-L3 comprising the amino acid sequence of SEQ ID NO: 2132.

In one aspect, the present disclosure provides an antibody or antigen-binding fragment thereof comprising a CDR-H3 comprising the amino acid sequence of SEQ ID NO: 1861, and a CDR-L3 comprising the amino acid sequence of SEQ ID NO: 2132.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 777, b. CDR-H2 comprising the amino acid sequence of SEQ ID NO: 1319, c. CDR-H3 comprising the amino acid sequence of SEQ ID NO: 1861, and a VL comprising the amino acid sequence of SEQ ID NO: 506.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1048, b. CDR-L2 comprising the amino acid sequence of SEQ ID NO: 1590, c. CDR-L3 comprising the amino acid sequence of SEQ ID NO: 2132, and a VH comprising the amino acid sequence of SEQ ID NO: 235.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 235. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 235. In some embodiments, substitutions, insertions, or deletions occur in regions outside the CDRs (e.g., in the FRs). Optionally, the antibody or antigen-binding fragment thereof comprises the VH sequence SEQ ID NO: 235, including one or more post-translational modifications of that sequence. In a particular embodiment, the VH comprises one, two or three CDRs selected from: a. CDR-H1, comprising the amino acid sequence SEQ ID NO: 777, b. CDR-H2, comprising the amino acid sequence SEQ ID NO: 1319, and c. CDR-H3, comprising the amino acid sequence SEQ ID NO: 1861.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 506. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 506. In some embodiments, the substitutions, insertions, or deletions occur in regions outside the CDRs (e.g., in the FRs). Optionally, the antibody or antigen-binding fragment thereof comprises the VL sequence SEQ ID NO: 506, including one or more post-translational modifications of that sequence. In a particular embodiment, the VL comprises one, two or three CDRs selected from: a. CDR-L1, comprising the amino acid sequence SEQ ID NO: 1048, b. CDR-L2, comprising the amino acid sequence SEQ ID NO: 1590, and c. CDR-L3, comprising the amino acid sequence SEQ ID NO: 2132.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 235, and the VL amino acid sequence of SEQ ID NO: 506, optionally including post-translational modifications of those sequences.

TSTO1006

In one aspect, the present disclosure provides an antibody or antigen-binding fragment thereof comprising at least one or both variable regions selected from: a. VH comprising the amino acid sequence of SEQ ID NO: 236 and b. VL comprising the amino acid sequence of SEQ ID NO: 507.

In one aspect, the present disclosure provides an antibody or antigen-binding fragment thereof comprising at least one, two, three, four, five, or six CDRs selected from: a. CDR-H1 comprising the amino acid sequence of SEQ ID NO: 778, b. CDR-H2 comprising the amino acid sequence of SEQ ID NO: 1320, c. CDR-H3 comprising the amino acid sequence of SEQ ID NO: 1862, d. CDR-L1 comprising the amino acid sequence of SEQ ID NO: 1049, e. CDR-L2 comprising the amino acid sequence of SEQ ID NO: 1591, and f. CDR-L3 comprising the amino acid sequence of SEQ ID NO: 2133.

In one aspect, the present disclosure provides an antibody or antigen-binding fragment thereof comprising a CDR-H3 comprising the amino acid sequence of SEQ ID NO: 1862, and a CDR-L3 comprising the amino acid sequence of SEQ ID NO: 2133.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 778, b. CDR-H2 comprising the amino acid sequence of SEQ ID NO: 1320, c. CDR-H3 comprising the amino acid sequence of SEQ ID NO: 1862, and a VL comprising the amino acid sequence of SEQ ID NO: 507.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1049, b. CDR-L2 comprising the amino acid sequence of SEQ ID NO: 1591, c. CDR-L3 comprising the amino acid sequence of SEQ ID NO: 2133, and a VH comprising the amino acid sequence of SEQ ID NO: 236.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 236. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 236. In some embodiments, substitutions, insertions, or deletions occur in regions outside the CDRs (e.g., in the FRs). Optionally, the antibody or antigen-binding fragment thereof comprises the VH sequence SEQ ID NO: 236, including one or more post-translational modifications of that sequence. In a particular embodiment, the VH comprises one, two or three CDRs selected from: a. CDR-H1, comprising the amino acid sequence SEQ ID NO: 778, b. CDR-H2, comprising the amino acid sequence SEQ ID NO: 1320, and c. CDR-H3, comprising the amino acid sequence SEQ ID NO: 1862.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 507. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 507. In some embodiments, the substitutions, insertions, or deletions occur in regions outside the CDRs (e.g., in the FRs). Optionally, the antibody or antigen-binding fragment thereof comprises the VL sequence SEQ ID NO: 507, including one or more post-translational modifications of that sequence. In a particular embodiment, the VL comprises one, two or three CDRs selected from: a. CDR-L1, comprising the amino acid sequence SEQ ID NO: 1049, b. CDR-L2, comprising the amino acid sequence SEQ ID NO: 1591, and c. CDR-L3, comprising the amino acid sequence SEQ ID NO: 2133.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 236, and the VL amino acid sequence of SEQ ID NO: 507, optionally including post-translational modifications of those sequences.

TSTO1007

In one aspect, the present disclosure provides an antibody or antigen-binding fragment thereof comprising at least one or both variable regions selected from: a. VH comprising the amino acid sequence of SEQ ID NO: 237 and b. VL comprising the amino acid sequence of SEQ ID NO: 508.

In one aspect, the present disclosure provides an antibody or antigen-binding fragment thereof comprising at least one, two, three, four, five, or six CDRs selected from: a. CDR-H1 comprising the amino acid sequence of SEQ ID NO: 779, b. CDR-H2 comprising the amino acid sequence of SEQ ID NO: 1321, c. CDR-H3 comprising the amino acid sequence of SEQ ID NO: 1863, d. CDR-L1 comprising the amino acid sequence of SEQ ID NO: 1050, e. CDR-L2 comprising the amino acid sequence of SEQ ID NO: 1592, and f. CDR-L3 comprising the amino acid sequence of SEQ ID NO: 2134.

In one aspect, the present disclosure provides an antibody or antigen-binding fragment thereof comprising a CDR-H3 comprising the amino acid sequence of SEQ ID NO: 1863, and a CDR-L3 comprising the amino acid sequence of SEQ ID NO: 2134.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 779, b. CDR-H2 comprising the amino acid sequence of SEQ ID NO: 1321, c. CDR-H3 comprising the amino acid sequence of SEQ ID NO: 1863, and a VL comprising the amino acid sequence of SEQ ID NO: 508.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1050, b. CDR-L2 comprising the amino acid sequence of SEQ ID NO: 1592, c. CDR-L3 comprising the amino acid sequence of SEQ ID NO: 2134, and a VH comprising the amino acid sequence of SEQ ID NO: 237.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 237. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 237. In some embodiments, substitutions, insertions, or deletions occur in regions outside the CDRs (e.g., in the FRs). Optionally, the antibody or antigen-binding fragment thereof comprises the VH sequence SEQ ID NO: 237, including one or more post-translational modifications of that sequence. In a particular embodiment, the VH comprises one, two or three CDRs selected from: a. CDR-H1, comprising the amino acid sequence SEQ ID NO: 779, b. CDR-H2, comprising the amino acid sequence SEQ ID NO: 1321, and c. CDR-H3, comprising the amino acid sequence SEQ ID NO: 1863.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 508. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 508. In some embodiments, the substitutions, insertions, or deletions occur in regions outside the CDRs (e.g., in the FRs). Optionally, the antibody or antigen-binding fragment thereof comprises the VL sequence SEQ ID NO: 508, including one or more post-translational modifications of that sequence. In a particular embodiment, the VL comprises one, two or three CDRs selected from: a. CDR-L1, comprising the amino acid sequence SEQ ID NO: 1050, b. CDR-L2, comprising the amino acid sequence SEQ ID NO: 1592, and c. CDR-L3, comprising the amino acid sequence SEQ ID NO: 2134.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 237, and the VL amino acid sequence of SEQ ID NO: 508, optionally including post-translational modifications of those sequences.
TSTO1008

In one aspect, the present disclosure provides an antibody or antigen-binding fragment thereof comprising at least one or both variable regions selected from: a. VH comprising the amino acid sequence of SEQ ID NO: 238 and b. VL comprising the amino acid sequence of SEQ ID NO: 509.

In one aspect, the present disclosure provides an antibody or antigen-binding fragment thereof comprising at least one, two, three, four, five, or six CDRs selected from: a. CDR-H1 comprising the amino acid sequence of SEQ ID NO: 780, b. CDR-H2 comprising the amino acid sequence of SEQ ID NO: 1322, c. CDR-H3 comprising the amino acid sequence of SEQ ID NO: 1864, d. CDR-L1 comprising the amino acid sequence of SEQ ID NO: 1051, e. CDR-L2 comprising the amino acid sequence of SEQ ID NO: 1593, and f. CDR-L3 comprising the amino acid sequence of SEQ ID NO: 2135.

In one aspect, the present disclosure provides an antibody or antigen-binding fragment thereof comprising a CDR-H3 comprising the amino acid sequence of SEQ ID NO: 1864, and a CDR-L3 comprising the amino acid sequence of SEQ ID NO: 2135.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 780, b. CDR-H2 comprising the amino acid sequence of SEQ ID NO: 1322, c. CDR-H3 comprising the amino acid sequence of SEQ ID NO: 1864, and a VL comprising the amino acid sequence of SEQ ID NO: 509.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1051, b. CDR-L2 comprising the amino acid sequence of SEQ ID NO: 1593, c. CDR-L3 comprising the amino acid sequence of SEQ ID NO: 2135, and a VH comprising the amino acid sequence of SEQ ID NO: 238.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 238. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 238. In some embodiments, substitutions, insertions, or deletions occur in regions outside the CDRs (e.g., in the FRs). Optionally, the antibody or antigen-binding fragment thereof comprises the VH sequence SEQ ID NO: 238, including one or more post-translational modifications of that sequence. In a particular embodiment, the VH comprises one, two or three CDRs selected from: a. CDR-H1, comprising the amino acid sequence SEQ ID NO: 780, b. CDR-H2, comprising the amino acid sequence SEQ ID NO: 1322, and c. CDR-H3, comprising the amino acid sequence SEQ ID NO: 1864.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 509. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 509. In some embodiments, the substitutions, insertions, or deletions occur in regions outside the CDRs (e.g., in the FRs). Optionally, the antibody or antigen-binding fragment thereof comprises the VL sequence SEQ ID NO: 509, including one or more post-translational modifications of that sequence. In a particular embodiment, the VL comprises one, two or three CDRs selected from: a. CDR-L1, comprising the amino acid sequence SEQ ID NO: 1051, b. CDR-L2, comprising the amino acid sequence SEQ ID NO: 1593, and c. CDR-L3, comprising the amino acid sequence SEQ ID NO: 2135.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 238, and the VL amino acid sequence of SEQ ID NO: 509, optionally including post-translational modifications of those sequences.
TSTO1009

In one aspect, the present disclosure provides an antibody or antigen-binding fragment thereof comprising at least one or both variable regions selected from: a. VH comprising the amino acid sequence of SEQ ID NO: 239 and b. VL comprising the amino acid sequence of SEQ ID NO: 510.

In one aspect, the present disclosure provides an antibody or antigen-binding fragment thereof comprising at least one, two, three, four, five, or six CDRs selected from: a. CDR-H1 comprising the amino acid sequence of SEQ ID NO: 781, b. CDR-H2 comprising the amino acid sequence of SEQ ID NO: 1323, c. CDR-H3 comprising the amino acid sequence of SEQ ID NO: 1865, d. CDR-L1 comprising the amino acid sequence of SEQ ID NO: 1052, e. CDR-L2 comprising the amino acid sequence of SEQ ID NO: 1594, and f. CDR-L3 comprising the amino acid sequence of SEQ ID NO: 2136.

In one aspect, the present disclosure provides an antibody or antigen-binding fragment thereof comprising a CDR-H3 comprising the amino acid sequence of SEQ ID NO: 1865, and a CDR-L3 comprising the amino acid sequence of SEQ ID NO: 2136.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 781, b. CDR-H2 comprising the amino acid sequence of SEQ ID NO: 1323, c. CDR-H3 comprising the amino acid sequence of SEQ ID NO: 1865, and a VL comprising the amino acid sequence of SEQ ID NO: 510.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1052, b. CDR-L2 comprising the amino acid sequence of SEQ ID NO: 1594, c. CDR-L3 comprising the amino acid sequence of SEQ ID NO: 2136, and a VH comprising the amino acid sequence of SEQ ID NO: 239.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 239. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 239. In some embodiments, substitutions, antigen-binding fragment thereof comprises the VH sequence SEQ ID NO: 239, including one or more post-translational modifications of that sequence. In a particular embodiment, the VH comprises one, two or three CDRs selected from: a. CDR-H1, comprising the amino acid sequence SEQ ID NO: 781, b. CDR-H2, comprising the amino acid sequence SEQ ID NO: 1323, and c. CDR-H3, comprising the amino acid sequence SEQ ID NO: 1865.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 510. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 510. In some embodiments, the substitutions, insertions, or deletions occur in regions outside the CDRs (e.g., in the FRs). Optionally, the antibody or antigen-binding fragment thereof comprises the VL sequence SEQ ID NO: 510, including one or more post-translational modifications of that sequence. In a particular embodiment, the VL comprises one, two or three CDRs selected from: a. CDR-L1, comprising the amino acid sequence SEQ ID NO: 1052, b. CDR-L2, comprising the amino acid sequence SEQ ID NO: 1594, and c. CDR-L3, comprising the amino acid sequence SEQ ID NO: 2136.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 239, and the VL amino acid sequence of SEQ ID NO: 510, optionally including post-translational modifications of those sequences.
TSTO1010

In one aspect, the present disclosure provides an antibody or antigen-binding fragment thereof comprising at least one or both variable regions selected from: a. VH comprising the amino acid sequence of SEQ ID NO: 240 and b. VL comprising the amino acid sequence of SEQ ID NO: 511.

In one aspect, the present disclosure provides an antibody or antigen-binding fragment thereof comprising at least one, two, three, four, five, or six CDRs selected from: a. CDR-H1 comprising the amino acid sequence of SEQ ID NO: 782, b. CDR-H2 comprising the amino acid sequence of SEQ ID NO: 1324, c. CDR-H3 comprising the amino acid sequence of SEQ ID NO: 1866, d. CDR-L1 comprising the amino acid sequence of SEQ ID NO: 1053, e. CDR-L2 comprising the amino acid sequence of SEQ ID NO: 1595, and f. CDR-L3 comprising the amino acid sequence of SEQ ID NO: 2137.

In one aspect, the present disclosure provides an antibody or antigen-binding fragment thereof comprising a CDR-H3 comprising the amino acid sequence of SEQ ID NO: 1866, and a CDR-L3 comprising the amino acid sequence of SEQ ID NO: 2137.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 782, b. CDR-H2 comprising the amino acid sequence of SEQ ID NO: 1324, c. CDR-H3 comprising the amino acid sequence of SEQ ID NO: 1866, and a VL comprising the amino acid sequence of SEQ ID NO: 511.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1053, b. CDR-L2 comprising the amino acid sequence of SEQ ID NO: 1595, c. CDR-L3 comprising the amino acid sequence of SEQ ID NO: 2137, and a VH comprising the amino acid sequence of SEQ ID NO: 240.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 240. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 240. In some embodiments, substitutions, insertions, or deletions occur in regions outside the CDRs (e.g., in the FRs). Optionally, the antibody or antigen-binding fragment thereof comprises the VH sequence SEQ ID NO: 240, including one or more post-translational modifications of that sequence. In a particular embodiment, the VH comprises one, two or three CDRs selected from: a. CDR-H1, comprising the amino acid sequence SEQ ID NO: 782, b. CDR-H2, comprising the amino acid sequence SEQ ID NO: 1324, and c. CDR-H3, comprising the amino acid sequence SEQ ID NO: 1866.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 511. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 511. In some embodiments, the substitutions, insertions, or deletions occur in regions outside the CDRs (e.g., in the FRs). Optionally, the antibody or antigen-binding fragment thereof comprises the VL sequence SEQ ID NO: 511, including one or more post-translational modifications of that sequence. In a particular embodiment, the VL comprises one, two or three CDRs selected from: a. CDR-L1, comprising the amino acid sequence SEQ ID NO: 1053, b. CDR-L2, comprising the amino acid sequence SEQ ID NO: 1595, and c. CDR-L3, comprising the amino acid sequence SEQ ID NO: 2137.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 240, and the VL amino acid sequence of SEQ ID NO: 511, optionally including post-translational modifications of those sequences.

TTES1001

In one aspect, the present disclosure provides an antibody or antigen-binding fragment thereof comprising at least one or both variable regions selected from: a. VH comprising the amino acid sequence of SEQ ID NO: 241 and b. VL comprising the amino acid sequence of SEQ ID NO: 512.

In one aspect, the present disclosure provides an antibody or antigen-binding fragment thereof comprising at least one, two, three, four, five, or six CDRs selected from: a. CDR-H1 comprising the amino acid sequence of SEQ ID NO: 783, b. CDR-H2 comprising the amino acid sequence of SEQ ID NO: 1325, c. CDR-H3 comprising the amino acid sequence of SEQ ID NO: 1867, d. CDR-L1 comprising the amino acid sequence of SEQ ID NO: 1054, e. CDR-L2 comprising the amino acid sequence of SEQ ID NO: 1596, and f. CDR-L3 comprising the amino acid sequence of SEQ ID NO: 2138.

In one aspect, the present disclosure provides an antibody or antigen-binding fragment thereof comprising a CDR-H3 comprising the amino acid sequence of SEQ ID NO: 1867, and a CDR-L3 comprising the amino acid sequence of SEQ ID NO: 2138.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 783, b. CDR-H2 comprising the amino acid sequence of SEQ ID NO: 1325, c. CDR-H3 comprising the amino acid sequence of SEQ ID NO: 1867, and a VL comprising the amino acid sequence of SEQ ID NO: 512.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1054, b. CDR-L2 comprising the amino acid sequence of SEQ ID NO: 1596, c. CDR-L3 comprising the amino acid sequence of SEQ ID NO: 2138, and a VH comprising the amino acid sequence of SEQ ID NO: 241.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 241. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 241. In some embodiments, substitutions, insertions, or deletions occur in regions outside the CDRs (e.g., in the FRs). Optionally, the antibody or antigen-binding fragment thereof comprises the VH sequence SEQ ID NO: 241, including one or more post-translational modifications of that sequence. In a particular embodiment, the VH comprises one, two or three CDRs selected from: a. CDR-H1, comprising the amino acid sequence SEQ ID NO: 783, b. CDR-H2, comprising the amino acid sequence SEQ ID NO: 1325, and c. CDR-H3, comprising the amino acid sequence SEQ ID NO: 1867.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 512. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 512. In some embodiments, the substitutions, insertions, or deletions occur in regions outside the CDRs (e.g., in the FRs). Optionally, the antibody or antigen-binding fragment thereof comprises the VL sequence SEQ ID NO: 512, including one or more post-translational modifications of that sequence. In a particular embodiment, the VL comprises one, two or three CDRs selected from: a. CDR-L1, comprising the amino acid sequence SEQ ID NO: 1054, b. CDR-L2, comprising the amino acid sequence SEQ ID NO: 1596, and c. CDR-L3, comprising the amino acid sequence SEQ ID NO: 2138.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 241, and the VL amino acid sequence of SEQ ID NO: 512, optionally including post-translational modifications of those sequences.

TTES1002

In one aspect, the present disclosure provides an antibody or antigen-binding fragment thereof comprising at least one or both variable regions selected from: a. VH comprising the amino acid sequence of SEQ ID NO: 242 and b. VL comprising the amino acid sequence of SEQ ID NO: 513.

In one aspect, the present disclosure provides an antibody or antigen-binding fragment thereof comprising at least one, two, three, four, five, or six CDRs selected from: a. CDR-H1 comprising the amino acid sequence of SEQ ID NO: 784, b. CDR-H2 comprising the amino acid sequence of SEQ ID NO: 1326, c. CDR-H3 comprising the amino acid sequence of SEQ ID NO: 1868, d. CDR-L1 comprising the amino acid sequence of SEQ ID NO: 1055, e. CDR-L2 comprising the amino acid sequence of SEQ ID NO: 1597, and f. CDR-L3 comprising the amino acid sequence of SEQ ID NO: 2139.

In one aspect, the present disclosure provides an antibody or antigen-binding fragment thereof comprising a CDR-H3 comprising the amino acid sequence of SEQ ID NO: 1868, and a CDR-L3 comprising the amino acid sequence of SEQ ID NO: 2139.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 784, b. CDR-H2 comprising the amino acid sequence of SEQ ID NO: 1326, c. CDR-H3 comprising the amino acid sequence of SEQ ID NO: 1868, and a. VL comprising the amino acid sequence of SEQ ID NO: 513.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1055, b. CDR-L2 comprising the amino acid sequence of SEQ ID NO: 1597, c. CDR-L3 comprising the amino acid sequence of SEQ ID NO: 2139, and a. VH comprising the amino acid sequence of SEQ ID NO: 242.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 242. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 242. In some embodiments, substitutions, insertions, or deletions occur in regions outside the CDRs (e.g., in the FRs). Optionally, the antibody or antigen-binding fragment thereof comprises the VH sequence SEQ ID NO: 242, including one or more post-translational modifications of that sequence. In a particular embodiment, the VH comprises one, two or three CDRs selected from: a. CDR-H1, comprising the amino acid sequence SEQ ID NO: 784, b. CDR-H2, comprising the amino acid sequence SEQ ID NO: 1326, and c. CDR-H3, comprising the amino acid sequence SEQ ID NO: 1868.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 513. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 513. In some embodiments, the substitutions, insertions, or deletions occur in regions outside the CDRs (e.g., in the FRs).

Optionally, the antibody or antigen-binding fragment thereof comprises the VL sequence SEQ ID NO: 513, including one or more post-translational modifications of that sequence. In a particular embodiment, the VL comprises one, two or three CDRs selected from: a. CDR-L1, comprising the amino acid sequence SEQ ID NO: 1055, b. CDR-L2, comprising the amino acid sequence SEQ ID NO: 1597, and c. CDR-L3, comprising the amino acid sequence SEQ ID NO: 2139.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 242, and the VL amino acid sequence of SEQ ID NO: 513, optionally including post-translational modifications of those sequences.

TTES1003

In one aspect, the present disclosure provides an antibody or antigen-binding fragment thereof comprising at least one or both variable regions selected from: a. VH comprising the amino acid sequence of SEQ ID NO: 243 and b. VL comprising the amino acid sequence of SEQ ID NO: 514.

In one aspect, the present disclosure provides an antibody or antigen-binding fragment thereof comprising at least one, two, three, four, five, or six CDRs selected from: a. CDR-H1 comprising the amino acid sequence of SEQ ID NO: 785, b. CDR-H2 comprising the amino acid sequence of SEQ ID NO: 1327, c. CDR-H3 comprising the amino acid sequence of SEQ ID NO: 1869, d. CDR-L1 comprising the amino acid sequence of SEQ ID NO: 1056, e. CDR-L2 comprising the amino acid sequence of SEQ ID NO: 1598, and f. CDR-L3 comprising the amino acid sequence of SEQ ID NO: 2140.

In one aspect, the present disclosure provides an antibody or antigen-binding fragment thereof comprising a CDR-H3 comprising the amino acid sequence of SEQ ID NO: 1869, and a CDR-L3 comprising the amino acid sequence of SEQ ID NO: 2140.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 785, b. CDR-H2 comprising the amino acid sequence of SEQ ID NO: 1327, c. CDR-H3 comprising the amino acid sequence of SEQ ID NO: 1869, and a VL comprising the amino acid sequence of SEQ ID NO: 514.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1056, b. CDR-L2 comprising the amino acid sequence of SEQ ID NO: 1598, c. CDR-L3 comprising the amino acid sequence of SEQ ID NO: 2140, and a VH comprising the amino acid sequence of SEQ ID NO: 243.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 243. In some embodiments, a VH sequence having at least 90%, 91%, 92%, 93%, 94%, 95%, 96%, 97%, 98%, or 99% identity contains substitutions (e.g., conservative substitutions), thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 243. In some embodiments, substitutions, insertions, or deletions occur in regions outside the CDRs (e.g., in the FRs). Optionally, the antibody or antigen-binding fragment thereof comprises the VH sequence SEQ ID NO: 243, including one or more post-translational modifications of that sequence. In a particular embodiment, the VH comprises one, two or three CDRs selected from: a. CDR-H1, comprising the amino acid sequence SEQ ID NO: 785, b. CDR-H2, comprising the amino acid sequence SEQ ID NO: 1327, and c. CDR-H3, comprising the amino acid sequence SEQ ID NO: 1869.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 514. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 514. In some embodiments, the substitutions, insertions, or deletions occur in regions outside the CDRs (e.g., in the FRs). Optionally, the antibody or antigen-binding fragment thereof comprises the VL sequence SEQ ID NO: 514, including one or more post-translational modifications of that sequence. In a particular embodiment, the VL comprises one, two or three CDRs selected from: a. CDR-L1, comprising the amino acid sequence SEQ ID NO: 1056, b. CDR-L2, comprising the amino acid sequence SEQ ID NO: 1598, and c. CDR-L3, comprising the amino acid sequence SEQ ID NO: 2140.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 243, and the VL amino acid sequence of SEQ ID NO: 514, optionally including post-translational modifications of those sequences.

TTES1004

In one aspect, the present disclosure provides an antibody or antigen-binding fragment thereof comprising at least one or both variable regions selected from: a. VH comprising the amino acid sequence of SEQ ID NO: 244 and b. VL comprising the amino acid sequence of SEQ ID NO: 515.

In one aspect, the present disclosure provides an antibody or antigen-binding fragment thereof comprising at least one, two, three, four, five, or six CDRs selected from: a. CDR-H1 comprising the amino acid sequence of SEQ ID NO: 786, b. CDR-H2 comprising the amino acid sequence of SEQ ID NO: 1328, c. CDR-H3 comprising the amino acid sequence of SEQ ID NO: 1870, d. CDR-L1 comprising the amino acid sequence of SEQ ID NO: 1057, e. CDR-L2 comprising the amino acid sequence of SEQ ID NO: 1599, and f. CDR-L3 comprising the amino acid sequence of SEQ ID NO: 2141.

In one aspect, the present disclosure provides an antibody or antigen-binding fragment thereof comprising a CDR-H3 comprising the amino acid sequence of SEQ ID NO: 1870, and a CDR-L3 comprising the amino acid sequence of SEQ ID NO: 2141.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 786, b. CDR-H2 comprising the amino acid sequence of SEQ ID NO: 1328, c. CDR-H3 comprising the amino acid sequence of SEQ ID NO: 1870, and a. VL comprising the amino acid sequence of SEQ ID NO: 515.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1057, b. CDR-L2 comprising the amino acid sequence of SEQ ID NO: 1599, c. CDR-L3 comprising the amino acid sequence of SEQ ID NO: 2141, and d. VH comprising the amino acid sequence of SEQ ID NO: 244.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 244. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 244. In some embodiments, substitutions, insertions, or deletions occur in regions outside the CDRs (e.g., in the FRs). Optionally, the antibody or antigen-binding fragment thereof comprises the VH sequence SEQ ID NO: 244, including one or more post-translational modifications of that sequence. In a particular embodiment, the VH comprises one, two or three CDRs selected from: a. CDR-H1, comprising the amino acid sequence SEQ ID NO: 786, b. CDR-H2, comprising the amino acid sequence SEQ ID NO: 1328, and c. CDR-H3, comprising the amino acid sequence SEQ ID NO: 1870.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 515. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 515. In some embodiments, the substitutions, insertions, or deletions occur in regions outside the CDRs (e.g., in the FRs). Optionally, the antibody or antigen-binding fragment thereof comprises the VL sequence SEQ ID NO: 515, including one or more post-translational modifications of that sequence. In a particular embodiment, the VL comprises one, two or three CDRs selected from: a. CDR-L1, comprising the amino acid sequence SEQ ID NO: 1057, b. CDR-L2, comprising the amino acid sequence SEQ ID NO: 1599, and c. CDR-L3, comprising the amino acid sequence SEQ ID NO: 2141.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 244, and the VL amino acid sequence of SEQ ID NO: 515, optionally including post-translational modifications of those sequences.

TTES1005

In one aspect, the present disclosure provides an antibody or antigen-binding fragment thereof comprising at least one or both variable regions selected from: a. VH comprising the amino acid sequence of SEQ ID NO: 245 and b. VL comprising the amino acid sequence of SEQ ID NO: 516.

In one aspect, the present disclosure provides an antibody or antigen-binding fragment thereof comprising at least one, two, three, four, five, or six CDRs selected from: a. CDR-H1 comprising the amino acid sequence of SEQ ID NO: 787, b. CDR-H2 comprising the amino acid sequence of SEQ ID NO: 1329, c. CDR-H3 comprising the amino acid sequence of SEQ ID NO: 1871, d. CDR-L1 comprising the amino acid sequence of SEQ ID NO: 1058, e. CDR-L2 comprising the amino acid sequence of SEQ ID NO: 1600, and f. CDR-L3 comprising the amino acid sequence of SEQ ID NO: 2142.

In one aspect, the present disclosure provides an antibody or antigen-binding fragment thereof comprising a CDR-H3 comprising the amino acid sequence of SEQ ID NO: 1871, and a CDR-L3 comprising the amino acid sequence of SEQ ID NO: 2142.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 787, b. CDR-H2 comprising the amino acid sequence of SEQ ID NO: 1329, c. CDR-H3 comprising the amino acid sequence of SEQ ID NO: 1871, and d. VL comprising the amino acid sequence of SEQ ID NO: 516.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1058, b. CDR-L2 comprising the amino acid sequence of SEQ ID NO: 1600, c. CDR-L3 comprising the amino acid sequence of SEQ ID NO: 2142, and a VH comprising the amino acid sequence of SEQ ID NO: 245.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 245. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 245. In some embodiments, substitutions, insertions, or deletions occur in regions outside the CDRs (e.g., in the FRs). Optionally, the antibody or antigen-binding fragment thereof comprises the VH sequence SEQ ID NO: 245, including one or more post-translational modifications of that sequence. In a particular embodiment, the VH comprises one, two or three CDRs selected from: a. CDR-H1, comprising the amino acid sequence SEQ ID NO: 787, b. CDR-H2, comprising the amino acid sequence SEQ ID NO: 1329, and c. CDR-H3, comprising the amino acid sequence SEQ ID NO: 1871.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 516. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 516. In some embodiments, the substitutions, insertions, or deletions occur in regions outside the CDRs (e.g., in the FRs). Optionally, the antibody or antigen-binding fragment thereof comprises the VL sequence SEQ ID NO: 516, including one or more post-translational modifications of that sequence. In a particular embodiment, the VL comprises one, two or three CDRs selected from: a. CDR-L1, comprising the amino acid sequence SEQ ID NO: 1058, b. CDR-L2, comprising the amino acid sequence SEQ ID NO: 1600, and c. CDR-L3, comprising the amino acid sequence SEQ ID NO: 2142.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 245, and the VL amino acid sequence of SEQ ID NO: 516, optionally including post-translational modifications of those sequences.
TTES1006

In one aspect, the present disclosure provides an antibody or antigen-binding fragment thereof comprising at least one or both variable regions selected from: a. VH comprising the amino acid sequence of SEQ ID NO: 246 and b. VL comprising the amino acid sequence of SEQ ID NO: 517.

In one aspect, the present disclosure provides an antibody or antigen-binding fragment thereof comprising at least one, two, three, four, five, or six CDRs selected from: a. CDR-H1 comprising the amino acid sequence of SEQ ID NO: 788, b. CDR-H2 comprising the amino acid sequence of SEQ ID NO: 1330, c. CDR-H3 comprising the amino acid sequence of SEQ ID NO: 1872, d. CDR-L1 comprising the amino acid sequence of SEQ ID NO: 1059, e. CDR-L2 comprising the amino acid sequence of SEQ ID NO: 1601, and f. CDR-L3 comprising the amino acid sequence of SEQ ID NO: 2143.

In one aspect, the present disclosure provides an antibody or antigen-binding fragment thereof comprising a CDR-H3 comprising the amino acid sequence of SEQ ID NO: 1872, a CDR-L3 comprising the amino acid sequence of SEQ ID NO: 2143.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 788, b. CDR-H2 comprising the amino acid sequence of SEQ ID NO: 1330, c. CDR-H3 comprising the amino acid sequence of SEQ ID NO: 1872, and a VL comprising the amino acid sequence of SEQ ID NO: 517.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1059, b. CDR-L2 comprising the amino acid sequence of SEQ ID NO: 1601, c. CDR-L3 comprising the amino acid sequence of SEQ ID NO: 2143, and a VH comprising the amino acid sequence of SEQ ID NO: 246.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 246. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 246. In some embodiments, substitutions, insertions, or deletions occur in regions outside the CDRs (e.g., in the FRs). Optionally, the antibody or antigen-binding fragment thereof comprises the VH sequence SEQ ID NO: 246, including one or more post-translational modifications of that sequence. In a particular embodiment, the VH comprises one, two or three CDRs selected from: a. CDR-H1, comprising the amino acid sequence SEQ ID NO: 788, b. CDR-H2, comprising the amino acid sequence SEQ ID NO: 1330, and c. CDR-H3, comprising the amino acid sequence SEQ ID NO: 1872.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 517. In some embodiments, a VL sequence having at least 90%, 91%, 92%, 93%, 94%, 95%, 96%, 97%, 98%, or 99% identity contains substitutions (e.g., conservative substitutions), thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 517. In some embodiments, the substitutions, insertions, or deletions occur in regions outside the CDRs (e.g., in the FRs). Optionally, the antibody or antigen-binding fragment thereof comprises the VL sequence SEQ ID NO: 517, including one or more post-translational modifications of that sequence. In a particular embodiment, the VL comprises one, two or three CDRs selected from: a. CDR-L1, comprising the amino acid sequence SEQ ID NO: 1059, b. CDR-L2, comprising the amino acid sequence SEQ ID NO: 1601, and c. CDR-L3, comprising the amino acid sequence SEQ ID NO: 2143.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 246, and the VL amino acid sequence of SEQ ID NO: 517, optionally including post-translational modifications of those sequences.
TTES1007

In one aspect, the present disclosure provides an antibody or antigen-binding fragment thereof comprising at least one or both variable regions selected from: a. VH comprising the amino acid sequence of SEQ ID NO: 247 and b. VL comprising the amino acid sequence of SEQ ID NO: 518.

In one aspect, the present disclosure provides an antibody or antigen-binding fragment thereof comprising at least one, two, three, four, five, or six CDRs selected from: a. CDR-H1 comprising the amino acid sequence of SEQ ID NO: 789, b. CDR-H2 comprising the amino acid sequence of SEQ ID NO: 1331, c. CDR-H3 comprising the amino acid sequence of SEQ ID NO: 1873, d. CDR-L1 comprising the amino acid sequence of SEQ ID NO: 1060, e. CDR-L2 comprising the amino acid sequence of SEQ ID NO: 1602, and f. CDR-L3 comprising the amino acid sequence of SEQ ID NO: 2144.

In one aspect, the present disclosure provides an antibody or antigen-binding fragment thereof comprising a CDR-H3 comprising the amino acid sequence of SEQ ID NO: 1873, and a CDR-L3 comprising the amino acid sequence of SEQ ID NO: 2144.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 789, b. CDR-H2 comprising the amino acid sequence of SEQ ID NO: 1331, c. CDR-H3 comprising the amino acid sequence of SEQ ID NO: 1873, and a VL comprising the amino acid sequence of SEQ ID NO: 518.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1060, b. CDR-L2 comprising the amino acid sequence of SEQ ID NO: 1602, c. CDR-L3 comprising the amino acid sequence of SEQ ID NO: 2144, and a VH comprising the amino acid sequence of SEQ ID NO: 247.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 247. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 247. In some embodiments, substitutions, insertions, or deletions occur in regions outside the CDRs (e.g., in the FRs). Optionally, the antibody or antigen-binding fragment thereof comprises the VH sequence SEQ ID NO: 247, including one or more post-translational modifications of that sequence. In a particular embodiment, the VH comprises one, two or three CDRs selected from: a. CDR-H1, comprising the amino acid sequence SEQ ID NO: 789, b. CDR-H2, comprising the amino acid sequence SEQ ID NO: 1331, and c. CDR-H3, comprising the amino acid sequence SEQ ID NO: 1873.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 518. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 518. In some embodiments, the substitutions, insertions, or deletions occur in regions outside the CDRs (e.g., in the FRs). Optionally, the antibody or antigen-binding fragment thereof comprises the VL sequence SEQ ID NO: 518, including one or more post-translational modifications of that sequence. In a particular embodiment, the VL comprises one, two or three CDRs selected from: a. CDR-L1, comprising the amino acid sequence SEQ ID NO: 1060, b. CDR-L2, comprising the amino acid sequence SEQ ID NO: 1602, and c. CDR-L3, comprising the amino acid sequence SEQ ID NO: 2144.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 247, and the VL amino acid sequence of SEQ ID NO: 518, optionally including post-translational modifications of those sequences.
TTES1008

In one aspect, the present disclosure provides an antibody or antigen-binding fragment thereof comprising at least one or both variable regions selected from: a. VH comprising the amino acid sequence of SEQ ID NO: 248 and b. VL comprising the amino acid sequence of SEQ ID NO: 519.

In one aspect, the present disclosure provides an antibody or antigen-binding fragment thereof comprising at least one, two, three, four, five, or six CDRs selected from: a. CDR-H1 comprising the amino acid sequence of SEQ ID NO: 790, b. CDR-H2 comprising the amino acid sequence of SEQ ID NO: 1332, c. CDR-H3 comprising the amino acid sequence of SEQ ID NO: 1874, d. CDR-L1 comprising the amino acid sequence of SEQ ID NO: 1061, CDR-L2 comprising the amino acid sequence of SEQ ID NO: 1603, and f. CDR-L3 comprising the amino acid sequence of SEQ ID NO: 2145.

In one aspect, the present disclosure provides an antibody or antigen-binding fragment thereof comprising at least one, two, three, four, five, or six CDRs selected from: a CDR-H3 comprising the amino acid sequence of SEQ ID NO: 1874, and a CDR-L3 comprising the amino acid sequence of SEQ ID NO: 2145.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 790, b. CDR-H2 comprising the amino acid sequence of SEQ ID NO: 1332, c. CDR-H3 comprising the amino acid sequence of SEQ ID NO: 1874, and a VL comprising the amino acid sequence of SEQ ID NO: 519.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1061, b. CDR-L2 comprising the amino acid sequence of SEQ ID NO: 1603, c. CDR-L3 comprising the amino acid sequence of SEQ ID NO: 2145, and a VH comprising the amino acid sequence of SEQ ID NO: 248.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 248. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 248. In some embodiments, substitutions, insertions, or deletions occur in regions outside the CDRs (e.g., in the FRs). Optionally, the antibody or antigen-binding fragment thereof comprises the VH sequence SEQ ID NO: 248, including one or more post-translational modifications of that sequence. In a particular embodiment, the VH comprises one, two or three CDRs selected from: a. CDR-H1, comprising the amino acid sequence SEQ ID NO: 790, b. CDR-H2, comprising the amino acid sequence SEQ ID NO: 1332, and c. CDR-H3, comprising the amino acid sequence SEQ ID NO: 1874.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 519. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 519. In some embodiments, the substitutions, insertions, or deletions occur in regions outside the CDRs (e.g., in the FRs). Optionally, the antibody or antigen-binding fragment thereof comprises the VL sequence SEQ ID NO: 519, including one or more post-translational modifications of that sequence. In a particular embodiment, the VL comprises one, two or three CDRs selected from: a. CDR-L1, comprising the amino acid sequence SEQ ID NO: 1061, b. CDR-L2, comprising the amino acid sequence SEQ ID NO: 1603, and c. CDR-L3, comprising the amino acid sequence SEQ ID NO: 2145.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 248, and the VL amino acid sequence of SEQ ID NO: 519, optionally including post-translational modifications of those sequences.

TTES1009

In one aspect, the present disclosure provides an antibody or antigen-binding fragment thereof comprising at least one or both variable regions selected from: a. VH comprising the amino acid sequence of SEQ ID NO: 249 and b. VL comprising the amino acid sequence of SEQ ID NO: 520.

In one aspect, the present disclosure provides an antibody or antigen-binding fragment thereof comprising at least one, two, three, four, five, or six CDRs selected from: a. CDR-H1 comprising the amino acid sequence of SEQ ID NO: 791, b. CDR-H2 comprising the amino acid sequence of SEQ ID NO: 1333, c. CDR-H3 comprising the amino acid sequence of SEQ ID NO: 1875, d. CDR-L1 comprising the amino acid sequence of SEQ ID NO: 1062, e. CDR-L2 comprising the amino acid sequence of SEQ ID NO: 1604, and f. CDR-L3 comprising the amino acid sequence of SEQ ID NO: 2146.

In one aspect, the present disclosure provides an antibody or antigen-binding fragment thereof comprising a CDR-H3 comprising the amino acid sequence of SEQ ID NO: 1875, and a CDR-L3 comprising the amino acid sequence of SEQ ID NO: 2146.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 791, b. CDR-H2 comprising the amino acid sequence of SEQ ID NO: 1333, c. CDR-H3 comprising the amino acid sequence of SEQ ID NO: 1875, and a VL comprising the amino acid sequence of SEQ ID NO: 520.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1062, b. CDR-L2 comprising the amino acid sequence of SEQ ID NO: 1604, c. CDR-L3 comprising the amino acid sequence of SEQ ID NO: 2146, and a VH comprising the amino acid sequence of SEQ ID NO: 249.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 249. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 249. In some embodiments, substitutions, insertions, or deletions occur in regions outside the CDRs (e.g., in the FRs). Optionally, the antibody or antigen-binding fragment thereof comprises the VH sequence SEQ ID NO: 249, including one or more post-translational modifications of that sequence. In a particular embodiment, the VH comprises one, two or three CDRs selected from: a. CDR-H1, comprising the amino acid sequence SEQ ID NO: 791, b. CDR-H2, comprising the amino acid sequence SEQ ID NO: 1333, and c. CDR-H3, comprising the amino acid sequence SEQ ID NO: 1875.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 520. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 520. In some embodiments, the substitutions, insertions, or deletions occur in regions outside the CDRs (e.g., in the FRs). Optionally, the antibody or antigen-binding fragment thereof comprises the VL sequence SEQ ID NO: 520, including one or more post-translational modifications of that sequence. In a particular embodiment, the VL comprises one, two or three CDRs selected from: a. CDR-L1, comprising the amino acid sequence SEQ ID NO: 1062, b. CDR-L2, comprising the amino acid sequence SEQ ID NO: 1604, and c. CDR-L3, comprising the amino acid sequence SEQ ID NO: 2146.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 249, and the VL amino acid sequence of SEQ ID NO: 520, optionally including post-translational modifications of those sequences.
TTES1010

In one aspect, the present disclosure provides an antibody or antigen-binding fragment thereof comprising at least one or both variable regions selected from: a. VH comprising the amino acid sequence of SEQ ID NO: 250 and b. VL comprising the amino acid sequence of SEQ ID NO: 521.

In one aspect, the present disclosure provides an antibody or antigen-binding fragment thereof comprising at least one, two, three, four, five, or six CDRs selected from: a. CDR-H1 comprising the amino acid sequence of SEQ ID NO: 792, b. CDR-H2 comprising the amino acid sequence of SEQ ID NO: 1334, c. CDR-H3 comprising the amino acid sequence of SEQ ID NO: 1876, d. CDR-L1 comprising the amino acid sequence of SEQ ID NO: 1063, e. CDR-L2 comprising the amino acid sequence of SEQ ID NO: 1605, and f. CDR-L3 comprising the amino acid sequence of SEQ ID NO: 2147.

In one aspect, the present disclosure provides an antibody or antigen-binding fragment thereof comprising a CDR-H3 comprising the amino acid sequence of SEQ ID NO: 1876, and a CDR-L3 comprising the amino acid sequence of SEQ ID NO: 2147.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 792, b. CDR-H2 comprising the amino acid sequence of SEQ ID NO: 1334, c. CDR-H3 comprising the amino acid sequence of SEQ ID NO: 1876, and a VL comprising the amino acid sequence of SEQ ID NO: 521.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1063, b. CDR-L2 comprising the amino acid sequence of SEQ ID NO: 1605, c. CDR-L3 comprising the amino acid sequence of SEQ ID NO: 2147, and a VH comprising the amino acid sequence of SEQ ID NO: 250.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 250. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 250. In some embodiments, substitutions, insertions, or deletions occur in regions outside the CDRs (e.g., in the FRs). Optionally, the antibody or antigen-binding fragment thereof comprises the VH sequence SEQ ID NO: 250, including one or more post-translational modifications of that sequence. In a particular embodiment, the VH comprises one, two or three CDRs selected from: a. CDR-H1, comprising the amino acid sequence SEQ ID NO: 792, b. CDR-H2, comprising the amino acid sequence SEQ ID NO: 1334, and c. CDR-H3, comprising the amino acid sequence SEQ ID NO: 1876.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 521. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 521. In some embodiments, the substitutions, insertions, or deletions occur in regions outside the CDRs (e.g., in the FRs). Optionally, the antibody or antigen-binding fragment thereof comprises the VL sequence SEQ ID NO: 521, including one or more post-translational modifications of that sequence. In a particular embodiment, the VL comprises one, two or three CDRs selected from: a. CDR-L1, comprising the amino acid sequence SEQ ID NO: 1063, b. CDR-L2, comprising the amino acid sequence SEQ ID NO: 1605, and c. CDR-L3, comprising the amino acid sequence SEQ ID NO: 2147.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 250, and the VL amino acid sequence of SEQ ID NO: 521, optionally including post-translational modifications of those sequences.
TTES1011

In one aspect, the present disclosure provides an antibody or antigen-binding fragment thereof comprising at least one or both variable regions selected from: a. VH comprising the amino acid sequence of SEQ ID NO: 251 and b. VL comprising the amino acid sequence of SEQ ID NO: 522.

In one aspect, the present disclosure provides an antibody or antigen-binding fragment thereof comprising at least one, two, three, four, five, or six CDRs selected from: a. CDR-H1 comprising the amino acid sequence of SEQ ID NO: 793, b. CDR-H2 comprising the amino acid sequence of SEQ ID NO: 1335, c. CDR-H3 comprising the amino acid sequence of SEQ ID NO: 1877, d. CDR-L1 comprising the amino acid sequence of SEQ ID NO: 1064, e. CDR-L2 comprising the amino acid sequence of SEQ ID NO: 1606, and f. CDR-L3 comprising the amino acid sequence of SEQ ID NO: 2148.

In one aspect, the present disclosure provides an antibody or antigen-binding fragment thereof comprising a CDR-H3 comprising the amino acid sequence of SEQ ID NO: 1877, and a CDR-L3 comprising the amino acid sequence of SEQ ID NO: 2148.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 793, b. CDR-H2 comprising the amino acid sequence of SEQ ID NO: 1335, c. CDR-H3 comprising the amino acid sequence of SEQ ID NO: 1877, and a VL comprising the amino acid sequence of SEQ ID NO: 522.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1064, b. CDR-L2 comprising the amino acid sequence of SEQ ID NO: 1606, c. CDR-L3 comprising the amino acid sequence of SEQ ID NO: 2148, and a VH comprising the amino acid sequence of SEQ ID NO: 251.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 251. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 251. In some embodiments, substitutions, insertions, or deletions occur in regions outside the CDRs (e.g., in the FRs). Optionally, the antibody or antigen-binding fragment thereof comprises the VH sequence SEQ ID NO: 251, including one or more post-translational modifications of that sequence. In a particular embodiment, the VH comprises one, two or three CDRs selected from: a. CDR-H1, comprising the amino acid sequence SEQ ID NO: 793, b. CDR-H2, comprising the amino acid sequence SEQ ID NO: 1335, and c. CDR-H3, comprising the amino acid sequence SEQ ID NO: 1877.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 522. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 522. In some embodiments, the substitutions, insertions, or deletions occur in regions outside the CDRs (e.g., in the FRs). Optionally, the antibody or antigen-binding fragment thereof comprises the VL sequence SEQ ID NO: 522, including one or more post-translational modifications of that sequence. In a particular embodiment, the VL comprises one, two or three CDRs selected from: a. CDR-L1, comprising the amino acid sequence SEQ ID NO: 1064, b. CDR-L2, comprising the amino acid sequence SEQ ID NO: 1606, and c. CDR-L3, comprising the amino acid sequence SEQ ID NO: 2148.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 251, and the VL amino acid sequence of SEQ ID NO: 522, optionally including post-translational modifications of those sequences.

TTES1012

In one aspect, the present disclosure provides an antibody or antigen-binding fragment thereof comprising at least one or both variable regions selected from: a. VH comprising the amino acid sequence of SEQ ID NO: 252 and b. VL comprising the amino acid sequence of SEQ ID NO: 523.

In one aspect, the present disclosure provides an antibody or antigen-binding fragment thereof comprising at least one, two, three, four, five, or six CDRs selected from: a. CDR-H1 comprising the amino acid sequence of SEQ ID NO: 794, b. CDR-H2 comprising the amino acid sequence of SEQ ID NO: 1336, c. CDR-H3 comprising the amino acid sequence of SEQ ID NO: 1878, d. CDR-L1 comprising the amino acid sequence of SEQ ID NO: 1065, e. CDR-L2 comprising the amino acid sequence of SEQ ID NO: 1607, and f. CDR-L3 comprising the amino acid sequence of SEQ ID NO: 2149.

In one aspect, the present disclosure provides an antibody or antigen-binding fragment thereof comprising a CDR-H3 comprising the amino acid sequence of SEQ ID NO: 1878, and a CDR-L3 comprising the amino acid sequence of SEQ ID NO: 2149.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 794, b. CDR-H2 comprising the amino acid sequence of SEQ ID NO: 1336, c. CDR-H3 comprising the amino acid sequence of SEQ ID NO: 1878, and a VL comprising the amino acid sequence of SEQ ID NO: 523.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1065, b. CDR-L2 comprising the amino acid sequence of SEQ ID NO: 1607, c. CDR-L3 comprising the amino acid sequence of SEQ ID NO: 2149, and a VH comprising the amino acid sequence of SEQ ID NO: 252.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 252. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 252. In some embodiments, substitutions, antigen-binding fragment thereof comprises the VH sequence SEQ ID NO: 252, including one or more post-translational modifications of that sequence. In a particular embodiment, the VH comprises one, two or three CDRs selected from: a. CDR-H1, comprising the amino acid sequence SEQ ID NO: 794, b. CDR-H2, comprising the amino acid sequence SEQ ID NO: 1336, and c. CDR-H3, comprising the amino acid sequence SEQ ID NO: 1878.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 523. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 523. In some embodiments, the substitutions, insertions, or deletions occur in regions outside the CDRs (e.g., in the FRs). Optionally, the antibody or antigen-binding fragment thereof comprises the VL sequence SEQ ID NO: 523, including one or more post-translational modifications of that sequence. In a particular embodiment, the VL comprises one, two or three CDRs selected from: a. CDR-L1, comprising the amino acid sequence SEQ ID NO: 1065, b. CDR-L2, comprising the amino acid sequence SEQ ID NO: 1607, and c. CDR-L3, comprising the amino acid sequence SEQ ID NO: 2149.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 252, and the VL amino acid sequence of SEQ ID NO: 523, optionally including post-translational modifications of those sequences.

TTHY1001

In one aspect, the present disclosure provides an antibody or antigen-binding fragment thereof comprising at least one or both variable regions selected from: a. VH comprising the amino acid sequence of SEQ ID NO: 253 and b. VL comprising the amino acid sequence of SEQ ID NO: 524.

In one aspect, the present disclosure provides an antibody or antigen-binding fragment thereof comprising at least one, two, three, four, five, or six CDRs selected from: a CDR-H1 comprising the amino acid sequence of SEQ ID NO: 795, b. CDR-H2 comprising the amino acid sequence of SEQ ID NO: 1337, c. CDR-H3 comprising the amino acid sequence of SEQ ID NO: 1879, d. CDR-L1 comprising the amino acid sequence of SEQ ID NO: 1066, e. CDR-L2 comprising the amino acid sequence of SEQ ID NO: 1608, and f. CDR-L3 comprising the amino acid sequence of SEQ ID NO: 2150.

In one aspect, the present disclosure provides an antibody or antigen-binding fragment thereof comprising a CDR-H3 comprising the amino acid sequence of SEQ ID NO: 1879, and a CDR-L3 comprising the amino acid sequence of SEQ ID NO: 2150.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 795, b. CDR-H2 comprising the amino acid sequence of SEQ ID NO: 1337, c. CDR-H3 comprising the amino acid sequence of SEQ ID NO: 1879, and a VL comprising the amino acid sequence of SEQ ID NO: 524.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1066, b. CDR-L2 comprising the amino acid sequence of SEQ ID NO: 1608, c. CDR-L3 comprising the amino acid sequence of SEQ ID NO: 2150, and a VH comprising the amino acid sequence of SEQ ID NO: 253.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 253. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 253. In some embodiments, substitutions, insertions, or deletions occur in regions outside the CDRs (e.g., in the FRs). Optionally, the antibody or antigen-binding fragment thereof comprises the VH sequence SEQ ID NO: 253, including one or more post-translational modifications of that sequence. In a particular embodiment, the VH comprises one, two or three CDRs selected from: a. CDR-H1, comprising the amino acid sequence SEQ ID NO: 795, b. CDR-H2, comprising the amino acid sequence SEQ ID NO: 1337, and c. CDR-H3, comprising the amino acid sequence SEQ ID NO: 1879.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 524. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 524. In some embodiments, the substitutions, insertions, or deletions occur in regions outside the CDRs (e.g., in the FRs). Optionally, the antibody or antigen-binding fragment thereof comprises the VL sequence SEQ ID NO: 524, including one or more post-translational modifications of that sequence. In a particular embodiment, the VL comprises one, two or three CDRs selected from: a. CDR-L1, comprising the amino acid sequence SEQ ID NO: 1066, b. CDR-L2, comprising the amino acid sequence SEQ ID NO: 1608, and c. CDR-L3, comprising the amino acid sequence SEQ ID NO: 2150.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 253, and the VL amino acid sequence of SEQ ID NO: 524, optionally including post-translational modifications of those sequences.
TTHY1002

In one aspect, the present disclosure provides an antibody or antigen-binding fragment thereof comprising at least one or both variable regions selected from: a. VH comprising the amino acid sequence of SEQ ID NO: 254 and b. VL comprising the amino acid sequence of SEQ ID NO: 525.

In one aspect, the present disclosure provides an antibody or antigen-binding fragment thereof comprising at least one, two, three, four, five, or six CDRs selected from: a. CDR-H1 comprising the amino acid sequence of SEQ ID NO: 796, b. CDR-H2 comprising the amino acid sequence of SEQ ID NO: 1338, c. CDR-H3 comprising the amino acid sequence of SEQ ID NO: 1880, d. CDR-L1 comprising the amino acid sequence of SEQ ID NO: 1067, e. CDR-L2 comprising the amino acid sequence of SEQ ID NO: 1609, and f. CDR-L3 comprising the amino acid sequence of SEQ ID NO: 2151.

In one aspect, the present disclosure provides an antibody or antigen-binding fragment thereof comprising a CDR-H3 comprising the amino acid sequence of SEQ ID NO: 1880 and a CDR-L3 comprising the amino acid sequence of SEQ ID NO: 2151.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 796, b. CDR-H2 comprising the amino acid sequence of SEQ ID NO: 1338, c. CDR-H3 comprising the amino acid sequence of SEQ ID NO: 1880, and a VL comprising the amino acid sequence of SEQ ID NO: 525.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1067, b. CDR-L2 comprising the amino acid sequence of SEQ ID NO: 1609, c. CDR-L3 comprising the amino acid sequence of SEQ ID NO: 2151, and a VH comprising the amino acid sequence of SEQ ID NO: 254.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 254. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 254. In some embodiments, substitutions, insertions, or deletions occur in regions outside the CDRs (e.g., in the FRs). Optionally, the antibody or antigen-binding fragment thereof comprises the VH sequence SEQ ID NO: 254, including one or more post-translational modifications of that sequence. In a particular embodiment, the VH comprises one, two or three CDRs selected from: a. CDR-H1, comprising the amino acid sequence SEQ ID NO: 796, b. CDR-H2, comprising the amino acid sequence SEQ ID NO: 1338, and c. CDR-H3, comprising the amino acid sequence SEQ ID NO: 1880.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 525. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 525. In some embodiments, the substitutions, insertions, or deletions occur in regions outside the CDRs (e.g., in the FRs). Optionally, the antibody or antigen-binding fragment thereof comprises the VL sequence SEQ ID NO: 525, including one or more post-translational modifications of that sequence. In a particular embodiment, the VL comprises one, two or three CDRs selected from: a. CDR-L1, comprising the amino acid sequence SEQ ID NO: 1067, b. CDR-L2, comprising the amino acid sequence SEQ ID NO: 1609, and c. CDR-L3, comprising the amino acid sequence SEQ ID NO: 2151.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 254, and the VL amino acid sequence of SEQ ID NO: 525, optionally including post-translational modifications of those sequences.
TTHY1003

In one aspect, the present disclosure provides an antibody or antigen-binding fragment thereof comprising at least one or both variable regions selected from: a. VH comprising the amino acid sequence of SEQ ID NO: 255 and b. VL comprising the amino acid sequence of SEQ ID NO: 526.

In one aspect, the present disclosure provides an antibody or antigen-binding fragment thereof comprising at least one, two, three, four, five, or six CDRs selected from: a. CDR-H1 comprising the amino acid sequence of SEQ ID NO: 797, b. CDR-H2 comprising the amino acid sequence of SEQ ID NO: 1339, c. CDR-H3 comprising the amino acid sequence of SEQ ID NO: 1881, d. CDR-L1 comprising the amino acid sequence of SEQ ID NO: 1068, e. CDR-L2 comprising the amino acid sequence of SEQ ID NO: 1610, and f. CDR-L3 comprising the amino acid sequence of SEQ ID NO: 2152.

In one aspect, the present disclosure provides an antibody or antigen-binding fragment thereof comprising a CDR-H3 comprising the amino acid sequence of SEQ ID NO: 1881 and a CDR-L3 comprising the amino acid sequence of SEQ ID NO: 2152.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 797, b. CDR-H2 comprising the amino acid sequence of SEQ ID NO: 1339, c. CDR-H3 comprising the amino acid sequence of SEQ ID NO: 1881, and a VL comprising the amino acid sequence of SEQ ID NO: 526.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1068, b. CDR-L2 comprising the amino acid sequence of SEQ ID NO: 1610, c. CDR-L3 comprising the amino acid sequence of SEQ ID NO: 2152, and a VH comprising the amino acid sequence of SEQ ID NO: 255.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 255. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 255. In some embodiments, substitutions, insertions, or deletions occur in regions outside the CDRs (e.g., in the FRs). Optionally, the antibody or antigen-binding fragment thereof comprises the VH sequence SEQ ID NO: 255, including one or more post-translational modifications of that sequence. In a particular embodiment, the VH comprises one, two or three CDRs selected from: a. CDR-H1, comprising the amino acid sequence SEQ ID NO: 797, b. CDR-H2, comprising the amino acid sequence SEQ ID NO: 1339, and c. CDR-H3, comprising the amino acid sequence SEQ ID NO: 1881.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 526. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 526. In some embodiments, the substitutions, antigen-binding fragment thereof comprises the VL sequence SEQ ID NO: 526, including one or more post-translational modifications of that sequence. In a particular embodiment, the VL comprises one, two or three CDRs selected from: a. CDR-L1, comprising the amino acid sequence SEQ ID NO: 1068, b. CDR-L2, comprising the amino acid sequence SEQ ID NO: 1610, and c. CDR-L3, comprising the amino acid sequence SEQ ID NO: 2152.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 255, and the VL amino acid sequence of SEQ ID NO: 526, optionally including post-translational modifications of those sequences.

TTHY1004

In one aspect, the present disclosure provides an antibody or antigen-binding fragment thereof comprising at least one or both variable regions selected from: a. VH comprising the amino acid sequence of SEQ ID NO: 256 and b. VL comprising the amino acid sequence of SEQ ID NO: 527.

In one aspect, the present disclosure provides an antibody or antigen-binding fragment thereof comprising at least one, two, three, four, five, or six CDRs selected from: a. CDR-H1 comprising the amino acid sequence of SEQ ID NO: 798, b. CDR-H2 comprising the amino acid sequence of SEQ ID NO: 1340, c. CDR-H3 comprising the amino acid sequence of SEQ ID NO: 1882, d. CDR-L1 comprising the amino acid sequence of SEQ ID NO: 1069, e. CDR-L2 comprising the amino acid sequence of SEQ ID NO: 1611, and f. CDR-L3 comprising the amino acid sequence of SEQ ID NO: 2153.

In one aspect, the present disclosure provides an antibody or antigen-binding fragment thereof comprising a CDR-H3 comprising the amino acid sequence of SEQ ID NO: 1882, and a CDR-L3 comprising the amino acid sequence of SEQ ID NO: 2153.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 798, b. CDR-H2 comprising the amino acid sequence of SEQ ID NO: 1340, c. CDR-H3 comprising the amino acid sequence of SEQ ID NO: 1882, and a VL comprising the amino acid sequence of SEQ ID NO: 527.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1069, b. CDR-L2 comprising the amino acid sequence of SEQ ID NO: 1611, c. CDR-L3 comprising the amino acid sequence of SEQ ID NO: 2153, and a VH comprising the amino acid sequence of SEQ ID NO: 256.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 256. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 256. In some embodiments, substitutions, insertions, or deletions occur in regions outside the CDRs (e.g., in the FRs). Optionally, the antibody or antigen-binding fragment thereof comprises the VH sequence SEQ ID NO: 256, including one or more post-translational modifications of that sequence. In a particular embodiment, the VH comprises one, two or three CDRs selected from: a. CDR-H1, comprising the amino acid sequence SEQ ID NO: 798, b. CDR-H2, comprising the amino acid sequence SEQ ID NO: 1340, and c. CDR-H3, comprising the amino acid sequence SEQ ID NO: 1882.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 527. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 527. In some embodiments, the substitutions, insertions, or deletions occur in regions outside the CDRs (e.g., in the FRs). Optionally, the antibody or antigen-binding fragment thereof comprises the VL sequence SEQ ID NO: 527, including one or more post-translational modifications of that sequence. In a particular embodiment, the VL comprises one, two or three CDRs selected from: a. CDR-L1, comprising the amino acid sequence SEQ ID NO: 1069, b. CDR-L2, comprising the amino acid sequence SEQ ID NO: 1611, and c. CDR-L3, comprising the amino acid sequence SEQ ID NO: 2153.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 256, and the VL amino acid sequence of SEQ ID NO: 527, optionally including post-translational modifications of those sequences.
TUCE1001

In one aspect, the present disclosure provides an antibody or antigen-binding fragment thereof comprising at least one or both variable regions selected from: a. VH comprising the amino acid sequence of SEQ ID NO: 257 and b. VL comprising the amino acid sequence of SEQ ID NO: 528.

In one aspect, the present disclosure provides an antibody or antigen-binding fragment thereof comprising at least one, two, three, four, five, or six CDRs selected from: a. CDR-H1 comprising the amino acid sequence of SEQ ID NO: 799, b. CDR-H2 comprising the amino acid sequence of SEQ ID NO: 1341, c. CDR-H3 comprising the amino acid sequence of SEQ ID NO: 1883, d. CDR-L1 comprising the amino acid sequence of SEQ ID NO: 1070, e. CDR-L2 comprising the amino acid sequence of SEQ ID NO: 1612, and f. CDR-L3 comprising the amino acid sequence of SEQ ID NO: 2154.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 799, b. CDR-H2 comprising the amino acid sequence of SEQ ID NO: 1341, b. CDR-H3 comprising the amino acid sequence of SEQ ID NO: 1883, and a VL comprising the amino acid sequence of SEQ ID NO: 528.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1070, b. CDR-L2 comprising the amino acid sequence of SEQ ID NO: 1612, c. CDR-L3 comprising the amino acid sequence of SEQ ID NO: 2154, and a VH comprising the amino acid sequence of SEQ ID NO: 257.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 257. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 257. In some embodiments, substitutions, insertions, or deletions occur in regions outside the CDRs (e.g., in the FRs). Optionally, the antibody or antigen-binding fragment thereof comprises the VH sequence SEQ ID NO: 257, including one or more post-translational modifications of that sequence. In a particular embodiment, the VH comprises one, two or three CDRs selected from: a. CDR-H1, comprising the amino acid sequence SEQ ID NO: 799, b. CDR-H2, comprising the amino acid sequence SEQ ID NO: 1341, and c. CDR-H3, comprising the amino acid sequence SEQ ID NO: 1883.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 528. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 528. In some embodiments, the substitutions, insertions, or deletions occur in regions outside the CDRs (e.g., in the FRs). Optionally, the antibody or antigen-binding fragment thereof comprises the VL sequence SEQ ID NO: 528, including one or more post-translational modifications of that sequence. In a particular embodiment, the VL comprises one, two or three CDRs selected from: a. CDR-L1, comprising the amino acid sequence SEQ ID NO: 1070, b. CDR-L2, comprising the amino acid sequence SEQ ID NO: 1612, and c. CDR-L3, comprising the amino acid sequence SEQ ID NO: 2154.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 257, and the VL amino acid sequence of SEQ ID NO: 528, optionally including post-translational modifications of those sequences.
TUCE1002

In one aspect, the present disclosure provides an antibody or antigen-binding fragment thereof comprising at least one or both variable regions selected from: a. VH comprising the amino acid sequence of SEQ ID NO: 258 and b. VL comprising the amino acid sequence of SEQ ID NO: 529.

In one aspect, the present disclosure provides an antibody or antigen-binding fragment thereof comprising at least one, two, three, four, five, or six CDRs selected from: a. CDR-H1 comprising the amino acid sequence of SEQ ID NO: 800, b. CDR-H2 comprising the amino acid sequence of SEQ ID NO: 1342, c. CDR-H3 comprising the amino acid sequence of SEQ ID NO: 1884, d. CDR-L1 comprising the amino acid sequence of SEQ ID NO: 1071, e. CDR-L2 comprising the amino acid sequence of SEQ ID NO: 1613, and f. CDR-L3 comprising the amino acid sequence of SEQ ID NO: 2155.

In one aspect, the present disclosure provides an antibody or antigen-binding fragment thereof comprising a CDR-H3 comprising the amino acid sequence of SEQ ID NO: 1884, and a CDR-L3 comprising the amino acid sequence of SEQ ID NO: 2155.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 800, b. CDR-H2 comprising the amino acid sequence of SEQ ID NO: 1342, c. CDR-H3 comprising the amino acid sequence of SEQ ID NO: 1884, and a VL comprising the amino acid sequence of SEQ ID NO: 529.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1071, b. CDR-L2 comprising the amino acid sequence of SEQ ID NO: 1613, c. CDR-L3 comprising the amino acid sequence of SEQ ID NO: 2155, and a VH comprising the amino acid sequence of SEQ ID NO: 258.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 258. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 258. In some embodiments, substitutions, insertions, or deletions occur in regions outside the CDRs (e.g., in the FRs). Optionally, the antibody or antigen-binding fragment thereof comprises the VH sequence SEQ ID NO: 258, including one or more post-translational modifications of that sequence. In a particular embodiment, the VH comprises one, two or three CDRs selected from: a. CDR-H1, comprising the amino acid sequence SEQ ID NO: 800, b. CDR-H2, comprising the amino acid sequence SEQ ID NO: 1342, and c. CDR-H3, comprising the amino acid sequence SEQ ID NO: 1884.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 529. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 529. In some embodiments, the substitutions, insertions, or deletions occur in regions outside the CDRs (e.g., in the FRs). Optionally, the antibody or antigen-binding fragment thereof comprises the VL sequence SEQ ID NO: 529, including one or more post-translational modifications of that sequence. In a particular embodiment, the VL comprises one, two or three CDRs selected from: a. CDR-L1, comprising the amino acid sequence SEQ ID NO: 1071, b. CDR-L2, comprising the amino acid sequence SEQ ID NO: 1613, and c. CDR-L3, comprising the amino acid sequence SEQ ID NO: 2155.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 258, and the VL amino acid sequence of SEQ ID NO: 529, optionally including post-translational modifications of those sequences.

TUCE1003

In one aspect, the present disclosure provides an antibody or antigen-binding fragment thereof comprising at least one or both variable regions selected from: a. VH comprising the amino acid sequence of SEQ ID NO: 259 and b. VL comprising the amino acid sequence of SEQ ID NO: 530.

In one aspect, the present disclosure provides an antibody or antigen-binding fragment thereof comprising at least one, two, three, four, five, or six CDRs selected from: a. CDR-H1 comprising the amino acid sequence of SEQ ID NO: 801, b. CDR-H2 comprising the amino acid sequence of SEQ ID NO: 1343, c. CDR-H3 comprising the amino acid sequence of SEQ ID NO: 1885, d. CDR-L1 comprising the amino acid sequence of SEQ ID NO: 1072, e. CDR-L2 comprising the amino acid sequence of SEQ ID NO: 1614, and f. CDR-L3 comprising the amino acid sequence of SEQ ID NO: 2156.

In one aspect, the present disclosure provides an antibody or antigen-binding fragment thereof comprising a CDR-H3 comprising the amino acid sequence of SEQ ID NO: 1885, and a CDR-L3 comprising the amino acid sequence of SEQ ID NO: 2156.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 801, b. CDR-H2 comprising the amino acid sequence of SEQ ID NO: 1343, c. CDR-H3 comprising the amino acid sequence of SEQ ID NO: 1885, and a VL comprising the amino acid sequence of SEQ ID NO: 530.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1072, b. CDR-L2 comprising the amino acid sequence of SEQ ID NO: 1614, c. CDR-L3 comprising the amino acid sequence of SEQ ID NO: 2156, and a VH comprising the amino acid sequence of SEQ ID NO: 259.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 259. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 259. In some embodiments, substitutions, insertions, or deletions occur in regions outside the CDRs (e.g., in the FRs). Optionally, the antibody or antigen-binding fragment thereof comprises the VH sequence SEQ ID NO: 259, including one or more post-translational modifications of that sequence. In a particular embodiment, the VH comprises one, two or three CDRs selected from: a. CDR-H1, comprising the amino acid sequence SEQ ID NO: 801, b. CDR-H2, comprising the amino acid sequence SEQ ID NO: 1343, and c. CDR-H3, comprising the amino acid sequence SEQ ID NO: 1885.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 530. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 530. In some embodiments, the substitutions, insertions, or deletions occur in regions outside the CDRs (e.g., in the FRs). Optionally, the antibody or antigen-binding fragment thereof comprises the VL sequence SEQ ID NO: 530, including one or more post-translational modifications of that sequence. In a particular embodiment, the VL comprises one, two or three CDRs selected from: a. CDR-L1, comprising the amino acid sequence SEQ ID NO: 1072, b. CDR-L2, comprising the amino acid sequence SEQ ID NO: 1614, and c. CDR-L3, comprising the amino acid sequence SEQ ID NO: 2156.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 259, and the VL amino acid sequence of SEQ ID NO: 530, optionally including post-translational modifications of those sequences.

TUCE1004

In one aspect, the present disclosure provides an antibody or antigen-binding fragment thereof comprising at least one or both variable regions selected from: a. VH comprising the amino acid sequence of SEQ ID NO: 260 and b. VL comprising the amino acid sequence of SEQ ID NO: 531.

In one aspect, the present disclosure provides an antibody or antigen-binding fragment thereof comprising at least one, two, three, four, five, or six CDRs selected from: a. CDR-H1 comprising the amino acid sequence of SEQ ID NO: 802, b. CDR-H2 comprising the amino acid sequence of SEQ ID NO: 1344, c. CDR-H3 comprising the amino acid sequence of SEQ ID NO: 1886, d. CDR-L1 comprising the amino acid sequence of SEQ ID NO: 1073, e. CDR-L2 comprising the amino acid sequence of SEQ ID NO: 1615, and f. CDR-L3 comprising the amino acid sequence of SEQ ID NO: 2157.

In one aspect, the present disclosure provides an antibody or antigen-binding fragment thereof comprising a CDR-H3 comprising the amino acid sequence of SEQ ID NO: 1886, and a CDR-L3 comprising the amino acid sequence of SEQ ID NO: 2157.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 802, b. CDR-H2 comprising the amino acid sequence of SEQ ID NO: 1344, c. CDR-H3 comprising the amino acid sequence of SEQ ID NO: 1886, and a VL comprising the amino acid sequence of SEQ ID NO: 531.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1073, b. CDR-L2 comprising the amino acid sequence of SEQ ID NO: 1615, c. CDR-L3 comprising the amino acid sequence of SEQ ID NO: 2157, and a VH comprising the amino acid sequence of SEQ ID NO: 260.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 260. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 260. In some embodiments, substitutions, insertions, or deletions occur in regions outside the CDRs (e.g., in the FRs). Optionally, the antibody or antigen-binding fragment thereof comprises the VH sequence SEQ ID NO: 260, including one or more post-translational modifications of that sequence. In a particular embodiment, the VH comprises one, two or three CDRs selected from: a. CDR-H1, comprising the amino acid sequence SEQ ID NO: 802, b. CDR-H2, comprising the amino acid sequence SEQ ID NO: 1344, and c. CDR-H3, comprising the amino acid sequence SEQ ID NO: 1886.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 531. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 531. In some embodiments, the substitutions, insertions, or deletions occur in regions outside the CDRs (e.g., in the FRs).

Optionally, the antibody or antigen-binding fragment thereof comprises the VL sequence SEQ ID NO: 531, including one or more post-translational modifications of that sequence. In a particular embodiment, the VL comprises one, two or three CDRs selected from: a. CDR-L1, comprising the amino acid sequence SEQ ID NO: 1073, b. CDR-L2, comprising the amino acid sequence SEQ ID NO: 1615, and c. CDR-L3, comprising the amino acid sequence SEQ ID NO: 2157.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 260, and the VL amino acid sequence of SEQ ID NO: 531, optionally including post-translational modifications of those sequences.
TUCE1005

In one aspect, the present disclosure provides an antibody or antigen-binding fragment thereof comprising at least one or both variable regions selected from: a. VH comprising the amino acid sequence of SEQ ID NO: 261 and b. VL comprising the amino acid sequence of SEQ ID NO: 532.

In one aspect, the present disclosure provides an antibody or antigen-binding fragment thereof comprising at least one, two, three, four, five, or six CDRs selected from: a. CDR-H1 comprising the amino acid sequence of SEQ ID NO: 803, b. CDR-H2 comprising the amino acid sequence of SEQ ID NO: 1345, c. CDR-H3 comprising the amino acid sequence of SEQ ID NO: 1887, d. CDR-L1 comprising the amino acid sequence of SEQ ID NO: 1074, e. CDR-L2 comprising the amino acid sequence of SEQ ID NO: 1616, and f. CDR-L3 comprising the amino acid sequence of SEQ ID NO: 2158.

In one aspect, the present disclosure provides an antibody or antigen-binding fragment thereof comprising a CDR-H3 comprising the amino acid sequence of SEQ ID NO: 1887, and a CDR-L3 comprising the amino acid sequence of SEQ ID NO: 2158.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 803, b. CDR-H2 comprising the amino acid sequence of SEQ ID NO: 1345, c. CDR-H3 comprising the amino acid sequence of SEQ ID NO: 1887, and a VL comprising the amino acid sequence of SEQ ID NO: 532.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1074, b. CDR-L2 comprising the amino acid sequence of SEQ ID NO: 1616, c. CDR-L3 comprising the amino acid sequence of SEQ ID NO: 2158, and a VH comprising the amino acid sequence of SEQ ID NO: 261.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 261. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 261. In some embodiments, substitutions, insertions, or deletions occur in regions outside the CDRs (e.g., in the FRs). Optionally, the antibody or antigen-binding fragment thereof comprises the VH sequence SEQ ID NO: 261, including one or more post-translational modifications of that sequence. In a particular embodiment, the VH comprises one, two or three CDRs selected from: a. CDR-H1, comprising the amino acid sequence SEQ ID NO: 803, b. CDR-H2, comprising the amino acid sequence SEQ ID NO: 1345, and c. CDR-H3, comprising the amino acid sequence SEQ ID NO: 1887.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 532. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 532. In some embodiments, the substitutions, insertions, or deletions occur in regions outside the CDRs (e.g., in the FRs). Optionally, the antibody or antigen-binding fragment thereof comprises the VL sequence SEQ ID NO: 532, including one or more post-translational modifications of that sequence. In a particular embodiment, the VL comprises one, two or three CDRs selected from: a. CDR-L1, comprising the amino acid sequence SEQ ID NO: 1074, b. CDR-L2, comprising the amino acid sequence SEQ ID NO: 1616, and c. CDR-L3, comprising the amino acid sequence SEQ ID NO: 2158.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 261, and the VL amino acid sequence of SEQ ID NO: 532, optionally including post-translational modifications of those sequences.
TUCE1006

In one aspect, the present disclosure provides an antibody or antigen-binding fragment thereof comprising at least one or both variable regions selected from: a. VH comprising the amino acid sequence of SEQ ID NO: 262 and b. VL comprising the amino acid sequence of SEQ ID NO: 533.

In one aspect, the present disclosure provides an antibody or antigen-binding fragment thereof comprising at least one, two, three, four, five, or six CDRs selected from: a. CDR-H1 comprising the amino acid sequence of SEQ ID NO: 804, b. CDR-H2 comprising the amino acid sequence of SEQ ID NO: 1346, c. CDR-H3 comprising the amino acid sequence of SEQ ID NO: 1888, d. CDR-L1 comprising the amino acid sequence of SEQ ID NO: 1075, e. CDR-L2 comprising the amino acid sequence of SEQ ID NO: 1617, and f. CDR-L3 comprising the amino acid sequence of SEQ ID NO: 2159.

In one aspect, the present disclosure provides an antibody or antigen-binding fragment thereof comprising a CDR-H3 comprising the amino acid sequence of SEQ ID NO: 1888, and a CDR-L3 comprising the amino acid sequence of SEQ ID NO: 2159.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 804, b. CDR-H2 comprising the amino acid sequence of SEQ ID NO: 1346, c. CDR-H3 comprising the amino acid sequence of SEQ ID NO: 1888, and a VL comprising the amino acid sequence of SEQ ID NO: 533.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1075, b. CDR-L2 comprising the amino acid sequence of SEQ ID NO: 1617, c. CDR-L3 comprising the amino acid sequence of SEQ ID NO: 2159, and a VH comprising the amino acid sequence of SEQ ID NO: 262.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 262. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 262. In some embodiments, substitutions, insertions, or deletions occur in regions outside the CDRs (e.g., in the FRs). Optionally, the antibody or antigen-binding fragment thereof comprises the VH sequence SEQ ID NO: 262, including one or more post-translational modifications of that sequence. In a particular embodiment, the VH comprises one, two or three CDRs selected from: a. CDR-H1, comprising the amino acid sequence SEQ ID NO: 804, b. CDR-H2, comprising the amino acid sequence SEQ ID NO: 1346, and c. CDR-H3, comprising the amino acid sequence SEQ ID NO: 1888.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 533. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 533. In some embodiments, the substitutions, insertions, or deletions occur in regions outside the CDRs (e.g., in the FRs). Optionally, the antibody or antigen-binding fragment thereof comprises the VL sequence SEQ ID NO: 533, including one or more post-translational modifications of that sequence. In a particular embodiment, the VL comprises one, two or three CDRs selected from: a. CDR-L1, comprising the amino acid sequence SEQ ID NO: 1075, b. CDR-L2, comprising the amino acid sequence SEQ ID NO: 1617, and c. CDR-L3, comprising the amino acid sequence SEQ ID NO: 2159.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 262, and the VL amino acid sequence of SEQ ID NO: 533, optionally including post-translational modifications of those sequences.

TUCE1007

In one aspect, the present disclosure provides an antibody or antigen-binding fragment thereof comprising at least one or both variable regions selected from: a. VH comprising the amino acid sequence of SEQ ID NO: 263 and b. VL comprising the amino acid sequence of SEQ ID NO: 534.

In one aspect, the present disclosure provides an antibody or antigen-binding fragment thereof comprising at least one, two, three, four, five, or six CDRs selected from: a. CDR-H1 comprising the amino acid sequence of SEQ ID NO: 805, b. CDR-H2 comprising the amino acid sequence of SEQ ID NO: 1347, c. CDR-H3 comprising the amino acid sequence of SEQ ID NO: 1889, d. CDR-L1 comprising the amino acid sequence of SEQ ID NO: 1076, e. CDR-L2 comprising the amino acid sequence of SEQ ID NO: 1618, f. CDR-L3 comprising the amino acid sequence of SEQ ID NO: 2160.

In one aspect, the present disclosure provides an antibody or antigen-binding fragment thereof comprising a CDR-H3 comprising the amino acid sequence of SEQ ID NO: 1889, and a CDR-L3 comprising the amino acid sequence of SEQ ID NO: 2160.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 805, b. CDR-H2 comprising the amino acid sequence of SEQ ID NO: 1347, c. CDR-H3 comprising the amino acid sequence of SEQ ID NO: 1889, and a VL comprising the amino acid sequence of SEQ ID NO: 534.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1076, b. CDR-L2 comprising the amino acid sequence of SEQ ID NO: 1618, c. CDR-L3 comprising the amino acid sequence of SEQ ID NO: 2160, and a VH comprising the amino acid sequence of SEQ ID NO: 263.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 263. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 263. In some embodiments, substitutions, insertions, or deletions occur in regions outside the CDRs (e.g., in the FRs). Optionally, the antibody or antigen-binding fragment thereof comprises the VH sequence SEQ ID NO: 263, including one or more post-translational modifications of that sequence. In a particular embodiment, the VH comprises one, two or three CDRs selected from: a. CDR-H1, comprising the amino acid sequence SEQ ID NO: 805, b. CDR-H2, comprising the amino acid sequence SEQ ID NO: 1347, and c. CDR-H3, comprising the amino acid sequence SEQ ID NO: 1889.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 534. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 534. In some embodiments, the substitutions, insertions, or deletions occur in regions outside the CDRs (e.g., in the FRs). Optionally, the antibody or antigen-binding fragment thereof comprises the VL sequence SEQ ID NO: 534, including one or more post-translational modifications of that sequence. In a particular embodiment, the VL comprises one, two or three CDRs selected from: a. CDR-L1, comprising the amino acid sequence SEQ ID NO: 1076, b. CDR-L2, comprising the amino acid sequence SEQ ID NO: 1618, and c. CDR-L3, comprising the amino acid sequence SEQ ID NO: 2160.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 263, and the VL amino acid sequence of SEQ ID NO: 534, optionally including post-translational modifications of those sequences.

TUCE1008

In one aspect, the present disclosure provides an antibody or antigen-binding fragment thereof comprising at least one or both variable regions selected from: a. VH comprising the amino acid sequence of SEQ ID NO: 264 and b. VL comprising the amino acid sequence of SEQ ID NO: 535.

In one aspect, the present disclosure provides an antibody or antigen-binding fragment thereof comprising at least one, two, three, four, five, or six CDRs selected from: a. CDR-H1 comprising the amino acid sequence of SEQ ID NO: 806, b. CDR-H2 comprising the amino acid sequence of SEQ ID NO: 1348, c. CDR-H3 comprising the amino acid sequence of SEQ ID NO: 1890, d. CDR-L1 comprising the amino acid sequence of SEQ ID NO: 1077, e. CDR-L2 comprising the amino acid sequence of SEQ ID NO: 1619, and f. CDR-L3 comprising the amino acid sequence of SEQ ID NO: 2161.

In one aspect, the present disclosure provides an antibody or antigen-binding fragment thereof comprising a CDR-H3 comprising the amino acid sequence of SEQ ID NO: 1890, and a CDR-L3 comprising the amino acid sequence of SEQ ID NO: 2161.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 806, b. CDR-H2 comprising the amino acid sequence of SEQ ID NO: 1348, c. CDR-H3 comprising the amino acid sequence of SEQ ID NO: 1890, and a VL comprising the amino acid sequence of SEQ ID NO: 535.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1077, b. CDR-L2 comprising the amino acid sequence of SEQ ID NO: 1619, c. CDR-L3 comprising the amino acid sequence of SEQ ID NO: 2161, and a VH comprising the amino acid sequence of SEQ ID NO: 264.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 264. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 264. In some embodiments, substitutions, insertions, or deletions occur in regions outside the CDRs (e.g., in the FRs). Optionally, the antibody or antigen-binding fragment thereof comprises the VH sequence SEQ ID NO: 264, including one or more post-translational modifications of that sequence. In a particular embodiment, the VH comprises one, two or three CDRs selected from: a. CDR-H1, comprising the amino acid sequence SEQ ID NO: 806, b. CDR-H2, comprising the amino acid sequence SEQ ID NO: 1348, and c. CDR-H3, comprising the amino acid sequence SEQ ID NO: 1890.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 535. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 535. In some embodiments, the substitutions, insertions, or deletions occur in regions outside the CDRs (e.g., in the FRs). Optionally, the antibody or antigen-binding fragment thereof comprises the VL sequence SEQ ID NO: 535, including one or more post-translational modifications of that sequence. In a particular embodiment, the VL comprises one, two or three CDRs selected from: a. CDR-L1, comprising the amino acid sequence SEQ ID NO: 1077, b. CDR-L2, comprising the amino acid sequence SEQ ID NO: 1619, and c. CDR-L3, comprising the amino acid sequence SEQ ID NO: 2161.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 264, and the VL amino acid sequence of SEQ ID NO: 535, optionally including post-translational modifications of those sequences.

TUCE1009

In one aspect, the present disclosure provides an antibody or antigen-binding fragment thereof comprising at least one or both variable regions selected from: a. VH comprising the amino acid sequence of SEQ ID NO: 265 and b. VL comprising the amino acid sequence of SEQ ID NO: 536.

In one aspect, the present disclosure provides an antibody or antigen-binding fragment thereof comprising at least one, two, three, four, five, or six CDRs selected from: a. CDR-H1 comprising the amino acid sequence of SEQ ID NO: 807, b. CDR-H2 comprising the amino acid sequence of SEQ ID NO: 1349, c. CDR-H3 comprising the amino acid sequence of SEQ ID NO: 1891, d. CDR-L1 comprising the amino acid sequence of SEQ ID NO: 1078, e. CDR-L2 comprising the amino acid sequence of SEQ ID NO: 1620, and f. CDR-L3 comprising the amino acid sequence of SEQ ID NO: 2162.

In one aspect, the present disclosure provides an antibody or antigen-binding fragment thereof comprising a CDR-H3 comprising the amino acid sequence of SEQ ID NO: 1891, and a CDR-L3 comprising the amino acid sequence of SEQ ID NO: 2162.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 807, b. CDR-H2 comprising the amino acid sequence of SEQ ID NO: 1349, c. CDR-H3 comprising the amino acid sequence of SEQ ID NO: 1891, and a VL comprising the amino acid sequence of SEQ ID NO: 536.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1078, b. CDR-L2 comprising the amino acid sequence of SEQ ID NO: 1620, c. CDR-L3 comprising the amino acid sequence of SEQ ID NO: 2162, and a VH comprising the amino acid sequence of SEQ ID NO: 265.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 265. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 265. In some embodiments, substitutions, insertions, or deletions occur in regions outside the CDRs (e.g., in the FRs). Optionally, the antibody or antigen-binding fragment thereof comprises the VH sequence SEQ ID NO: 265, including one or more post-translational modifications of that sequence. In a particular embodiment, the VH comprises one, two or three CDRs selected from: a. CDR-H1, comprising the amino acid sequence SEQ ID NO: 807, b. CDR-H2, comprising the amino acid sequence SEQ ID NO: 1349, and c. CDR-H3, comprising the amino acid sequence SEQ ID NO: 1891.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 536. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 536. In some embodiments, the substitutions, insertions, or deletions occur in regions outside the CDRs (e.g., in the FRs). Optionally, the antibody or antigen-binding fragment thereof comprises the VL sequence SEQ ID NO: 536, including one or more post-translational modifications of that sequence. In a particular embodiment, the VL comprises one, two or three CDRs selected from: a. CDR-L1, comprising the amino acid sequence SEQ ID NO: 1078, b. CDR-L2, comprising the amino acid sequence SEQ ID NO: 1620, and c. CDR-L3, comprising the amino acid sequence SEQ ID NO: 2162.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 265, and the VL amino acid sequence of SEQ ID NO: 536, optionally including post-translational modifications of those sequences.

TUCE1010

In one aspect, the present disclosure provides an antibody or antigen-binding fragment thereof comprising at least one or both variable regions selected from: a. VH comprising the amino acid sequence of SEQ ID NO: 266 and b. VL comprising the amino acid sequence of SEQ ID NO: 537.

In one aspect, the present disclosure provides an antibody or antigen-binding fragment thereof comprising at least one, two, three, four, five, or six CDRs selected from: a. CDR-H1 comprising the amino acid sequence of SEQ ID NO: 808, b. CDR-H2 comprising the amino acid sequence of SEQ ID NO: 1350, c. CDR-H3 comprising the amino acid sequence of SEQ ID NO: 1892, d. CDR-L1 comprising the amino acid sequence of SEQ ID NO: 1079, e. CDR-L2 comprising the amino acid sequence of SEQ ID NO: 1621, and f. CDR-L3 comprising the amino acid sequence of SEQ ID NO: 2163.

In one aspect, the present disclosure provides an antibody or antigen-binding fragment thereof comprising a CDR-H3 comprising the amino acid sequence of SEQ ID NO: 1892, and a CDR-L3 comprising the amino acid sequence of SEQ ID NO: 2163.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 808, b. CDR-H2 comprising the amino acid sequence of SEQ ID NO: 1350, c. CDR-H3 comprising the amino acid sequence of SEQ ID NO: 1892, and a VL comprising the amino acid sequence of SEQ ID NO: 537.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1079, b. CDR-L2 comprising the amino acid sequence of SEQ ID NO: 1621, c. CDR-L3 comprising the amino acid sequence of SEQ ID NO: 2163, and a VH comprising the amino acid sequence of SEQ ID NO: 266.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 266. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 266. In some embodiments, substitutions, insertions, or deletions occur in regions outside the CDRs (e.g., in the FRs). Optionally, the antibody or antigen-binding fragment thereof comprises the VH sequence SEQ ID NO: 266, including one or more post-translational modifications of that sequence. In a particular embodiment, the VH comprises one, two or three CDRs selected from: a. CDR-H1, comprising the amino acid sequence SEQ ID NO: 808, b. CDR-H2, comprising the amino acid sequence SEQ ID NO: 1350, and c. CDR-H3, comprising the amino acid sequence SEQ ID NO: 1892.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 537. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 537. In some embodiments, the substitutions, insertions, or deletions occur in regions outside the CDRs (e.g., in the FRs). Optionally, the antibody or antigen-binding fragment thereof comprises the VL sequence SEQ ID NO: 537, including one or more post-translational modifications of that sequence. In a particular embodiment, the VL comprises one, two or three CDRs selected from: a. CDR-L1, comprising the amino acid sequence SEQ ID NO: 1079, b. CDR-L2, comprising the amino acid sequence SEQ ID NO: 1621, and c. CDR-L3, comprising the amino acid sequence SEQ ID NO: 2163.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 266, and the VL amino acid sequence of SEQ ID NO: 537, optionally including post-translational modifications of those sequences.
TUCS1001

In one aspect, the present disclosure provides an antibody or antigen-binding fragment thereof comprising at least one or both variable regions selected from: a. VH comprising the amino acid sequence of SEQ ID NO: 267 and b. VL comprising the amino acid sequence of SEQ ID NO: 538.

In one aspect, the present disclosure provides an antibody or antigen-binding fragment thereof comprising at least one, two, three, four, five, or six CDRs selected from: a. CDR-H1 comprising the amino acid sequence of SEQ ID NO: 809, b. CDR-H2 comprising the amino acid sequence of SEQ ID NO: 1351, c. CDR-H3 comprising the amino acid sequence of SEQ ID NO: 1893, d. CDR-L1 comprising the amino acid sequence of SEQ ID NO: 1080, e. CDR-L2 comprising the amino acid sequence of SEQ ID NO: 1622, and f. CDR-L3 comprising the amino acid sequence of SEQ ID NO: 2164.

In one aspect, the present disclosure provides an antibody or antigen-binding fragment thereof comprising a CDR-H3 comprising the amino acid sequence of SEQ ID NO: 1893, and a CDR-L3 comprising the amino acid sequence of SEQ ID NO: 2164.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 809, b. CDR-H2 comprising the amino acid sequence of SEQ ID NO: 1351, c. CDR-H3 comprising the amino acid sequence of SEQ ID NO: 1893, and a VL comprising the amino acid sequence of SEQ ID NO: 538.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1080, b. CDR-L2 comprising the amino acid sequence of SEQ ID NO: 1622, c. CDR-L3 comprising the amino acid sequence of SEQ ID NO: 2164, and a VH comprising the amino acid sequence of SEQ ID NO: 267.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 267. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 267. In some embodiments, substitutions, insertions, or deletions occur in regions outside the CDRs (e.g., in the FRs). Optionally, the antibody or antigen-binding fragment thereof comprises the VH sequence SEQ ID NO: 267, including one or more post-translational modifications of that sequence. In a particular embodiment, the VH comprises one, two or three CDRs selected from: a. CDR-H1, comprising the amino acid sequence SEQ ID NO: 809, b. CDR-H2, comprising the amino acid sequence SEQ ID NO: 1351, and c. CDR-H3, comprising the amino acid sequence SEQ ID NO: 1893.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 538. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 538. In some embodiments, the substitutions, insertions, or deletions occur in regions outside the CDRs (e.g., in the FRs). Optionally, the antibody or antigen-binding fragment thereof comprises the VL sequence SEQ ID NO: 538, including one or more post-translational modifications of that sequence. In a particular embodiment, the VL comprises one, two or three CDRs selected from: a. CDR-L1, comprising the amino acid sequence SEQ ID NO: 1080, b. CDR-L2, comprising the amino acid sequence SEQ ID NO: 1622, and c. CDR-L3, comprising the amino acid sequence SEQ ID NO: 2164.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 267, and the VL amino acid sequence of SEQ ID NO: 538, optionally including post-translational modifications of those sequences.
TUCS1002

In one aspect, the present disclosure provides an antibody or antigen-binding fragment thereof comprising at least one or both variable regions selected from: a. VH comprising the amino acid sequence of SEQ ID NO: 268 and b. VL comprising the amino acid sequence of SEQ ID NO: 539.

In one aspect, the present disclosure provides an antibody or antigen-binding fragment thereof comprising at least one, two, three, four, five, or six CDRs selected from: a. CDR-H1 comprising the amino acid sequence of SEQ ID NO: 810, b. CDR-H2 comprising the amino acid sequence of SEQ ID NO: 1352, c. CDR-H3 comprising the amino acid sequence of SEQ ID NO: 1894, d. CDR-L1 comprising the amino acid sequence of SEQ ID NO: 1081, e. CDR-L2 comprising the amino acid sequence of SEQ ID NO: 1623, and f. CDR-L3 comprising the amino acid sequence of SEQ ID NO: 2165.

In one aspect, the present disclosure provides an antibody or antigen-binding fragment thereof comprising a CDR-H3 comprising the amino acid sequence of SEQ ID NO: 1894, and a CDR-L3 comprising the amino acid sequence of SEQ ID NO: 2165.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 810, b. CDR-H2 comprising the amino acid sequence of SEQ ID NO: 1352, c. CDR-H3 comprising the amino acid sequence of SEQ ID NO: 1894, and a VL comprising the amino acid sequence of SEQ ID NO: 539.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1081, b. CDR-L2 comprising the amino acid sequence of SEQ ID NO: 1623, c. CDR-L3 comprising the amino acid sequence of SEQ ID NO: 2165, and a VH comprising the amino acid sequence of SEQ ID NO: 268.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 268. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 268. In some embodiments, substitutions, insertions, or deletions occur in regions outside the CDRs (e.g., in the FRs). Optionally, the antibody or antigen-binding fragment thereof comprises the VH sequence SEQ ID NO: 268, including one or more post-translational modifications of that sequence. In a particular embodiment, the VH comprises one, two or three CDRs selected from: a. CDR-H1, comprising the amino acid sequence SEQ ID NO: 810, b. CDR-H2, comprising the amino acid sequence SEQ ID NO: 1352, and c. CDR-H3, comprising the amino acid sequence SEQ ID NO: 1894.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 539. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 539. In some embodiments, the substitutions, insertions, or deletions occur in regions outside the CDRs (e.g., in the FRs). Optionally, the antibody or antigen-binding fragment thereof comprises the VL sequence SEQ ID NO: 539, including one or more post-translational modifications of that sequence. In a particular embodiment, the VL comprises one, two or three CDRs selected from: a. CDR-L1, comprising the amino acid sequence SEQ ID NO: 1081, b. CDR-L2, comprising the amino acid sequence SEQ ID NO: 1623, and c. CDR-L3, comprising the amino acid sequence SEQ ID NO: 2165.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 268, and the VL amino acid sequence of SEQ ID NO: 539, optionally including post-translational modifications of those sequences.
TUCS1003

In one aspect, the present disclosure provides an antibody or antigen-binding fragment thereof comprising at least one or both variable regions selected from: a. VH comprising the amino acid sequence of SEQ ID NO: 269 and b. VL comprising the amino acid sequence of SEQ ID NO: 540.

In one aspect, the present disclosure provides an antibody or antigen-binding fragment thereof comprising at least one, two, three, four, five, or six CDRs selected from: a. CDR-H1 comprising the amino acid sequence of SEQ ID NO: 811, b. CDR-H2 comprising the amino acid sequence of SEQ ID NO: 1353, c. CDR-H3 comprising the amino acid sequence of SEQ ID NO: 1895, d. CDR-L1 comprising the amino acid sequence of SEQ ID NO: 1082, e. CDR-L2 comprising the amino acid sequence of SEQ ID NO: 1624, and f. CDR-L3 comprising the amino acid sequence of SEQ ID NO: 2166.

In one aspect, the present disclosure provides an antibody or antigen-binding fragment thereof comprising a CDR-H3 comprising the amino acid sequence of SEQ ID NO: 1895, and a CDR-L3 comprising the amino acid sequence of SEQ ID NO: 2166.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 811, b. CDR-H2 comprising the amino acid sequence of SEQ ID NO: 1353, c. CDR-H3 comprising the amino acid sequence of SEQ ID NO: 1895, and a VL comprising the amino acid sequence of SEQ ID NO: 540.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1082, b. CDR-L2 comprising the amino acid sequence of SEQ ID NO: 1624, c. CDR-L3 comprising the amino acid sequence of SEQ ID NO: 2166, and a VH comprising the amino acid sequence of SEQ ID NO: 269.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 269. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 269. In some embodiments, substitutions, insertions, or deletions occur in regions outside the CDRs (e.g., in the FRs). Optionally, the antibody or antigen-binding fragment thereof comprises the VH sequence SEQ ID NO: 269, including one or more post-translational modifications of that sequence. In a particular embodiment, the VH comprises one, two or three CDRs selected from: a. CDR-H1, comprising the amino acid sequence SEQ ID NO: 811, b. CDR-H2, comprising the amino acid sequence SEQ ID NO: 1353, and c. CDR-H3, comprising the amino acid sequence SEQ ID NO: 1895.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 540. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 540. In some embodiments, the substitutions, insertions, or deletions occur in regions outside the CDRs (e.g., in the FRs). Optionally, the antibody or antigen-binding fragment thereof comprises the VL sequence SEQ ID NO: 540, including one or more post-translational modifications of that sequence. In a particular embodiment, the VL comprises one, two or three CDRs selected from: a. CDR-L1, comprising the amino acid sequence SEQ ID NO: 1082, b. CDR-L2, comprising the amino acid sequence SEQ ID NO: 1624, and c. CDR-L3, comprising the amino acid sequence SEQ ID NO: 2166.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 269, and the VL amino acid sequence of SEQ ID NO: 540, optionally including post-translational modifications of those sequences.

TUVM1001

In one aspect, the present disclosure provides an antibody or antigen-binding fragment thereof comprising at least one or both variable regions selected from: a. VH comprising the amino acid sequence of SEQ ID NO: 270 and b. VL comprising the amino acid sequence of SEQ ID NO: 541.

In one aspect, the present disclosure provides an antibody or antigen-binding fragment thereof comprising at least one, two, three, four, five, or six CDRs selected from: a. CDR-H1 comprising the amino acid sequence of SEQ ID NO: 812, b. CDR-H2 comprising the amino acid sequence of SEQ ID NO: 1354, c. CDR-H3 comprising the amino acid sequence of SEQ ID NO: 1896, d. CDR-L1 comprising the amino acid sequence of SEQ ID NO: 1083, e. CDR-L2 comprising the amino acid sequence of SEQ ID NO: 1625, and f. CDR-L3 comprising the amino acid sequence of SEQ ID NO: 2167.

In one aspect, the present disclosure provides an antibody or antigen-binding fragment thereof comprising a CDR-H3 comprising the amino acid sequence of SEQ ID NO: 1896, and a CDR-L3 comprising the amino acid sequence of SEQ ID NO: 2167.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 812, b. CDR-H2 comprising the amino acid sequence of SEQ ID NO: 1354, c. CDR-H3 comprising the amino acid sequence of SEQ ID NO: 1896, and a VL comprising the amino acid sequence of SEQ ID NO: 541.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1083, b. CDR-L2 comprising the amino acid sequence of SEQ ID NO: 1625, c. CDR-L3 comprising the amino acid sequence of SEQ ID NO: 2167, and a VH comprising the amino acid sequence of SEQ ID NO: 270.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 270. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 270. In some embodiments, substitutions, insertions, or deletions occur in regions outside the CDRs (e.g., in the FRs). Optionally, the antibody or antigen-binding fragment thereof comprises the VH sequence SEQ ID NO: 270, including one or more post-translational modifications of that sequence. In a particular embodiment, the VH comprises one, two or three CDRs selected from: a. CDR-H1, comprising the amino acid sequence SEQ ID NO: 812, b. CDR-H2, comprising the amino acid sequence SEQ ID NO: 1354, and c. CDR-H3, comprising the amino acid sequence SEQ ID NO: 1896.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 541. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 541. In some embodiments, the substitutions, insertions, or deletions occur in regions outside the CDRs (e.g., in the FRs). Optionally, the antibody or antigen-binding fragment thereof comprises the VL sequence SEQ ID NO: 541, including one or more post-translational modifications of that sequence. In a particular embodiment, the VL comprises one, two or three CDRs selected from: a. CDR-L1, comprising the amino acid sequence SEQ ID NO: 1083, b. CDR-L2, comprising the amino acid sequence SEQ ID NO: 1625, and c. CDR-L3, comprising the amino acid sequence SEQ ID NO: 2167.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 270, and the VL amino acid sequence of SEQ ID NO: 541, optionally including post-translational modifications of those sequences.

TUVM1002

In one aspect, the present disclosure provides an antibody or antigen-binding fragment thereof comprising at least one or both variable regions selected from: a. VH comprising the amino acid sequence of SEQ ID NO: 271 and b. VL comprising the amino acid sequence of SEQ ID NO: 542.

In one aspect, the present disclosure provides an antibody or antigen-binding fragment thereof comprising at least one, two, three, four, five, or six CDRs selected from: a. CDR-H1 comprising the amino acid sequence of SEQ ID NO: 813, b. CDR-H2 comprising the amino acid sequence of SEQ ID NO: 1355, c. CDR-H3 comprising the amino acid sequence of SEQ ID NO: 1897, d. CDR-L1 comprising the amino acid sequence of SEQ ID NO: 1084, e. CDR-L2 comprising the amino acid sequence of SEQ ID NO: 1626, and f. CDR-L3 comprising the amino acid sequence of SEQ ID NO: 2168.

In one aspect, the present disclosure provides an antibody or antigen-binding fragment thereof comprising a CDR-H3 comprising the amino acid sequence of SEQ ID NO: 1897, and a CDR-L3 comprising the amino acid sequence of SEQ ID NO: 2168.

In one aspect, the present disclosure provides an antibody or antigen-binding fragment thereof comprising at least one, at least two, or all three VH CDR sequences selected from: a. CDR-H1 comprising the amino acid sequence of SEQ ID NO: 813, b. CDR-H2 comprising the amino acid sequence of SEQ ID NO: 1355, c. CDR-H3 comprising the amino acid sequence of SEQ ID NO: 1897, and a VL comprising the amino acid sequence of SEQ ID NO: 542.

In one aspect, the present disclosure provides an antibody or antigen-binding fragment thereof comprising at least one, at least two, or all three VL CDR sequences selected from: a. CDR-L1 comprising the amino acid sequence of SEQ ID NO: 1084, b. CDR-L2 comprising the amino acid sequence of SEQ ID NO: 1626, c. CDR-L3 comprising the amino acid sequence of SEQ ID NO: 2168, and a VH comprising the amino acid sequence of SEQ ID NO: 271.

In one aspect, an antibody or antigen-binding fragment thereof is provided, wherein the antibody or antigen-binding fragment thereof comprises a heavy chain variable domain (VH) having at least 90%, 91%, 92%, 93%, 94%, 95%, 96%, 97%, 98%, 99%, or 100% sequence identity to the amino acid sequence SEQ ID NO: 271. In some embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as of the parent (e.g., cancer associated antigen). In some embodiments, a total of 1 to 10 amino acids have been substituted, inserted and/or deleted in the amino acid sequence SEQ ID NO: 271. In some embodiments, substitutions, insertions, or deletions occur in regions outside the CDRs (e.g., in the FRs). Optionally, the antibody or antigen-binding fragment thereof comprises the VH sequence SEQ ID NO: 271, including one or more post-translational modifications of that sequence. In a particular embodiment, the VH comprises one, two or three CDRs selected from: a. CDR-H1, comprising the amino acid sequence SEQ ID NO: 813, b. CDR-H2, comprising the amino acid sequence SEQ ID NO: 1355, and a. CDR-H3, comprising the amino acid sequence SEQ ID NO: 1897.

In one aspect, an antibody or antigen-binding fragment thereof is provided, wherein the antibody or antigen-binding fragment thereof comprises a light chain variable domain (VL) having at least 90%, 91%, 92%, 93%, 94%, 95%, 96%, 97%, 98%, 99%, or 100% sequence identity to the amino acid sequence SEQ ID NO: 542. In some embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an antibody or antigen-binding fragment thereof comprising that sequence retains the ability to bind to same antigen as the parent (e.g., cancer associated antigen). In some embodiments, a total of 1 to 10 amino acids have been substituted, inserted and/or deleted in the amino acid sequence SEQ ID NO: 542. In some embodiments, the substitutions, insertions, or deletions occur in regions outside the CDRs (e.g., in the FRs). Optionally, the antibody or antigen-binding fragment thereof comprises the VL sequence SEQ ID NO: 542, including one or more post-translational modifications of that sequence. In a particular embodiment, the VL comprises one, two or three CDRs selected from: a. CDR-L1, comprising the amino acid sequence SEQ ID NO: 1084, b. CDR-L2, comprising the amino acid sequence SEQ ID NO: 1626, and c. CDR-L3, comprising the amino acid sequence SEQ ID NO: 2168.

In one aspect, an antibody or antigen-binding fragment thereof is provided, wherein the antibody or antigen-binding fragment thereof comprises a VH as in any of the embodiments provided above, and a VL as in any of the embodiments provided above. In some embodiments, the antibody or antigen-binding fragment thereof comprises the VH amino acid sequence of SEQ ID NO: 271, and the VL amino acid sequence of SEQ ID NO: 542, optionally including post-translational modifications of those sequences.

Mutation Frequency

The antibodies or antigen-binding fragment thereof of the present disclosure can comprise a heavy chain sequence with a mutation frequency of at least about 5%, 6%, 7%, 8%, 9%, 10%, 11%, 12%, 13%, 14%, 15%, 16%, 17%, 18%, 19%, or 20%, or higher from a germline sequence. The antibodies of the present disclosure can comprise a CDR3 region that is a light chain sequence with a mutation frequency of at least about 5%, 6%, 7%, 8%, 9%, 10%, 11%, 12%, 13%, 14%, 15%, 16%, 17%, 18%, 19%, or 20%, or higher from a germline sequence. The antibodies or antigen-binding fragment thereof of the invention can comprise a heavy chain and a light chain sequence with a mutation frequency of at least about 5%, 6%, 7%, 8%, 9%, 10%, 11%, 12%, 13%, 14%, 15%, 16%, 17%, 18%, 19%, or 20%, or higher from a germline sequence. The antibodies or antigen-binding fragment thereof of the invention can comprise a VH region from a VH family selected from the group consisting of any one of VH family 4-59.

Competitive Antibody

In some embodiments, antibodies which compete with the antibodies provided herein for binding to specified antigens (e.g., antigen in Table 3 and Table 4) are provided. In some embodiments, antibodies compete with the antibodies provided herein for binding to an epitope on the specified antigen.

In some embodiments, competition assays may be used to identify a monoclonal antibody that competes with an antibody described herein. Competition assays can be used to determine whether two antibodies bind the same epitope by recognizing identical or sterically overlapping epitopes or one antibody competitively inhibits binding of another antibody to the antigen. In some embodiments, such a competing antibody binds to the same epitope that is bound by an antibody described herein. Exemplary competition assays include, but are not limited to, routine assays such as those provided in Harlow and Lane (1988) Antibodies: A Laboratory Manual ch. 14 (Cold Spring Harbor Laboratory, Cold Spring Harbor, N.Y.). Detailed exemplary methods for mapping an epitope to which an antibody binds are provided in Morris (1996) "Epitope Mapping Protocols," in Methods in Molecular Biology vol. 66 (Humana Press, Totowa, N.J.). In some embodiments, two antibodies are said to bind to the same epitope if each blocks binding of the other by 50% or more. In some embodiments, the antibody that competes with an antibody described herein is a chimeric, humanized or human antibody. In some embodiments, an antibody that competes with a chimeric, humanized, or human antibody as described herein is provided.

In some embodiments, antibodies that bind to any one or more of the epitopes that the antibodies provided herein are provided. In some embodiments, antibodies that bind and overlap an epitope to which the present antibodies bind to are provided. In some embodiments, an antibody is provided that competes with at least one of the antibodies provided herein. In some embodiments, an antibody is provided that competes with at least two of the antibodies provided herein. In some embodiments, an antibody is provided that competes with at least three of the antibodies provided herein. In some embodiments, the antibody binds to an overlapping epitope as an antibody described in the examples herein. In some embodiments, the entire epitope is bound and/or obstructed by the competing antibody. In some embodiments, a part of the epitope is bound and/or obstructed by the competing antibody. In some embodiments, the competing antibody's paratope binds to at least a part of the epitope of an antibody provided herein. In some embodiments, the competing antibody's paratope binds the target, and a different section of the competing antibody's structure obstruct at least a part of the epitope of an antibody provided herein.

The term "competition" or "cross-competition" refers to the ability of an antibody molecule, e.g., an antibody molecule that interferes with the binding of an antibody the invention to a target, e.g., antigens in Table 3 and Table 4; is used interchangeably herein. Interference to binding may be direct or indirect (e.g., through allosteric modulation of the antibody molecule or target). The degree to which antibody molecules can interfere with the binding of other antibody molecules to the target and thus whether they can compete can be determined using competitive binding assays, such as FACS analysis, ELISA or BIACORE analysis. In some embodiments, the competitive binding assay is a quantitative competitive assay. In some embodiments, the first antibody molecule has a binding of the first antibody molecule to a target that is greater than or equal to 10%, such as greater than or equal to 20% (e. G., Greater than or equal to 10%, 30% or more, 40% or more, 50% or more, 55% or more, 60% or more, 65% or more, 70% or more, 75% or more, 80% or more, 85% or more, 90% %, More than 99%, compared to the antibody of the second antibody molecule.

Methods of Making Antibodies

The antibodies or antigen binding fragment thereof of the present disclosure can be obtained using the in silico reconstructed, complete nucleic acid sequences and amino acid sequences of cancer associated antibodies or antigen binding fragment thereof disclosed herein. In some embodiments, antibodies or antigen binding fragment thereof prepared by the methods described below are provided. In some embodiments, the antibody or antigen binding fragment thereof is prepared in a host cell. In some embodiments, the antibody or antigen binding fragment thereof is isolated from a host cell. In some embodiments, the antibody or antigen binding fragment thereof is prepared in a cell-free system. In some embodiments, the antibody or antigen binding fragment thereof is purified. The present invention also provides a method of producing an antibody molecule of the invention, said method generally comprising the steps of: Culturing a host cell comprising an expression vector comprising a nucleic acid encoding an antibody molecule of the invention under conditions permitting the formation of an antibody of the invention; isolating the antibody molecule expressed by the host cell from the culture; And Optionally, further purifying and/or modifying and/or formulating an antibody molecule of the invention.

Nucleic acid molecules encoding the antibodies or antigen binding fragment thereof of the present disclosure can be isolated, for example, from mature mammalian B lymphocyte or when fused with an immortalized cell as part of a hybridoma culture, using conventional procedures (e.g., by using oligonucleotide probes that are capable of binding specifically to genes encoding the heavy and light chains of a desired antibody). The disclosure provides isolated nucleic acid molecule comprising a nucleic acid sequence encoding an antibody polypeptide or antigen binding fragment thereof. Isolated nucleic acid molecule comprising the sequences disclosed herein can be prepared using (a) recombinant methods, (b) synthetic techniques, (c) purification techniques, and/or (d) combinations thereof, as is well known in the art and discussed below. Messenger RNA coding for the antibodies or antigen binding fragment thereof (e.g., heavy or light chain) can be isolated from a suitable source, either mature B cells or a hybridoma culture, employing standard techniques of RNA isolation, and the use of oligo-dT cellulose chromatography to segregate the poly-A mRNA. The poly-A mRNA may, further, be fractionated to obtain sequences of sufficient size to code for the amino acid sequences in the light or heavy chain of the desired antibody as the case may be.

For example, a cDNA library may be constructed by reverse transcription of polyA+mRNA, preferably membrane-associated mRNA, and the library screened using a suitable primer, preferably a nucleic acid sequence which is characteristic of the desired cDNA. Such a primer can be easily hypothesized and synthesized based on the cDNA or the amino acid sequence of an antibody if the sequence is known, for example, the primer can be synthesized based on the nucleic acid sequence or the amino acid sequence of the antibodies disclosed herein.

In some embodiments, however, the polymerase chain reaction (PCR) using the primers described above is used to amplify cDNAs (or portions of full-length cDNAs) encoding one or more immunoglobulin gene segment of interest (e.g., a light chain variable segment). The amplified sequences can be readily cloned into any suitable vector, e.g., expression vectors, minigene vectors, or phage display vectors. In some embodiments, the nucleic acid sequence of the antibodies or antigen binding fragment thereof, of the present disclosure can be readily cloned into any suitable vector, e.g., expression vectors, minigene vectors, or phage display vectors. Cloning is carried out using standard techniques (see, e.g., Sambrook et al. (1989) Molecular Cloning: A Laboratory Guide, Vols 1-3, Cold Spring Harbor Press, which is incorporated herein by reference). It will be appreciated that the particular method of cloning used not critical, so long as it is possible to determine the sequence of some portion of the immunoglobulin polypeptide of interest.

One source for RNA used for cloning and isolating nucleic acid sequence encoding a desired antibody or antigen-binding fragment thereof, is a hybridoma produced by fusing a B cell producing the antibody to an immortal cell. An advantage of using hybridomas is that they can be easily screened, and a hybridoma that produces the antibody of interest selected. Alternatively, RNA can be isolated from antibody-producing cells (e.g., B-cells) from the peripheral blood or, preferably the spleen or lymph nodes, or whole spleen, of a subject (e.g., humans or other suitable animals). In some embodiments, the human or suitable animal has been immunized against a target antigen. Recombinant antigens or fragments thereof can be used to immunize mice to generate the hybridomas that produce the antibodies of the instant disclosure. In some embodiments, provided herein is a hybridoma generating the antibodies or the present disclosure. The antigen may include an antigenic polypeptide, a fusion protein or variants thereof. Depending upon the nature of the polypeptides (i.e., percent hydrophobicity, percent hydrophilicity, stability, net charge, isoelectric point etc.), it may be useful to conjugate the antigen to a protein known to be immunogenic in the mammal being immunized. As it relates to the present disclosure, the subject can be one suffering from a cancer.

Based on the in silico reconstructed nucleic acid and amino acid sequences of the cancer associated antibody, the isolated nucleic acid molecule encoding a cancer associated antibody or an antigen binding fragment thereof, can also be prepared by direct chemical synthesis by known methods (see, e.g., Ausubel et al., Supra, WO1999014318A1). Chemical synthesis generally produces a single stranded oligonucleotide, which can become dsDNA by hybridization with a complementary sequence, or by polymerization with a DNA polymerase using the single strand as a template. One skilled in the art will recognize that while chemical synthesis of DNA can be limited to sequences of about 100 or more bases, longer sequences may be obtained by the ligation of shorter sequences.

The disclosure provides isolated nucleic acid molecule comprising a nucleic acid sequence encoding an antibody polypeptide or antigen-binding fragment thereof. In some embodiments, the isolated nucleic acid molecule comprises a nucleic acid sequence encoding a heavy chain polypeptide of an antibody. In some embodiments, the nucleic acid sequence encoding a heavy chain polypeptide is selected from any one of SEQ ID NOS: 2169-2439. In some embodiments, the isolated nucleic acid molecule comprises a nucleic acid sequence encoding a light chain polypeptide of an antibody. In some embodiments, the nucleic acid sequence encoding a light chain polypeptide is selected from any one of SEQ ID NOS: 2440-2710. In some embodiments, the isolated nucleic acid molecule comprises a nucleic acid sequence encoding a CDR1, CDR2, or CDR3 polypeptide of a variable heavy chain. In some embodiments, the isolated nucleic acid molecule comprises a nucleic acid sequence encoding a CDR1, CDR2, or CDR3 polypeptide of a variable light chain. In some embodiments, the nucleic acid sequence encoding the CDR1 polypeptide of a variable heavy chain (CDR-H1) is selected from any one of SEQ ID NOS: 2711-2981. In some embodiments, the nucleic acid sequence encoding the CDR2 polypeptide of a variable heavy chain (CDR-H2) is selected from any one of SEQ ID NOS: 3253-3523. In some embodiments, the nucleic acid sequence the nucleic acid sequence encoding the CDR3 polypeptide of a variable heavy chain (CDR-H3) is selected from any one of SEQ ID NOS: 3795-4065. In some embodiments, the isolated nucleic acid comprises a sequence encoding a CDR1, CDR2, or CDR3 polypeptide of a variable light chain. In some embodiments, the nucleic acid sequence encoding the CDR1 region of a variable light chain polypeptide (CDR-L1) is selected from any one of SEQ ID NOS: 2982-3252. In some embodiments, the nucleic acid sequence encoding the CDR2 region of a variable light chain polypeptide (CDR-L2) is selected from any one of SEQ ID NOS: 3524-3794. In some embodiments, the nucleic acid sequence encoding the CDR3 region of a variable light chain polypeptide (CDR-L3) is selected from any one of SEQ ID NOS: 4066-4336.

The terms "nucleic acid molecule", "nucleic acid" and "polynucleotide" may be used interchangeably, and refer to a polymer of nucleotides. Such polymers of nucleotides may contain natural and/or non-natural nucleotides, and include, but are not limited to, DNA, RNA, and PNA. "Nucleic acid sequence" refers to the linear sequence of nucleotides.

As used herein, an "isolated" nucleic acid molecule or "isolated" nucleic acid sequence is a nucleic acid molecule that is either (1) identified and separated from at least one contaminant nucleic acid molecule with which it is ordinarily associated in the natural source of the nucleic acid or (2) cloned, amplified, tagged, or otherwise distinguished from background nucleic acids such that the sequence of the nucleic acid of interest can be determined, is considered isolated. An isolated nucleic acid molecule is other than in the form or setting in which it is found in nature. Isolated nucleic acid molecules therefore are distinguished from the nucleic acid molecule as it exists in natural cells. However, an isolated nucleic acid molecule includes a nucleic acid molecule contained in cells that ordinarily express the antibody where, for example, the nucleic acid molecule is in a chromosomal location different from that of natural cells. "Isolated nucleic acid", as used herein, is a nucleic acid that is substantially separated from other genome DNA sequences as well as proteins or complexes such as ribosomes and polymerases, which naturally accompany a native sequence. The term embraces a nucleic acid sequence that has been removed from its naturally occurring environment, and includes recombinant or cloned DNA isolates and chemically synthesized analogues or analogues biologically synthesized by heterologous systems. A substantially pure nucleic acid includes isolated forms of the nucleic acid. Of course, this refers to the nucleic acid as originally isolated and does not exclude genes or sequences later added to the isolated nucleic acid by the hand of man. The term "polypeptide" is used in its conventional meaning, i.e., as a sequence of amino acids.

An isolated nucleic acid molecule encoding the antibody, portion or polypeptide of the present disclosure can be recombined with vector DNA (e.g., expression vector) in accordance with conventional techniques, including blunt-ended or staggered-ended termini for ligation, restriction enzyme digestion to provide appropriate termini, filling in of cohesive ends as appropriate, alkaline phosphatase treatment to avoid undesirable joining, and ligation with appropriate ligases. Techniques for such manipulations are disclosed, e.g., by Maniatis et al., Molecular Cloning, Lab. Manual (Cold Spring Harbor Lab. Press, N Y, 1982 and 1989), and Ausubel, 1987, 1993, and can be used to construct nucleic acid sequences which encode an antibody molecule or antigen binding region thereof. Accordingly, the disclosure provides for a vector or expression vector comprising the isolated nucleic acids set forth herein. In one embodiment, the nucleic acid coding for the light chain and that coding for the heavy chain are isolated separately by the procedures outlined above. In one embodiment, the isolated nucleic acid encoding the light chain and that coding for the heavy chain may be inserted into separate expression plasmids, or together in the same plasmid, so long as each is under suitable promoter and translation control.

Once the isolated nucleic acid molecule is placed into an expression vector, they are then transfected into host cells such as E. coli cells, simian COS cells, human embryonic kidney 293 cells (e.g., 293E cells), Chinese hamster ovary (CHO) cells, or myeloma cells that do not otherwise produce immunoglobulin protein, to obtain the synthesis of the antibody or an antigen-binding fragment thereof in the recombinant host cells. Recombinant production of antibodies is well known in the art. Many vectors are available. The vector components generally include, but are not limited to, one or more of the following: a signal sequence, an origin of replication, one or more selective marker genes, an enhancer element, a promoter, and a transcription termination sequence.

The isolated nucleic acid molecules are operably linked to an expression control sequence in the vector DNA. Expression control sequence refers to DNA sequences necessary for the expression of an operably linked coding sequence in a particular host organism. The control sequences that are suitable for prokaryotes, for example, include a promoter, optionally an operator sequence, and a ribosome binding site. Eukaryotic cells are known to utilize promoters, polyadenylation signals, and enhancers. The term "operably linked" or "transcriptional control" refers to functional linkage between a regulatory sequence and a heterologous nucleic acid sequence resulting in expression of the latter. For example, a first nucleic acid sequence is operably linked with a second nucleic acid sequence when the first nucleic acid sequence is placed in a functional relationship with the second nucleic acid sequence. For instance, a promoter is operably linked to a coding sequence if the promoter affects the transcription or expression of the coding sequence. Operably linked DNA sequences can be contiguous with each other and, e.g., where necessary to join two protein coding regions, are in the same reading frame.

Nucleic acid is operably linked when it is placed into a functional relationship with another nucleic acid sequence. For example, a promoter or enhancer is operably linked to a coding sequence if it affects the transcription of the sequence; or a ribosome binding site is operably linked to a coding sequence if it is positioned so as to facilitate translation. Generally, operably linked means that the DNA sequences being linked are contiguous, and/or can contiguous and in reading phase. However, enhancers do not have to be contiguous. Linking is accomplished by ligation at convenient restriction sites. If such sites do not exist, the synthetic oligonucleotide adaptors or linkers are used in accordance with conventional practice.

Cell, cell line, and cell culture are often used interchangeably and all such designations herein include progeny. Transformants and transformed cells include the primary subject cell and cultures derived therefrom without regard for the number of transfers. It is also understood that all progeny may not be precisely identical in DNA content, due to deliberate or inadvertent mutations. Mutant progeny that have the same function or biological activity as screened for in the originally transformed cell are included. Where distinct designations are intended, it will be clear from the context. In an alternative embodiment, suitable encoding nucleic acid sequences can be designed according to a universal codon table, based on the known amino acid sequence of an immunoglobulin of interest.

Amino acid sequence variants of the desired antibody may be prepared by introducing appropriate nucleotide changes into the encoding DNA, or by peptide synthesis. Such variants include, for example, deletions from, and/or insertions into and/or substitutions of, residues within the amino acid sequences of the antibodies. Any combination of deletion, insertion, and substitution is made to arrive at the final construct, provided that the final construct possesses the desired characteristics. The amino acid changes also may alter post-translational processes of the monoclonal, human, humanized, or variant antibody, such as changing the number or position of glycosylation sites.

Nucleic acid molecules encoding amino acid sequence variants of the antibody are prepared by various methods. These methods include, but are not limited to, isolation from a natural source (in the case of naturally occurring amino acid sequence variants) or preparation by oligonucleotide-mediated (or site-directed) mutagenesis, PCR mutagenesis, and cassette mutagenesis of an earlier prepared variant or a non-variant version of the antibody. The present disclosure also provides isolated nucleic acid molecules encoding for antibodies or antigen binding fragment thereof, described herein, optionally operably linked to regulatory control sequences recognized by a host cell, vectors and host cells comprising the nucleic acids, and recombinant techniques for the production of the antibodies, which may comprise culturing the host cell so that the nucleic acid is expressed and, optionally, recovering the antibody from the host cell culture or culture medium. For recombinant production of an antibody or antigen binding fragment thereof, the nucleic acid molecule encoding it can be isolated and inserted into a replicable vector for further cloning (amplification of the DNA) or for expression. Accordingly provided herein are isolated antibody or antigen binding fragment thereof. In some embodiments, the antibodies or the present disclosure or antigen binding fragment thereof can be recombinant antibody. The term "recombinant antibody" refers to an antibody that is expressed from a cell or cell line transfected with an expression vector (or possibly more than one expression vector, typically two expression vectors) comprising the coding sequence of the antibody, where said coding sequence is not naturally associated with the cell. In one embodiment, a recombinant antibody has a glycosylation pattern that is different than the glycosylation pattern of an antibody having the same sequence if it were to exist in nature. In one embodiment, a recombinant antibody is expressed in a mammalian host cell which is not a human host cell. Notably, individual mammalian host cells have unique glycosylation patterns In some embodiments, the antibodies or antigen binding fragment thereof of the present disclosure are isolated. With regards to the an isolated antibody polypeptide or an antigen binding fragment polypeptide; "isolated" is referred to when the polypeptide is separated from at least some of the components of the cell (e.g., host cell) in which it was produced. Where a polypeptide is secreted by a host cell after expression, physically separating the supernatant containing the polypeptide from the host cell that produced it is considered to be "isolating" the polypeptide. The term "isolated" refers to a protein (e.g., an antibody) that is substantially free of other cellular material and/or chemicals. In one embodiment, an isolated antibody is substantially free of other proteins from the same species. In one embodiment, an isolated antibody is expressed by a cell from a different species and is substantially free of other proteins from the difference species. A protein may be rendered substantially free of naturally associated components (or components associated with the cellular expression system used to produce the antibody) by isolation, using protein purification techniques well known in the art.

In some embodiments, the antibody or antigen binding fragment thereof disclosed herein is produced in a cell-free system. Nonlimiting exemplary cell-free systems are described, for example, in Sitaraman et al., Methods Mol. Biol. 498: 229-44 (2009); Spirin, Trends Biotechnol. 22: 538-45 (2004); Endo et al., Biotechnol. Adv. 21: 695-713 (2003). For such purposes the nucleic acids encoding the polypeptide must be modified to allow in vitro transcription to produce mRNA and to allow cell-free translation of the mRNA in the particular cell-free system being utilized (eukaryotic such as a mammalian or yeast cell-free translation system or prokaryotic such as a bacterial cell-free translation system. Antibody polypeptides can also be produced by chemical synthesis (e.g., by the methods described in Solid Phase Peptide Synthesis, 2nd ed., 1984, The Pierce Chemical Co., Rockford, Ill.). Modifications to the protein can also be produced by chemical synthesis. In some embodiments, the antibodies or antigen binding fragment of the present disclosure is synthetic. The polypeptides of the present disclosure can be purified by isolation/purification methods for proteins generally known in the field of protein chemistry.

When sources other than hybridomas are used to obtain antibodies, it may be desirable to screen for sequences encoding immunoglobulins or immunoglobulin polypeptides with specific binding characteristics. One method for such screening is the use of phage display technology. Phage display is described in e.g., Dower et al., McCafferty et al., and Caton and Koprowski, Proc. Natl. Acad. Sci. USA, 87:6450-6454 (1990), each of which is incorporated herein by reference. In one embodiment using phage display technology, cDNA from an immunized transgenic mouse (e.g., total spleen cDNA) is isolated, the polymerase chain reaction is used to amplify a cDNA sequences that encode a portion of an immunoglobulin polypeptide, e.g., CDR regions, and the amplified sequences are inserted into a phage vector. cDNAs encoding peptides of interest, e.g., variable region peptides with desired binding characteristics are identified by standard techniques such as panning. The sequence of the amplified or cloned nucleic acid is then determined. Typically the sequence encoding an entire variable region of the immunoglobulin polypeptide is determined, however, it will sometimes be adequate to sequence only a portion of a variable region, for example, the CDR-encoding portion. Typically the portion sequenced will be at least 30 bases in length, more often based coding for at least about one-third or at least about one-half of the length of the variable region will be sequenced.

Sequencing can be carried out on clones isolated from a cDNA library, or, when PCR is used, after subcloning the amplified sequence or by direct PCR sequencing of the amplified segment. Sequencing is carried out using standard techniques (see, e.g., Sambrook et al. (1989) Molecular Cloning: A Laboratory Guide, Vols 1-3, Cold Spring Harbor Press, and Sanger, F. et al. (1977) Proc. Natl. Acad. Sci. USA 74: 5463-5467, which is incorporated herein by reference). By comparing the sequence of the cloned nucleic acid with published sequences of human immunoglobulin genes and cDNAs, one of skill will readily be able to determine, depending on the region sequenced, (i) the germline segment usage of the hybridoma immunoglobulin polypeptide (including the isotype of the heavy chain) and (ii) the sequence of the heavy and light chain variable regions, including sequences resulting from N-region addition and the process of somatic mutation. One source of immunoglobulin gene sequence information is the National Center for Biotechnology Information, National Library of Medicine, National Institutes of Health, Bethesda, Md.

Selection and Transformation of Host Cells

In one aspect, provided herein is a host cell that comprises the isolated nucleic acids described above or a vector comprising said isolated nucleic acids described above. The vector can be a cloning vector or an expression vector. Suitable host cells for cloning or expressing the DNA in the vectors herein are the prokaryote, yeast, or higher eukaryote cells described above. Suitable prokaryotes for this purpose include eubacteria, such as Gram-negative or Gram-positive organisms, for example, Enterobacteriaceae such as *Escherichia*, e.g., *E. coli*, *Enterobacter*, *Erwinia*, *Klebsiella*, *Proteus*, *Salmonella*, e.g., *Salmonella typhimurium*, *Serratia*, e.g., *Serratia marcescens*, and *Shigella*, as well as Bacilli such as *B. subtilis* and *B. licheniformis* (e.g., *B. licheniformis* 41 P disclosed in DD 266,710 published Apr. 12, 1989), *Pseudomonas* such as *P. aeruginosa*, and *Streptomyces*. One preferred *E. coli* cloning host is *E. coli* 294 (ATCC 31,446), although other strains such as *E. coli* B, *E. coli* X1776 (ATCC 31,537), and *E. coli* W3110 (ATCC 27,325) are suitable. These examples are illustrative rather than limiting.

In addition to prokaryotes, eukaryotic microbes such as filamentous fungi or yeast are suitable cloning or expression hosts for antibody-encoding vectors. *Saccharomyces cerevisiae*, or common baker's yeast, is the most commonly used among lower eukaryotic host microorganisms. However, a number of other genera, species, and strains are commonly available and useful herein, such as *Schizosaccharomyces pombe*; *Kluyveromyces* hosts such as, e.g., *K. lactis*, *K. fragilis* (ATCC 12,424), *K. bulgaricus* (ATCC 16,045), *K. wickeramii* (ATCC 24,178), *K. waltii* (ATCC 56,500), *K. drosophilarum* (ATCC 36,906), *K. thermotolerans*, and *K. marxianus*; *yarrowia* (EP 402,226); *Pichia pastors* (EP 183,070); *Candida*; *Trichoderma reesia* (EP 244,234); *Neurospora crassa*; *Schwanniomyces* such as *Schwanniomyces occidentalis*; and filamentous fungi such as, e.g., *Neurospora*, *Penicillium*, *Tolypocladium*, and *Aspergillus* hosts such as *A. nidulans* and *A. niger*.

Suitable host cells for the expression of glycosylated antibody are derived from multicellular organisms. Examples of invertebrate cells include plant and insect cells. Numerous baculoviral strains and variants and corresponding permissive insect host cells from hosts such as *Spodoptera frugiperda* (caterpillar), *Aedes aegypti* (mosquito), *Aedes albopictus* (mosquito), *Drosophila melanogaster* (fruitfly), and *Bombyx mori* have been identified. A variety of viral strains for transfection are publicly available, e.g., the L-1 variant of *Autographa californica* NPV and the Bm-5 strain of *Bombyx mori* NP\7, and such viruses may be used as the virus herein according to the present invention, particularly for transfection of *Spodoptera frugiperda* cells.

Plant cell cultures of cotton, corn, potato, soybean, petunia, tomato, tobacco, lemna, and other plant cells can also be utilized as hosts. However, interest has been greatest in vertebrate cells, and propagation of vertebrate cells in culture (tissue culture) has become routine procedure. Examples of useful mammalian host cell lines are Chinese hamster ovary cells, including CHOK1 cells (ATCC CCL61), DXB-11, DG-44, and Chinese hamster ovary cells/-DHFR (CHO, Urlaub et al., Proc. Natl. Acad. Sci. USA 77: 4216 (1980)); monkey kidney CV1 line transformed by SV40 (COS-7, ATCC CRL 1651); human embryonic kidney line (293 or 293 cells subcloned for growth in suspension culture, [Graham et al., J. Gen Virol. 36: 59 (1977)]; baby hamster kidney cells (BHK, ATCC CCL 10); mouse sertoli cells (TM4, Mather, Biol. Reprod. 23: 243-251 (1980)); monkey kidney cells (CV1 ATCC CCL 70); African green monkey kidney cells (VERO-76, ATCC CRL-1587); human cervical carcinoma cells (HELA, ATCC CCL 2); canine kidney cells (MDCK, ATCC CCL 34); buffalo rat liver cells (BRL 3A, ATCC CRL 1442); human lung cells (W138, ATCC CCL 75); human liver cells (Hep G2, HB 8065); mouse mammary tumor (MMT 060562, ATCC CCL51); TRI cells (Mather et al., Annals N.Y Acad. Sci. 383: 44-68 (1982)); MRC 5 cells; FS4 cells; and a human hepatoma line (Hep G2). Host cells are transformed or transfected with the above-described expression or cloning vectors for antibody production and cultured in conventional nutrient media modified as appropriate for inducing promoters, selecting transformants, or amplifying the genes encoding the desired sequences. In addition, novel vectors and transfected cell lines with multiple copies of transcription units separated by a selective marker are particularly useful and preferred for the expression of antibodies, described herein.

For transfection of the expression vectors and production of the chimeric, humanized, or composite human antibodies described herein, the recipient cell line can be a myeloma cell. Myeloma cells can synthesize, assemble and secrete immunoglobulins encoded by transfected immunoglobulin nucleic acid sequences and possess the mechanism for glycosylation of the immunoglobulin. For example, in some embodiments, the recipient cell is the recombinant Ig-producing myeloma cell SP2/0 (ATCC #CRL 8287). SP2/0 cells produce only immunoglobulin encoded by the transfected genes. Myeloma cells can be grown in culture or in the peritoneal cavity of a mouse, where secreted immunoglobulin can be obtained from ascites fluid. Other suitable recipient cells include lymphoid cells such as B lymphocytes of human or non-human origin, hybridoma cells of human or non-human origin, or interspecies heterohybridoma cells. An expression vector carrying a chimeric, humanized, or composite human antibody construct or antibody polypeptide described herein can be introduced into an appropriate host cell by any of a variety of suitable means, including such biochemical means as transformation, transfection, conjugation, protoplast fusion, calcium phosphate-precipitation, and application with polycations such as diethylaminoethyl (DEAE) dextran, and such mechanical means as electroporation, direct microinjection, and microprojectile bombardment. Johnston et al., 240 Science 1538 (1988), as known to one of ordinary skill in the art.

Yeast provides certain advantages over bacteria for the production of immunoglobulin H and L chains. Yeasts carry out post-translational peptide modifications including glycosylation. A number of recombinant DNA strategies exist that utilize strong promoter sequences and high copy number plasmids which can be used for production of the desired proteins in yeast. Yeast recognizes leader sequences of cloned mammalian gene products and secretes peptides bearing leader sequences (i.e., pre-peptides). Hitzman et al., 11th Intl. Conf. Yeast, Genetics & Molec. Biol. (Montpelier, France, 1982). Yeast gene expression systems can be routinely evaluated for the levels of production, secretion and the stability of antibody polypeptide or antigen-binding fragment peptide thereof, and assembled chimeric, humanized, or composite human antibodies, fragments and regions thereof. Any of a series of yeast gene expression systems incorporating promoter and termination elements from the actively expressed genes coding for glycolytic enzymes produced in large quantities when yeasts are grown in media rich in glucose can be utilized. Known glycolytic genes can also provide very efficient transcription control signals. For example, the promoter and terminator signals of the phosphoglycerate kinase (PGK) gene can be utilized. A number of approaches can be taken for evaluating optimal expression plasmids for the expression of cloned immunoglobulin cDNAs in yeast.

Bacterial strains can also be utilized as hosts for the production of the antibody molecules or fragments thereof described herein, *E. coli* K12 strains such as *E. coli* W3110 (ATCC 27325), *Bacillus* species, enterobacteria such as *Salmonella typhimurium* or *Serratia marcescens*, and various *Pseudomonas* species can be used. Plasmid vectors containing replicon and control sequences which are derived from species compatible with a host cell are used in connection with these bacterial hosts. The vector carries a replication site, as well as specific genes which are capable of providing phenotypic selection in transformed cells. A number of approaches can be taken for evaluating the expression plasmids for the production of chimeric, humanized, or composite humanized antibodies and fragments thereof encoded by the cloned immunoglobulin cDNAs or CDRs in bacteria (see Glover, 1985; Ausubel, 1987, 1993; Sambrook, 1989; Colligan, 1992-1996).

Host mammalian cells can be grown in vitro or in vivo. Mammalian cells provide post-translational modifications to immunoglobulin protein molecules including leader peptide removal, folding and assembly of H and L chains, glycosylation of the antibody molecules, and secretion of functional antibody protein. Mammalian cells which can be useful as hosts for the production of antibody proteins, in addition to the cells of lymphoid origin described above, include cells of fibroblast origin, such as Vero (ATCC CRL 81) or CHO-K1 (ATCC CRL 61) cells. Exemplary eukaryotic cells that can be used to express polypeptides include, but are not limited to, COS cells, including COS 7 cells; 293 cells, including 293-6E cells; CHO cells, including CHO-S and DG44 cells; PER.C6® cells (Crucell); and NS0 cells. In some embodiments, a particular eukaryotic host cell is selected based on its ability to make desired post-translational modifications to the variable heavy chains and/or variable light chains. For example, in some embodiments, CHO cells produce polypeptides that have a higher level of sialylation than the same polypeptide produced in 293 cells.

In some embodiments, polypeptides of the antibodies or antigen-binding fragment thereof, disclosed herein can be produced in vivo in an animal that has been engineered or transfected with one or more nucleic acid molecules encoding the polypeptides, according to any suitable method. In some embodiments, an antibody or antigen-binding fragment thereof is produced in a cell-free system. Non-limiting exemplary cell-free systems are described, e.g., in Sitaraman et al., Methods Mol. Biol. 498: 229-44 (2009); Spirin, Trends Biotechnol. 22: 538-45 (2004); and Endo et al., Biotechnol. Adv. 21: 695-713 (2003).

Many vector systems are available for the expression of H and L chain nucleic acid sequence in mammalian cells (see Glover, 1985). Different approaches can be followed to obtain complete H2L2 antibodies. As discussed above, it is possible to co-express H and L chains in the same cells to achieve intracellular association and linkage of H and L chains into complete tetrameric H2L2 antibodies and/or antigen-binding fragment peptides. The co-expression can occur by using either the same or different plasmids in the same host. Genes for both H and L chains and/or CDR3 regions peptides can be placed into the same plasmid, which is then transfected into cells, thereby selecting directly for cells that express both chains. Alternatively, cells can be transfected first with a plasmid encoding one chain, for example the L chain, followed by transfection of the resulting cell line with an H chain plasmid containing a second selectable marker. Cell lines producing antigen-binding peptide fragments and/or H2L2molecules via either route could be transfected with plasmids encoding additional copies of peptides, H, L, or H plus L chains in conjunction with additional selectable markers to generate cell lines with enhanced properties, such as higher production of assembled H2L2 antibody molecules or enhanced stability of the transfected cell lines.

Additionally, plants have emerged as a convenient, safe and economical alternative main-stream expression systems for recombinant antibody production, which are based on large scale culture of microbes or animal cells. Antibodies can be expressed in plant cell culture, or plants grown conventionally. The expression in plants may be systemic, limited to sub-cellular plastids, or limited to seeds (endosperms). Several plant-derived antibodies have reached advanced stages of development (see, e.g., Biolex, NC).

In some aspects, provided herein are methods and systems for the production of a humanized antibody, which is prepared by a process which comprises maintaining a host transformed with a first expression vector which encodes the light chain of the humanized antibody and with a second expression vector which encodes the heavy chain of the humanized antibody under such conditions that each chain is expressed and isolating the humanized antibody formed by assembly of the thus-expressed chains. The first and second expression vectors can be the same vector. Also provided herein are DNA sequences encoding the light chain or the heavy chain of the humanized antibody; an expression vector which incorporates a said DNA sequence; and a host transformed with a said expression vector. Generating a humanized antibody from the sequences and information provided herein can be practiced by those of ordinary skill in the art without undue experimentation. In one approach, there are four general steps employed to humanize a monoclonal antibody. These are: (1) determining the nucleotide and predicted amino acid sequence of the starting antibody light and heavy variable domains; (2) designing the humanized antibody, i.e., deciding which antibody framework region to use during the humanizing process; (3) the actual humanizing methodologies/techniques; and (4) the transfection and expression of the humanized antibody.

Library-Derivation

Antibodies or antigen-binding fragment thereof of the present disclosure may be isolated by screening combinatorial libraries for antibodies with the desired activity or activities. (See, e.g., in Hoogenboom et al., Methods in Molecular Biology 178:1-37 (2001); McCafferty et al., Nature 348:552-554; Clackson et al., Nature 352: 624-628 (1991); Marks et al., J. Mol. Biol. 222: 581-597 (1992); Marks and Bradbury, Methods in Molecular Biology 248: 161-175 (2003); Sidhu et al., J. Mol. Biol. 338(2): 299-310 (2004); Lee et al., J. Mol. Biol. 340(5): 1073-1093 (2004); Fellouse, Proc. Natl. Acad. Sci. USA 101(34): 12467-12472 (2004); and Lee et al., J. Immunol. Methods 284(1-2): 119-132 (2004)). Repertoires of VH and VL genes can be cloned separately (e.g., by PCR) and recombined randomly in libraries (e.g., phage libraries), and screened (See, e.g., Winter et al., Ann. Rev. Immunol., 12: 433-455 (1994)). Alternatively, the naive repertoire can be cloned (e.g., from human) to provide a single source of antibodies to a wide range of non-self and also self-antigens without any immunization (See, e.g., Griffiths et al., EMBO J, 12: 725-734 (1993). Alternatively, naive libraries can be synthetically made by cloning unrearranged V-gene segments from stem cells, and encoding the CDR3 regions using random primers or to rearrange the V-gene segments in vitro (See, e.g., Hoogenboom and Winter, J. Mol. Biol., 227: 381-388 (1992)). Antibodies or antibody fragments isolated from human antibody libraries are considered human antibodies or human antibody fragments herein.

Fusion Proteins

In one aspect, provided herein is a fusion protein comprising an antibody or an antigen-binding fragment, disclosed herein. In some embodiments, fusion protein comprises one or more antibody or antigen-binding fragment thereof, disclosed herein, and an immunomodulator or toxin moiety. Methods of making antibody fusion proteins are known. Antibody fusion proteins comprising an interleukin-2 moiety are described by Boleti et al., Ann. Oneal. 6:945 (1995), Nicolet et al., Cancer Gene Ther. 2:161 (1995), Becker et al., Proc. Natl Acad. Sci. USA 93:7826 (1996), Hank et al., Clin. Cancer Res. 2:1951 (1996), and Hu et al., Cancer Res. 56:4998 (1996). In addition, Yang et al., Hum. Antibodies Hybridomas 6:129 (1995), describe a fusion protein that includes an F(ab')2 fragment and a tumor necrosis factor alpha moiety.

Methods of making antibody-toxin fusion proteins in which a recombinant molecule comprises one or more antibody components and a toxin or chemotherapeutic agent also are known to those of skill in the art. For example, antibody-*Pseudomonas* exotoxin A fusion proteins have been described by Chaudhary et al., Nature 339:394 (1989), Brinkmann et al., Proc. Nat'l Acad. Sci. USA 88:8616 (1991), Batra et al., Proc. Natl Acad. Sci. USA 89:5867 (1992), Friedman et al., J. Immunol. 150:3054 (1993), Weis et al., Int. J. Can. 60:137 (1995), Fominaya et al., J. Biol. Chem. 271:10560 (1996), Kuan et al., Biochemistry 35:2872 (1996), and Schmidt et al., Int. J. Can. 65:538 (1996). Antibody-toxin fusion proteins containing a diphtheria toxin moiety have been described by Kreitman et al., Leukemia 7:553 (1993), Nicholls et al., J. Biol. Chem. 268:5302 (1993), Thompson et al., J. Biol. Chem. 270:28037 (1995), and Vallera et al., Blood 88:2342 (1996). Deonarain et al., Tumor Targeting 1:177 (1995), have described an antibody-toxin fusion protein having an RNase moiety, while Linardou et al., Cell Biophys. 24-25:243 (1994), produced an antibody-toxin fusion protein comprising a DNase I component. Gelonin was used as the toxin moiety in the antibody-toxin fusion protein of Wang et al., Abstracts of the 209th ACS National Meeting, Anaheim, Calif., Apr. 2-6, 1995, Part 1, BIOT005. As a further example, Dohlsten et al., Proc. Natl Acad. Sci. USA 91:8945 (1994), reported an antibody-toxin fusion protein comprising Staphylococcal enterotoxin-A.

Illustrative of toxins which are suitably employed in the preparation of such conjugates are ricin, abrin, ribonuclease, DNase I, Staphylococcal enterotoxin-A, pokeweed antiviral protein, gelonin, diphtheria toxin, *Pseudomonas* exotoxin, and *Pseudomonas* endotoxin. See, for example, Pastan et al., Cell 47:641 (1986), and Goldenberg, C A-A Cancer Journal for Clinicians 44:43 (1994). Other suitable toxins are known to those of skill in the art.

Antibodies or antigen-binding fragment thereof, disclosed herein, may also be used in ADEPT by conjugating the antibody to a prodrug-activating enzyme which converts a prodrug (e.g., a peptidyl chemotherapeutic agent, see, WO 81/01145) to an active anti-cancer drug. See, for example, WO 88/07378 and U.S. Pat. No. 4,975,278. The enzyme component of the immunoconjugate useful for ADEPT includes any enzyme capable of acting on a prodrug in such a way so as to convert it into its more active, cytotoxic form.

Enzymes that are useful in the method of this invention include, but are not limited to, alkaline phosphatase useful for converting phosphate-containing prodrugs into free drugs; arylsulfatase useful for converting sulfate-containing prodrugs into free drugs; cytosine deaminase useful for converting non-toxic 5-fluorocytosine into the anti-cancer drug, 5-fluorouracil; proteases, such as *serratia* protease, thermolysin, subtilisin, carboxypeptidases and cathepsins (such as cathepsins B and L), that are useful for converting peptide-containing prodrugs into free drugs; D-alanylcarboxypeptidases, useful for converting prodrugs that contain D-amino acid substituents; carbohydrate-cleaving enzymes such as galactosidase and neuraminidase useful for converting glycosylated prodrugs into free drugs; lactamase useful for converting drugs derivatized with lactams into free drugs; and penicillin amidases, such as penicillin V amidase or penicillin G amidase, useful for converting drugs derivatized at their amine nitrogens with phenoxyacetyl or phenylacetyl groups, respectively, into free drugs. Alternatively, antibodies with enzymatic activity, also known in the art as abzymes, can be used to convert the prodrugs of the invention into free active drugs (See, e.g., Massey, Nature 328:457-458 (1987)). Antibody-abzyme conjugates can be prepared as described herein for delivery of the abzyme to a tumor cell population.

The enzymes of this invention can be covalently bound to the antibodies by techniques well known in the art such as the use of the heterobifunctional crosslinking reagents discussed above. Alternatively, fusion proteins comprising at least the antigen-binding region of an antibody of the invention linked to at least a functionally active portion of an enzyme of the invention can be constructed using recombinant DNA techniques well known in the art (See, e.g., Neuberger et al., Nature 312: 604-608 (1984)).

Chimeric Antigen Receptors

In one aspect, the disclosure herein, provides a chimeric antigen receptor comprising, an antigen-binding fragment, disclosed herein, a transmembrane domain, and an intracellular signaling domain. The term "chimeric Antigen Receptor" (CAR), "artificial T cell receptor", "chimeric T cell receptor", or "chimeric immunoreceptor" as used herein refers to an engineered receptor, which grafts an arbitrary specificity onto an immune effector cell. CARs typically have an extracellular domain (ectodomain), which comprises an antigen-binding domain, a transmembrane domain, and an intracellular (endodomain) domain. The term "signaling domain" refers to the functional portion of a protein which acts by transmitting information within the cell to regulate cellular activity via defined signaling pathways by generating second messengers or functioning as effectors by responding to such messengers.

An "intracellular signaling domain," as the term is used herein, refers to an intracellular portion of a molecule. The intracellular signaling domain generates a signal that promotes an immune effector function of the CAR containing cell, e.g., a CART cell. Examples of immune effector function, e.g., in a CART cell, include cytolytic activity and helper activity, including the secretion of cytokines. In an embodiment, the intracellular signaling domain can comprise a primary intracellular signaling domain. Exemplary primary intracellular signaling domains include those derived from the molecules responsible for primary stimulation, or antigen dependent simulation. In an embodiment, the intracellular signaling domain can comprise a costimulatory intracellular domain. Exemplary costimulatory intracellular signaling domains include those derived from molecules responsible for costimulatory signals, or antigen independent stimulation. For example, in the case of a CART, a primary intracellular signaling domain can comprise a cytoplasmic sequence of a T cell receptor, and a costimulatory intracellular signaling domain can comprise cytoplasmic sequence from co-receptor or costimulatory molecule.

A primary intracellular signaling domain can comprise a signaling motif which is known as an immunoreceptor tyrosine-based activation motif or ITAM. Examples of ITAM-containing primary cytoplasmic signaling sequences include, but are not limited to, those derived from CD3 zeta, FcR gamma, FcR beta, CD3 gamma, CD3 delta, CD3 epsilon, CD5, CD22, CD79a, CD79b, and CD66d DAP10 and DAP12.

The term "zeta" or alternatively "zeta chain", "CD3-zeta" or "TCR-zeta" is defined as the protein provided as Gen-Bank Acc. No. BAG36664.1, or the equivalent residues from a non-human species, e.g., mouse, rodent, monkey, ape and the like, and a "zeta stimulatory domain" or alternatively a "CD3-zeta stimulatory domain" or a "TCR-zeta stimulatory domain" is defined as the amino acid residues from the cytoplasmic domain of the zeta chain that are sufficient to functionally transmit an initial signal necessary for T cell activation. In one aspect the cytoplasmic domain of zeta comprises residues 52 through 164 of GenBank Acc. No. BAG36664.1 or the equivalent residues from a non-human species, e.g., mouse, rodent, monkey, ape and the like, that are functional orthologs thereof.

The term "costimulatory molecule" refers to the cognate binding partner on a T cell that specifically binds with a costimulatory ligand, thereby mediating a costimulatory response by the T cell, such as, but not limited to, proliferation. Costimulatory molecules are cell surface molecules other than antigen receptors or their ligands that are required for an efficient immune response. Costimulatory molecules include, but are not limited to, an MHC class I molecule, BTLA and a Toll ligand receptor, as well as OX40, CD2, CD27, CD28, CD5, ICAM-1, LFA-1 (CD11a/CD18) and 4-1BB (CD137). A costimulatory intracellular signaling domain can be derived from the intracellular portion of a costimulatory molecule. A costimulatory molecule can be represented in the following protein families: TNF receptor proteins, Immunoglobulin-like proteins, cytokine receptors, integrins, signaling lymphocytic activation molecules (SLAM proteins), and activating NK cell receptors. Examples of such molecules include CD27, CD28, 4-1BB (CD137), OX40, GITR, CD30, CD40, ICOS, BAFFR, HVEM, lymphocyte function-associated antigen-1 (LFA-1), CD2, CD7, LIGHT, NKG2C, SLAMF7, NKp80, CD160, B7-H3, and a ligand that specifically binds with CD83, and the like. The intracellular signaling domain can comprise the entire intracellular portion, or the entire native intracellular signaling domain, of the molecule from which it is derived, or a functional fragment thereof.

In another aspect, the antigen binding fragment comprises a humanized antibody or antibody fragment. In one embodiment, the antigen binding fragment comprises one or more (e.g., one, two, or all three) light chain complementary determining region 1 (CDR-L1), light chain complementary determining region 2 (CDR-L2), and light chain complementary determining region 3 (CDR-L3) of an antibody described herein, and one or more (e.g., one, two, or all three) heavy chain complementary determining region 1 (CDR-H1), heavy chain complementary determining region 2 (CDR-H2), and heavy chain complementary determining region 3 (CDR-H3) of an antibody described herein. In one embodiment, the CDR-L1 comprises a sequence selected from any one of SEQ ID NOS: 814-1084. In one embodiment, the CDR-L2 comprises a sequence selected from any one of SEQ ID NOS: 1356-1626. In one embodiment, the CDR-L3 comprises a sequence selected from any one of SEQ ID NOS: 1898-2168. In one embodiment, the CDR-H1 comprises a sequence selected from any one of SEQ ID NOS: 543-813. In one embodiment, the CDR-H2 comprises a sequence selected from any one of SEQ ID NOS: 1085-1355. In one embodiment, the CDR-H3 comprises a sequence selected from any one of SEQ ID NOS: 1627-1897. In one embodiment, the antigen-binding fragment comprises a light chain variable region described herein and/or a heavy chain variable region described herein. In some embodiments, the light chain variable region comprises a sequence selected from any one of SEQ ID NOS: 272-542. In some embodiments, the heavy chain variable region comprises a sequence selected from any one of SEQ ID NOS: 1-271. In one embodiment, the antigen-binding fragment is a scFv comprising a light chain variable region and a heavy chain variable region of an amino acid sequence, e.g., a light chain variable region and heavy chain variable region described herein. In an embodiment, the antigen-binding fragment (e.g., an scFv) comprises: a light chain variable region comprising an amino acid sequence having at least one, two or three modifications (e.g., substitutions) but not more than 30, 20 or 10 modifications (e.g., substitutions) of an amino acid sequence of a light chain variable region provided herein, or a sequence with 85-99% (e.g., 90-99%, or 95-99%) identity to an amino acid sequence provided herein; and/or a heavy chain variable region comprising an amino acid sequence having at least one, two or three modifications (e.g., substitutions) but not more than 30, 20 or 10 modifications (e.g., substitutions) of an amino acid sequence of a heavy chain variable region provided herein, or a sequence with 85-99% (e.g., 90-99%, or 95-99%) identity to an amino acid sequence provided herein.

Transmembrane Domain

With respect to the transmembrane domain, in various embodiments, a CAR can be designed to comprise a transmembrane domain that is attached to the extracellular domain of the CAR. A transmembrane domain can include one or more additional amino acids adjacent to the transmembrane region, e.g., one or more amino acid associated with the extracellular region of the protein from which the transmembrane was derived (e.g., 1, 2, 3, 4, 5, 6, 7, 8, 9, 10 up to 15 amino acids of the extracellular region) and/or one or more additional amino acids associated with the intracellular region of the protein from which the transmembrane protein is derived (e.g., 1, 2, 3, 4, 5, 6, 7, 8, 9, 10 up to 15 amino acids of the intracellular region). In one aspect, the transmembrane domain is one that is associated with one of the other domains of the CAR is used. In some instances, the transmembrane domain can be selected or modified by amino acid substitution to avoid binding of such domains to the transmembrane domains of the same or different surface membrane proteins, e.g., to minimize interactions with other members of the receptor complex. In one aspect, the transmembrane domain is capable of homodimerization with another CAR on the CART cell surface. In a different aspect, the amino acid sequence of the transmembrane domain may be modified or substituted so as to minimize interactions with the binding domains of the native binding partner present in the same CAR T.

The transmembrane domain may be derived either from a natural or from a recombinant source. Where the source is natural, the domain may be derived from any membrane-bound or transmembrane protein. In one aspect the transmembrane domain is capable of signaling to the intracellular domain(s) whenever the CAR has bound to a target. A transmembrane domain, for example, can include at least the transmembrane region(s) of e.g., the alpha, beta or zeta chain of the T-cell receptor, CD28, CD3 epsilon, CD45, CD4, CD5, CD8, CD9, CD16, CD22, CD33, CD37, CD64, CD80, CD86, CD134, CD137, CD154. In some instances, the transmembrane domain can be attached to the extracellular region of the CAR, e.g., the antigen-binding domain of the CAR, via a hinge, e.g., a hinge from a human protein. For example, in one embodiment, the hinge can be a human Ig (immunoglobulin) hinge, e.g., an IgG4 hinge, or a CD8a hinge. In one aspect, the hinge or spacer comprises an IgG4 hinge.

Cytoplasmic Domain

The cytoplasmic domain or region of the CAR includes an intracellular signaling domain. An intracellular signaling domain is generally responsible for activation of at least one of the normal effector functions of the immune cell in which the CAR has been introduced. The term "effector function" refers to a specialized function of a cell. Effector function of a T cell, for example, may be cytolytic activity or helper activity including the secretion of cytokines. Thus the term "intracellular signaling domain" refers to the portion of a protein which transduces the effector function signal and directs the cell to perform a specialized function. While usually the entire intracellular signaling domain can be employed, in many cases it is not necessary to use the entire chain. To the extent that a truncated portion of the intracellular signaling domain is used, such truncated portion may be used in place of the intact chain as long as it transduces the effector function signal. The term intracellular signaling domain is thus meant to include any truncated portion of the intracellular signaling domain sufficient to transduce the effector function signal. Examples of intracellular signaling domains for use in the CAR of the invention include the cytoplasmic sequences of the T cell receptor (TCR) and co-receptors that act in concert to initiate signal transduction following antigen receptor engagement, as well as any derivative or variant of these sequences and any recombinant sequence that has the same functional capability.

It is known that signals generated through the TCR alone are insufficient for full activation of the T cell and that a secondary and/or costimulatory signal is also required. Thus, T cell activation can be said to be mediated by two distinct classes of cytoplasmic signaling sequences: those that initiate antigen-dependent primary activation through the TCR (primary intracellular signaling domains) and those that act in an antigen-independent manner to provide a secondary or costimulatory signal (secondary cytoplasmic signaling domain, e.g., a costimulatory domain). A primary signaling domain regulates primary activation of the TCR complex either in a stimulatory way, or in an inhibitory way. Primary intracellular signaling domains that act in a stimulatory manner may contain signaling motifs which are known as immunoreceptor tyrosine-based activation motifs or ITAMs.

Examples of ITAM containing primary intracellular signaling domains that are of particular use in the invention include those of TCR zeta, FcR gamma, FcR beta, CD3 gamma, CD3 delta, CD3 epsilon, CD5, CD22, CD79a, CD79b, and CD66d. In one embodiment, a CAR of the invention, e.g., a CAR comprises a intracellular signaling domain, e.g., a primary signaling domain, of CD3-zeta. In one embodiment, a primary signaling domain comprises a modified ITAM domain, e.g., a mutated ITAM domain which has altered (e.g., increased or decreased) activity as compared to the native ITAM domain. In one embodiment, a primary signaling domain comprises a modified ITAM-containing primary intracellular signaling domain, e.g., an optimized and/or truncated ITAM-containing primary intracellular signaling domain. In an embodiment, a primary signaling domain comprises one, two, three, four or more ITAM motifs.

The intracellular signaling domain of the CAR can comprise the CD3-zeta signaling domain by itself or it can be combined with any other desired intracellular signaling domain(s) useful in the context of a CAR of the invention. For example, the intracellular signaling domain of the CAR can comprise a CD3 zeta chain portion and a costimulatory signaling domain. The costimulatory signaling domain refers to a portion of the CAR comprising the intracellular domain of a costimulatory molecule. A costimulatory molecule is a cell surface molecule other than an antigen receptor or its ligands that is required for an efficient response of lymphocytes to an antigen. Examples of such molecules include CD27, CD28, 4-1BB (CD137), OX40, CD30, CD40, PD-1, ICOS, lymphocyte function-associated antigen-1 (LFA-1), CD2, CD7, LIGHT, NKG2C, B7-H3, and a ligand that specifically binds with CD83, and the like. For example, CD27 costimulation has been demonstrated to enhance expansion, effector function, and survival of human CART cells in vitro and augments human T cell persistence and antitumor activity in vivo (Song et al. Blood. 2012; 119(3):696-706). The intracellular signaling sequences within the cytoplasmic portion of a CAR of the invention may be linked to each other in a random or specified order. Optionally, a short oligo- or polypeptide linker, for example, between 2 and 10 amino acids (e.g., 2, 3, 4, 5, 6, 7, 8, 9, or 10 amino acids) in length may form the linkage between intracellular signaling sequence. In one embodiment, a glycine-serine doublet can be used as a suitable linker. In one embodiment, a single amino acid, e.g., an alanine, a glycine, can be used as a suitable linker.

In one aspect, the intracellular signaling domain is designed to comprise two or more, e.g., 2, 3, 4, 5, or more, costimulatory signaling domains. In an embodiment, the two or more, e.g., 2, 3, 4, 5, or more, costimulatory signaling domains, are separated by a linker molecule, e.g., a linker molecule described herein. In one embodiment, the intracellular signaling domain comprises two costimulatory signaling domains. In some embodiments, the linker molecule is a glycine residue. In some embodiments, the linker is an alanine residue. In some embodiments, CAR does not actually recognize the entire antigen; instead it binds to only a portion of the antigen's surface, an area called the antigenic determinant or epitope. In some embodiments, a CAR described herein include (including functional portions and functional variants thereof) glycosylated, amidated, carboxylated, phosphorylated, esterified, N-acylated, cyclized via, e.g., a disulfide bridge, or converted into an acid addition salt and/or optionally dimerized or polymerized, or conjugated.

T Cell Receptor Fusion Proteins (TFP)

As used herein, a "T-cell receptor (TCR) fusion protein" or "TFP" includes a recombinant polypeptide derived from the various polypeptides comprising the TCR that is generally capable of i) binding to a surface antigen on target cells and ii) interacting with other polypeptide components of the intact TCR complex, typically when co-located in or on the surface of a T-cell. Non-limiting examples of TFPs are illustrated in FIGS. 9-12.

In one aspect provided herein is an isolated TFP molecule that comprises a human or humanized anti-cancer antigen (anti-Cag) binding domain, a TCR extracellular domain, a transmembrane domain, and an intracellular signaling domain. In some embodiments, the TFP molecule is capable of functionally interacting with an endogenous TCR complex and/or at least one endogenous TCR polypeptide. In some instances, the anti-CAg binding domain is a scFv or a VH domain. In some instances, the anti-CAg binding domain comprises a heavy chain with 95-100% identity to an amino acid sequence of SEQ ID NOs: 1-271, a functional fragment thereof, or an amino acid sequence thereof having at least one but not more than 30 modifications. In some instances, the anti-CAg binding domain comprises a light chain with 95-100% identity to an amino acid sequence of SEQ ID NOs: 272-542, a functional fragment thereof, or an amino acid sequence thereof having at least one but not more than 30 modifications. In some instances, the isolated TFP molecule comprises a TCR extracellular domain that comprises an extracellular domain or portion thereof of a protein selected from the group consisting of a TCR alpha chain, a TCR beta chain, a CD3 epsilon TCR subunit, a CD3 gamma TCR subunit, a CD3 delta TCR subunit, functional fragments thereof, and amino acid sequences thereof having at least one but not more than 20 modifications. In some instances, the anti-CAg binding domain is connected to the TCR extracellular domain by a linker sequence. In some instances, the linker region comprises (G4S)n, wherein n=1 to 4.

In one aspect, provided herein is a vector that comprises a nucleic acid molecule encoding a TFP provided herein. In some instances, the vector is selected from the group consisting of a DNA, a RNA, a plasmid, a lentivirus vector, adenoviral vector, a Rous sarcoma viral (RSV) vector, or a retrovirus vector. In some instances, the vector further comprises a promoter. In some instances, the vector is an in vitro transcribed vector. In some instances, a nucleic acid sequence in the vector further comprises a poly(A) tail. In some instances, a nucleic acid sequence in the vector further comprises a 3'UTR.

In one aspect, provided herein is a cell that comprises a vector provided herein. In some instances, the cell is a human T-cell. In some instances, the T-cell is a CD8+ or CD4+ T-cell. In some instances, the cell further comprises a nucleic acid encoding an inhibitory molecule that comprises a first polypeptide that comprises at least a portion of an inhibitory molecule, associated with a second polypeptide that comprises a positive signal from an intracellular signaling domain. In some instances, the inhibitory molecule comprise first polypeptide that comprises at least a portion of PD1 and a second polypeptide comprising a costimulatory domain and primary signaling domain.

In one aspect, provided herein is a human CD8+ or CD4+ T-cell that comprises at least two TFP molecules, the TFP molecules comprising a human or humanized anti-CAg binding domain, a TCR extracellular domain, a transmembrane domain, and an intracellular domain, wherein the TFP molecule is capable of functionally interacting with an endogenous TCR complex and/or at least one endogenous TCR polypeptide in, at and/or on the surface of the human CD8+ or CD4+ T-cell.

In one aspect, provided herein is a protein complex that comprises: a TFP molecule comprising a human or humanized anti-CAg binding domain, a TCR extracellular domain, a transmembrane domain, and an intracellular domain; and at least one endogenous TCR complex.

In some instances, the TCR comprises an extracellular domain or portion thereof of a protein selected from the group consisting of TCR alpha chain, a TCR beta chain, a CD3 epsilon TCR subunit, a CD3 gamma TCR subunit, and a CD3 delta TCR subunit. In some instances, the anti-CAg binding domain is connected to the TCR extracellular domain by a linker sequence. In some instances, the linker region comprises (G4S)n, wherein n=1 to 4. In some instances, the disease associated with the cancer antigen expression is selected from the group consisting of a proliferative disease, a cancer, a malignancy, myelodysplasia, a myelodysplastic syndrome, a preleukemia, a non-cancer related indication associated with expression of the cancer antigen. In some instances, the disease is a cancer or a metastasis thereof. In some instances, the cells expressing a TFP molecule are administered in combination with an agent that increases the efficacy of a cell expressing a TFP molecule.

In one aspect, an isolated nucleic acid molecule provided herein, an isolated polypeptide molecule provided herein, an isolated TFP provided herein, a complex provided herein, a vector provided herein, or a cell provided herein, is for use as a medicament.

The term "stimulation" refers to a primary response induced by binding of a stimulatory domain or stimulatory molecule (e.g., a TCR/CD3 complex) with its cognate ligand thereby mediating a signal transduction event, such as, but not limited to, signal transduction via the TCR/CD3 complex. Stimulation can mediate altered expression of certain molecules, and/or reorganization of cytoskeletal structures, and the like. Methods of making, expressing and isolating TFPs are known in the art in, for example, U.S. Pre-Grant Publication No. 20170166622 A1, which methods are hereby incorporated by reference.

Antigen-Binding Domain

The TFP of the invention comprises a target-specific binding element otherwise referred to as an antigen-binding domain. The choice of moiety depends upon the type and number of target antigen that define the surface of a target cell. For example, the antigen-binding domain may be chosen to recognize a target antigen that acts as a cell surface marker on target cells associated with a particular disease state. Thus examples of cell surface markers that may act as target antigens for the antigen-binding domain in a TFP of the invention include those associated with cancerous diseases (e.g., malignant diseases).

In one aspect, the TFP-mediated T-cell response can be directed to an antigen of interest by way of engineering an antigen-binding domain into the TFP that specifically binds a desired antigen. In one aspect, the portion of the TFP comprising the antigen-binding domain comprises an antigen-binding domain that targets a cancer antigen (CAg). In one aspect, the antigen-binding domain targets human CAg. The antigen-binding domain can be any domain that binds to the CAg including but not limited to a monoclonal antibody, a polyclonal antibody, a recombinant antibody, a human antibody, a humanized antibody, and a functional fragment thereof, including but not limited to a single-domain antibody such as a heavy chain variable domain (VH), a light chain variable domain (VL) and a variable domain (VHH) of a camelid derived nanobody, and to an alternative scaffold known in the art to function as antigen-binding domain, such as a recombinant fibronectin domain, anticalin, DARPIN, and the like. Likewise a natural or synthetic ligand specifically recognizing and binding the target CAg can be used as antigen-binding domain for the TFP. In some instances, it is beneficial for the antigen-binding domain to be derived from the same species in which the TFP will ultimately be used in. For example, for use in humans, it may be beneficial for the antigen-binding domain of the TFP to comprise human or humanized residues for the antigen-binding domain of an antibody or antibody fragment.

The portion of the TFP composition of the invention comprising an antibody or antibody fragment thereof may exist in a variety of forms where the antigen-binding domain is expressed as part of a contiguous polypeptide chain including, for example, a single domain antibody fragment (sdAb), a single chain antibody (scFv) derived from a murine, humanized or human antibody (Harlow et al., 1999, In: Using Antibodies: A Laboratory Manual, Cold Spring Harbor Laboratory Press, N.Y.; Harlow et al., 1989, In: Antibodies: A Laboratory Manual, Cold Spring Harbor, N.Y.; Houston et al., 1988, Proc. Natl. Acad. Sci. USA 85:5879-5883; Bird et al., 1988, Science 242:423-426). In one aspect, the antigen-binding domain of a TFP composition of the invention comprises an antibody fragment. In a further aspect, the TFP comprises an antibody fragment that comprises a scFv or a sdAb.

In another aspect, the antigen-binding domain comprises a humanized antibody or antigen-binding domain. In one embodiment, the antigen-binding domain comprises one or more (e.g., one, two, or all three) light chain complementary determining region 1 (CDR-L1), light chain complementary determining region 2 (CDR-L2), and light chain complementary determining region 3 (CDR-L3) of an antibody described herein, and one or more (e.g., one, two, or all three) heavy chain complementary determining region 1 (CDR-H1), heavy chain complementary determining region 2 (CDR-H2), and heavy chain complementary determining region 3 (CDR-H3) of an antibody described herein. In some embodiments, the CDR-H1 comprises a sequence selected from any one of SEQ ID NOs: 543-813. In some embodiments, the CDR-H2 comprises a sequence selected from any one of SEQ ID NOs: 1085-1355. In some embodiments the CDR-H3 comprises a sequence selected from any one of SEQ ID NOS: 1627-1897. In some embodiments, the CDR-L1 comprises a sequence selected from any one of SEQ ID NOs: 814-1084. In some embodiments, the CDR-L2 comprises a sequence selected from any one of SEQ ID NOs: 1356-1626. In some embodiments, the CDR-L3 comprises a sequence selected from any one of SEQ ID NOs: 1898-2168. In one embodiment, the antigen-binding domain comprises a heavy chain variable region described herein and/or a light chain variable region described herein. In some embodiments, the heavy chain variable region comprises a sequence selected from any one of SEQ ID NOs: 1-271. In some embodiments, the light chain variable region comprises a sequence selected from any one of SEQ ID NOs: 272-542.

In some embodiments, the antigen-binding domain is a scFv comprising a heavy chain variable region and a light chain variable region of an amino acid sequence, e.g., a heavy chain variable region and light chain variable region described herein. In some embodiments, the antigen-binding domain (e.g., an scFv) comprises a heavy chain variable region comprising an amino acid sequence having at least one, two or three modifications (e.g., substitutions) but not more than 30, 20 or 10 modifications (e.g., substitutions) of an amino acid sequence of a heavy chain variable region provided herein, or a sequence with 85-99% (e.g., 90-99%, or 95-99%) identity to an amino acid sequence provided herein; and/or a light chain variable region comprising an amino acid sequence having at least one, two or three modifications (e.g., substitutions) but not more than 30, 20 or 10 modifications (e.g., substitutions) of an amino acid sequence of a light chain variable region provided herein, or a sequence with 85-99% (e.g., 90-99%, or 95-99%) identity to an amino acid sequence provided herein; and/or The term "stimulatory molecule" or "stimulatory domain" refers to a molecule or portion thereof expressed by a T-cell that provides the primary cytoplasmic signaling sequence(s) that regulate primary activation of the TCR complex in a stimulatory way for at least some aspect of the T-cell signaling pathway. In one aspect, the primary signal is initiated by, for instance, binding of a TCR/CD3 complex with an MHC molecule loaded with peptide, and which leads to mediation of a T-cell response, including, but not limited to, proliferation, activation, differentiation, and the like. A primary cytoplasmic signaling sequence (also referred to as a "primary signaling domain") that acts in a stimulatory manner may contain a signaling motif which is known as immunoreceptor tyrosine-based activation motif (ITAM). Examples of an ITAM containing primary cytoplasmic signaling sequence that is of particular use in the invention includes, but is not limited to, those derived from TCR zeta, FcR gamma, FcR beta, CD3 gamma, CD3 delta, CD3 epsilon, CDS, CD22, CD79a, CD79b, CD278 (also known as "ICOS") and CD66d.

The term "antigen presenting cell" or "APC" refers to an immune system cell such as an accessory cell (e.g., a B-cell, a dendritic cell, and the like) that displays a foreign antigen complexed with major histocompatibility complexes (MHC's) on its surface. T-cells may recognize these complexes using their T-cell receptors (TCRs). APCs process antigens and present them to T-cells.

An "intracellular signaling domain," as the term is used herein, refers to an intracellular portion of a molecule. The intracellular signaling domain generates a signal that promotes an immune effector function of the TFP containing cell, e.g., a TFP-expressing T-cell. Examples of immune effector function, e.g., in a TFP-expressing T-cell, include cytolytic activity and T helper cell activity, including the secretion of cytokines. In an embodiment, the intracellular signaling domain can comprise a primary intracellular signaling domain. Exemplary primary intracellular signaling domains include those derived from the molecules responsible for primary stimulation, or antigen dependent simulation. In an embodiment, the intracellular signaling domain can comprise a costimulatory intracellular domain. Exemplary costimulatory intracellular signaling domains include those derived from molecules responsible for costimulatory signals, or antigen independent stimulation.

A primary intracellular signaling domain can comprise an ITAM ("immunoreceptor tyrosine-based activation motif"). Examples of ITAM containing primary cytoplasmic signaling sequences include, but are not limited to, those derived from CD3 zeta, FcR gamma, FcR beta, CD3 gamma, CD3 delta, CD3 epsilon, CDS, CD22, CD79a, CD79b, and CD66d DAP10 and DAP12.

The term "costimulatory molecule" refers to the cognate binding partner on a T-cell that specifically binds with a costimulatory ligand, thereby mediating a costimulatory response by the T-cell, such as, but not limited to, proliferation. Costimulatory molecules are cell surface molecules other than antigen receptors or their ligands that are required for an efficient immune response. Costimulatory molecules include, but are not limited to an MHC class 1 molecule, BTLA and a Toll ligand receptor, as well as OX40, CD2, CD27, CD28, CDS, ICAM-1, LFA-1 (CD11a/CD18) and 4-1BB (CD137). A costimulatory intracellular signaling domain can be the intracellular portion of a costimulatory molecule. A costimulatory molecule can be represented in the following protein families: TNF receptor proteins, Immunoglobulin-like proteins, cytokine receptors, integrins, signaling lymphocytic activation molecules (SLAM proteins), and activating NK cell receptors. Examples of such molecules include CD27, CD28, 4-1BB (CD137), OX40, GITR, CD30, CD40, ICOS, BAFFR, HVEM, lymphocyte function-associated antigen-1 (LFA-1), CD2, CD7, LIGHT, NKG2C, SLAMF7, NKp80, CD160, B7-H3, and a ligand that specifically binds with CD83, and the like. The intracellular signaling domain can comprise the entire intracellular portion, or the entire native intracellular signaling domain, of the molecule from which it is derived, or a functional fragment thereof. The term "4-1BB" refers to a member of the TNFR superfamily with an amino acid sequence provided as GenBank Acc. No. AAA62478.2, or the equivalent residues from a non-human species, e.g., mouse, rodent, monkey, ape and the like; and a "4-1BB costimulatory domain" is defined as amino acid residues 214-255 of GenBank Acc. No. AAA62478.2, or the equivalent residues from a non-human species, e.g., mouse, rodent, monkey, ape and the like.

Extracellular Domain

The extracellular domain may be derived either from a natural or from a recombinant source. Where the source is natural, the domain may be derived from any protein, but in particular a membrane-bound or transmembrane protein. In one aspect the extracellular domain is capable of associating with the transmembrane domain. An extracellular domain of particular use in this invention may include at least the extracellular region(s) of e.g., the alpha, beta or zeta chain of the T-cell receptor, or CD3 epsilon, CD3 gamma, or CD3 delta, or in alternative embodiments, CD28, CD45, CD4, CDS, CD8, CD9, CD16, CD22, CD33, CD37, CD64, CD80, CD86, CD134, CD137, CD154.

Transmembrane Domain

In general, a TFP sequence contains an extracellular domain and a transmembrane domain encoded by a single genomic sequence. In alternative embodiments, a TFP can be designed to comprise a transmembrane domain that is heterologous to the extracellular domain of the TFP. A transmembrane domain can include one or more additional amino acids adjacent to the transmembrane region, e.g., one or more amino acid associated with the extracellular region of the protein from which the transmembrane was derived (e.g., 1, 2, 3, 4, 5, 6, 7, 8, 9, 10 or up to 15 amino acids of the extracellular region) and/or one or more additional amino acids associated with the intracellular region of the protein from which the transmembrane protein is derived (e.g., 1, 2, 3, 4, 5, 6, 7, 8, 9, 10 or up to 15 amino acids of the intracellular region). In one aspect, the transmembrane domain is one that is associated with one of the other domains of the TFP is used. In some instances, the transmembrane domain can be selected or modified by amino acid substitution to avoid binding of such domains to the transmembrane domains of the same or different surface membrane proteins, e.g., to minimize interactions with other members of the receptor complex. In one aspect, the transmembrane domain is capable of homodimerization with another TFP on the TFP-T-cell surface. In a different aspect the amino acid sequence of the transmembrane domain may be modified or substituted so as to minimize interactions with the binding domains of the native binding partner present in the same TFP.

The transmembrane domain may be derived either from a natural or from a recombinant source. Where the source is natural, the domain may be derived from any membrane-bound or transmembrane protein. In one aspect the transmembrane domain is capable of signaling to the intracellular domain(s) whenever the TFP has bound to a target. A transmembrane domain of particular use in this invention may include at least the transmembrane region(s) of e.g., the alpha, beta or zeta chain of the T-cell receptor, CD28, CD3 epsilon, CD45, CD4, CD5, CD8, CD9, CD16, CD22, CD33, CD37, CD64, CD80, CD86, CD134, CD137, CD154. In some instances, the transmembrane domain can be attached to the extracellular region of the TFP, e.g., the antigen-binding domain of the TFP, via a hinge, e.g., a hinge from a human protein. For example, in one embodiment, the hinge can be a human immunoglobulin (Ig) hinge, e.g., an IgG4 hinge, or a CD8a hinge.

Linkers

Optionally, a linker may form the linkage between the transmembrane domain and the cytoplasmic region of the TFP. For examples of linker orientation and size see, e.g., Hollinger et al. 1993 Proc Natl Acad. Sci. U.S.A. 90:6444-6448, U.S. Patent Application Publication Nos. 2005/0100543, 2005/0175606, 2007/0014794, and PCT publication Nos. WO2006/020258 and WO2007/024715, is incorporated herein by reference. For example, a short oligo- or polypeptide linker, between 2 and 10 amino acids in length may form the linkage between the transmembrane domain and the cytoplasmic region of the TFP. In some instances, a linker can be about 10, 11, 12, 13, 14, 15 or greater than 15 residues between VL and VH regions. The linker sequence may comprise any naturally occurring amino acid. Variation in the linker length may retain or enhance activity, giving rise to superior efficacy in activity studies. In one aspect, a linker comprises amino acids glycine and serine with an optimized length and/or amino acid composition. The linker length can greatly affect how the variable regions of a polypeptide fold and interact. In fact, if a short polypeptide linker is employed (e.g., between 5-10 amino acids) intra-chain folding is prevented. Inter-chain folding is also required to bring the two variable regions together to form a functional epitope binding site. In some embodiments, the linker sequence comprises sets of glycine and serine repeats such as (Gly4Ser)n, where n is a positive integer equal to or greater than 1. In some instances, the linker sequence comprises a long linker (LL) sequence. In some instances, the long linker sequence comprises (G4S)n, wherein n=2 to 4. In some instances, the linker sequence comprises a short linker (SL) sequence. In some instances, the short linker sequence comprises (G4S)n, wherein n=1 to 3. A glycine-serine doublet provides a particularly suitable linker. For example, in one aspect, the linker comprises the amino acid sequence of GGGGSGGGGS. In some embodiments, the linker is encoded by a nucleotide sequence of GGTGGCGGAGGTTCTGGAGGTGGAGGTTCC. In one embodiment, the linker can be (Gly4Ser)4 or (Gly4Ser)3.

Purification

The term "isolated" means altered or removed from the natural state. For example, a nucleic acid or a polypeptide naturally present in a living animal is not "isolated," but the same nucleic acid or polypeptide partially or completely separated from the coexisting materials of its natural state is "isolated." An isolated nucleic acid or polypeptide can exist in substantially purified form, or can exist in a non-native environment such as, for example, a host cell. An isolated polypeptide is one that has been separated and/or recovered from a component of its natural environment. Contaminant components of its natural environment are materials that would interfere with diagnostic or therapeutic uses of the polypeptide, and may include enzymes, hormones, and other proteinaceous or non-proteinaceous components. In preferred embodiments, the polypeptide is purified: (1) to greater than 95% by weight of polypeptide as determined by the Lowry method, and most preferably more than 99% by weight; (2) to a degree sufficient to obtain at least 15 residues of N-terminal or internal amino acid sequence by use of a spinning cup sequenator; or (3) to homogeneity as shown by SDS-PAGE under reducing or non-reducing conditions and using Coomassie blue or, preferably, silver staining. Isolated antibody includes the polypeptide in situ within recombinant cells since at least one component of the polypeptide's natural environment will not be present. Ordinarily, however, isolated polypeptide will be prepared by at least one purification step.

In one aspect, disclosed herein is a purified antibody or antigen-binding fragment as provided herein. Once expressed, the whole antibodies, their dimers, individual light and heavy chains, or other immunoglobulin forms of the present invention can be recovered and purified by known techniques, e.g., immunoabsorption or immunoaffinity chromatography, chromatographic methods such as HPLC (high performance liquid chromatography), ammonium sulfate precipitation, gel electrophoresis, or any combination of these. See generally, Scopes, PROTEIN PURIF. (Springer-Verlag, NY, 1982).

Substantially pure immunoglobulins of at least about 90% to 95% homogeneity are advantageous, as are those with 98% to 99% or more homogeneity, particularly for pharmaceutical uses. When using recombinant techniques, the antibody can be produced intracellularly, in the periplasmic space, or directly secreted into the medium, including from microbial cultures. If the antibody is produced intracellularly, as a first step, the particulate debris, either host cells or lysed fragments, is removed, for example, by centrifugation or ultrafiltration. Better et al. Science 240: 1041-1043 (1988); ICSU Short Reports 10: 105 (1990); and Proc. Natl. Acad. Sci. USA 90: 457-461 (1993) describe a procedure for isolating antibodies which are secreted to the periplasmic space of *E. coli*. (See also, [Carter et al., Bio/Technology 10: 163-167 (1992)].

The antibody composition prepared from microbial or mammalian cells can be purified using, for example, hydroxylapatite chromatography cation or avian exchange chromatography, and affinity chromatography, with affinity chromatography being the preferred purification technique. The suitability of protein A as an affinity ligand depends on the species and isotype of any immunoglobulin Fe domain that is present in the antibody. Protein A can be used to purify antibodies that are based on human γ1, γ2, or γ4 heavy chains (Lindmark et al., J. Immunol. Meth. 62: 1-13 (1983)). Protein G is recommended for all mouse isotypes and for human γ3 (Guss et al., EMBO J. 5: 15671575 (1986)). The matrix to which the affinity ligand is attached is most often agarose, but other matrices are available. Mechanically stable matrices such as controlled pore glass or poly(styrenedivinyl)benzene allow for faster flow rates and shorter processing times than can be achieved with agarose. Where the antibody comprises a CH 3 domain, the Bakerbond ABX™ resin (J. T. Baker, Phillipsburg, N.J.) is useful for purification. Other techniques for protein purification such as fractionation on an ion-exchange column, ethanol precipitation, Reverse Phase HPLC, chromatography on silica, chromatography on heparin SEPHAROSE™ chromatography on an anion or cation exchange resin (such as a polyaspartic acid column), chromatofocusing, SDS-PAGE, and ammonium sulfate precipitation are also available depending on the antibody to be recovered. Once purified, partially or to homogeneity as desired, a humanized or composite human antibody can then be used therapeutically or in developing and performing assay procedures, immunofluorescent staining, and the like. See generally, Vols. I & II Immunol. Meth. (Lefkovits & Pernis, eds., Acad. Press, N Y, 1979 and 1981).

Functional activities of an antibody or antigen-binding fragment disclosed herein include, but are not limited to, biological activity and ability to bind to a cancer cell antigen. Additionally, a polypeptide having functional activity means the polypeptide exhibits activity similar, but not necessarily identical to, an activity of an antibody described herein, including mature forms, as measured in a particular assay, such as, for example, a biological assay, with or without dose dependency. In the case where dose dependency does exist, it need not be identical to that of the antibodies of the disclosure, but rather substantially similar to the dose-dependence in a given activity as compared to the antibodies set forth herein (i.e., the candidate polypeptide will exhibit greater activity, or not more than about 25-fold less, about 10-fold less, or about 3-fold less activity relative to the antibodies described herein).

Methods of Engineering Antibodies

As discussed above, antibodies having VH and VL sequences disclosed herein can be used to create new antibodies, respectively, by modifying the VH and/or VL sequences, or the constant regions attached thereto. Thus, in another aspect according to at least some embodiments of the present disclosure, the structural features of an antibody disclosed herein according to at least some embodiments of the disclosure, are used to create structurally related antibodies that retain at least one functional property of the parent antibodies according to at least some embodiments of the disclosure herein, such as binding to human cancer cell antigen, respectively. For example, one or more CDR regions of one antibody disclosed herein or mutations thereof, can be combined recombinantly with known framework regions and/or other CDRs to create additional, recombinantly-engineered, antibodies according to at least some embodiments of the disclosure, as discussed above. Other types of modifications include those described in the previous section. The starting material for the engineering method is one or more of the VH and/or VL sequences provided herein, or one or more CDR regions thereof, or one or more of the CDR3 region sequences provided herein. To create the engineered antibody, it is not necessary to actually prepare (i.e., express as a protein) an antibody having one or more of the VH and/or VL sequences provided herein, or one or more CDR regions thereof. Rather, the information contained in the sequences is used as the starting material to create a "second generation" sequences derived from the original sequences and then the "second generation" sequences is prepared and expressed as a protein.

Standard molecular biology techniques can be used to prepare and express altered antibody sequence. Preferably, the antibody encoded by the altered antibody sequences is one that retains one, some or all of the functional properties of the antibodies disclosed herein, respectively, produced by methods and with sequences provided herein, which functional properties include, for example, binding to a cancer cell antigen with a specific $K_D$ level or less and/or modulating immune stimulation and/or selectively binding to desired target cells such as for example, that express cancer associated antigen.

The functional properties of the altered antibodies can be assessed using standard assays available in the art and/or described herein. In some embodiments, mutations can be introduced randomly or selectively along all or part of an antibody coding sequence disclosed herein and the resulting modified antibodies can be screened for binding activity and/or other desired functional properties. Mutational methods have been described in the art. For example, PCT Publication WO 02/092780 by Short describes methods for creating and screening antibody mutations using saturation mutagenesis, synthetic ligation assembly, or a combination thereof. Alternatively, PCT Publication WO 03/074679 by Lazar et al. describes methods of using computational screening methods to optimize physiochemical properties of antibodies.

Nucleic Acid Molecules Encoding Antibodies

Using the information provided herein, for example, the nucleic acid and amino acid sequences disclosed herein; a nucleic acid molecule encoding the antibodies or antigen-binding fragment thereof can be obtained. Such a nucleic acid molecule can be obtained, for example, using conventional methods disclosed in the art. Nucleic acid molecules of the present disclosure may be in the form of RNA, such as mRNA, hnRNA, tRNA or any other form, or in the form of DNA, including but not limited to, cDNA and genomic DNA obtained by cloning or produced synthetically, or any combinations thereof. The DNA may be triplex, duplex or single-stranded, or any combination thereof. Any portion of at least one strand of the DNA or RNA may be the coding strand, also known as the sense strand, or it can be the antisense strand, also known as the antisense strand.

"Polynucleotide," or "nucleic acid," or "nucleic acid molecule" as used interchangeably herein, refer to polymers of nucleotides of any length, and include DNA and RNA. The nucleotides can be deoxyribonucleotides, ribonucleotides, modified nucleotides or bases, and/or their analogs, or any substrate that can be incorporated into a polymer by DNA or RNA polymerase. A polynucleotide may comprise modified nucleotides, such as methylated nucleotides and their analogs. If present, modification to the nucleotide structure may be imparted before or after assembly of the polymer. The sequence of nucleotides may be interrupted by non-nucleotide components. A polynucleotide may be further modified after polymerization, such as by conjugation with a labeling component. Other types of modifications include, for example, "caps", substitution of one or more of the naturally occurring nucleotides with an analog, internucleotide modifications such as, for example, those with uncharged linkages (e.g., methyl phosphonates, phosphotriesters, phosphoamidates, carbamates, etc.) and with charged linkages (e.g., phosphorothioates, phosphorodithioates, etc.), those containing pendant moieties, such as, for example, proteins (e.g., nucleases, toxins, antibodies, signal peptides, ply-L-lysine, etc.), those with intercalators (e.g., acridine, psoralen, etc.), those containing chelators (e.g., metals, radioactive metals, boron, oxidative metals, etc.), those containing alkylators, those with modified linkages (e.g., alpha anomeric nucleic acids, etc.), as well as unmodified forms of the polynucleotide(s). Further, any of the hydroxyl groups ordinarily present in the sugars may be replaced, for example, by phosphonate groups, phosphate groups, protected by standard protecting groups, or activated to prepare additional linkages to additional nucleotides, or may be conjugated to solid supports. The 5' and 3' terminal OH can be phosphorylated or substituted with amines or organic capping group moieties of from 1 to 20 carbon atoms. Other hydroxyls may also be derivatized to standard protecting groups. Polynucleotides can also contain analogous forms of ribose or deoxyribose sugars that are generally known in the art, including, for example, 2'-O-methyl-, 2'-O-allyl, 2'-fluoro- or 2'-azido-ribose, carbocyclic sugar analogs, α-anomeric sugars, epimeric sugars such as arabinose, xyloses or lyxoses, pyranose sugars, furanose sugars, sedoheptuloses, acyclic analogs and abasic nucleoside analogs such as methyl riboside. One or more phosphodiester linkages may be replaced by alternative linking groups. These alternative linking groups include, but are not limited to, embodiments wherein phosphate is replaced by P(O)S ("thioate"), P(S)S ("dithioate"), "(O)NR2 ("amidate"), P(O) R, P(O)OR', CO or CH2 ("formacetal"), in which each R or R' is independently H or substituted or unsubstituted alkyl (1-20 C) optionally containing an ether (—O—) linkage, aryl, alkenyl, cycloalkyl, cycloalkenyl or araldyl. Not all linkages in a polynucleotide need be identical. The preceding description applies to all polynucleotides referred to herein, including RNA and DNA.

In the context of the present invention, the following abbreviations for the commonly occurring nucleic acid bases are used. "A" refers to adenosine, "C" refers to cytosine, "G" refers to guanosine, "T" refers to thymidine, and "U" refers to uridine. In some embodiments, the nucleic acid molecule comprises an isolated nucleic acid. In some embodiments, a nucleic acid molecule comprises one more nucleic acid sequences operably linked to one another. The term "operably linked" or "transcriptional control" refers to functional linkage between a regulatory sequence and a heterologous nucleic acid sequence resulting in expression of the latter. For example, a first nucleic acid sequence is operably linked with a second nucleic acid sequence when the first nucleic acid sequence is placed in a functional relationship with the second nucleic acid sequence. For instance, a promoter is operably linked to a coding sequence if the promoter affects the transcription or expression of the coding sequence. Operably linked DNA sequences can be contiguous with each other and, e.g., where necessary to join two protein coding regions, are in the same reading frame.

"Isolated nucleic acid", as used herein, is a nucleic acid that is substantially separated from other genome DNA sequences as well as proteins or complexes such as ribosomes and polymerases, which naturally accompany a native sequence. The term embraces a nucleic acid sequence that has been removed from its naturally occurring environment, and includes recombinant or cloned DNA isolates and chemically synthesized analogues or analogues biologically synthesized by heterologous systems. A substantially pure nucleic acid includes isolated forms of the nucleic acid. Of course, this refers to the nucleic acid as originally isolated and does not exclude genes or sequences later added to the isolated nucleic acid by the hand of man.

Another aspect of the present disclosure pertains to nucleic acid molecules comprising nucleic acid sequences that encode the antibody polypeptide, described herein or antigen-binding fragment thereof. In some embodiments, the nucleic acid sequence encoding a heavy chain polypeptide is selected from any one of SEQ ID NOs: 2169-2439. In some embodiments, the isolated nucleic acid molecule comprises a nucleic acid sequence encoding a light chain polypeptide of an antibody. In some embodiments, the nucleic acid sequence encoding a light chain polypeptide is selected from any one of SEQ ID NOs: 2440-2710. In some embodiments, the isolated nucleic acid molecule comprises a nucleic acid sequence encoding a CDR1, CDR2, or CDR3 polypeptide of a variable heavy chain. In some embodiments, the isolated nucleic acid molecule comprises a nucleic acid sequence encoding a CDR1, CDR2, or CDR3 polypeptide of a variable light chain. In some embodiments, the nucleic acid sequence encoding the CDR1 polypeptide of a variable heavy chain (CDR-H1) is selected from any one of SEQ ID NOS: 2711-2981. In some embodiments, the nucleic acid sequence encoding the CDR2 polypeptide of a variable heavy chain (CDR-H2) is selected from any one of SEQ ID NOS: 3253-3523. In some embodiments, the nucleic acid sequence encoding the CDR3 polypeptide of a variable heavy chain (CDR-H3) is selected from any one of SEQ ID NOS: 3795-4065.

In some embodiments, the nucleic acid molecule comprises a sequence encoding a CDR1, CDR2, or CDR3 polypeptide of a variable light chain. In some embodiments, the nucleic acid sequence encoding the CDR1 region of a variable light chain polypeptide is selected from any one of SEQ ID NOS: 2982-3252. In some embodiments, the nucleic acid sequence encoding the CDR2 region of a variable light chain polypeptide is selected from any one of SEQ ID NOS: 3524-3794. In some embodiments, the nucleic acid sequence encoding the CDR3 region of a variable light chain polypeptide is selected from any one of SEQ ID NOS: 4056-4336. The nucleic acids can be present in whole cells, in a cell lysate, or in a partially purified or substantially pure form. A nucleic acid is "isolated" or "rendered substantially pure" when purified away from other cellular components or other contaminants, e.g., other cellular nucleic acids or proteins, by standard techniques, including alkaline/SDS treatment, CsCl banding, column chromatography, agarose gel electrophoresis and others well known in the art. See, F. Ausubel, et al., ed. (1987) Current Protocols in Molecular Biology, Greene Publishing and Wiley Interscience, New York. A nucleic acid according to at least some embodiments of the disclosure can be, for example, DNA or RNA and may or may not contain intronic sequences. In a preferred embodiment, the nucleic acid is a cDNA molecule.

Nucleic acids according to at least some embodiments of the present disclosure can be obtained using standard molecular biology techniques. For antibodies expressed by hybridomas (e.g., hybridomas prepared from transgenic mice carrying human immunoglobulin genes as described further below), cDNAs encoding the light and heavy chains of the antibody made by the hybridoma can be obtained by standard PCR amplification or cDNA cloning techniques. For antibodies obtained from an immunoglobulin gene library (e.g., using phage display techniques), nucleic acid encoding the antibody can be recovered from the library.

Once DNA fragments encoding VH and VL segments are obtained, these DNA fragments can be further manipulated by standard recombinant DNA techniques, for example to convert the variable region genes to full-length antibody chain genes, to Fab fragment genes or to a scFv gene. In these manipulations, a VL- or VH-encoding DNA fragment is operatively linked to another DNA fragment encoding another protein, such as an antibody constant region or a flexible linker. The term "operatively linked", as used in this context, is intended to mean that the two DNA fragments are joined such that the amino acid sequences encoded by the two DNA fragments remain in-frame. The isolated DNA encoding the VH region can be converted to a full-length heavy chain gene by operatively linking the VH-encoding DNA to another DNA molecule encoding heavy chain constant regions (CH1, CH2 and CH3). The sequences of human heavy chain constant region genes are known in the art (see e.g., Kabat, E. A., et al. (1991) Sequences of Proteins of Immunological Interest, Fifth Edition, U.S. Department of Health and Human Services, NIH Publication No. 91-3242) and DNA fragments encompassing these regions can be obtained by standard PCR amplification. The heavy chain constant region can be an IgG1, IgG2, IgG3, IgG4, IgA, IgE, IgM or IgD constant region, but most preferably is an IgG1 or IgG4 constant region. For a Fab fragment heavy chain gene, the VH-encoding DNA can be operatively linked to another DNA molecule encoding only the heavy chain CH1 constant region.

The isolated DNA encoding the VL region can be converted to a full-length light chain gene (as well as a Fab light chain gene) by operatively linking the VL-encoding DNA to another DNA molecule encoding the light chain constant region, CL. The sequences of human light chain constant region genes are known in the art (see e.g., Kabat, E. A., et al. (1991) Sequences of Proteins of Immunological Interest, Fifth Edition, U.S. Department of Health and Human Services, NIH Publication No. 91-3242) and DNA fragments encompassing these regions can be obtained by standard PCR amplification. The light chain constant region can be a kappa or lambda constant region, but most preferably is a kappa constant region.

To create a scFv gene, the VH- and VL-encoding DNA fragments are operatively linked to another fragment encoding a flexible linker, e.g., encoding the amino acid sequence (Gly-Gly-Gly-Gly-Ser)3, such that the VH and VL sequences can be expressed as a contiguous single-chain protein, with the VL and VH regions joined by the flexible linker (see e.g., Bird et al. (1988) Science 242:423-426; Huston et al. (1988) Proc. Natl. Acad. Sci. USA 85:5879-5883; McCafferty et al., (1990) Nature 348:552-554).

In one aspect, the present disclosure provides methods for treatment or prevention of cancer comprising administering nucleic acid molecules, wherein the nucleic acid molecules encode for a VH, VL, CDR3 region of VH or CDR 3 region of VL or antigen-binding fragment thereof, wherein the nucleic acid molecule comprises a sequence disclosed herein (e.g. Table 2) by way of gene therapy. Gene therapy refers to therapy performed by the administration to a subject of an expressed or expressible nucleic acid. In this embodiment of the invention, the nucleic acids produce their encoded protein that mediates a prophylactic or therapeutic effect. Any of the methods for gene therapy available in the art can be used according to the embodiments herein.

For general reviews of the methods of gene therapy, see Goldspiel et al., 1993, Clinical Pharmacy 12:488-505; Wu and Wu, 1991, Biotherapy 3:87-95; Tolstoshev, 1993, Ann. Rev. Pharmacol. Toxicol. 32:573-596; Mulligan, 1993, Science 260:926-932; and Morgan and Anderson, 1993, Ann. Rev. Biochem. 62:191-217; May, 1993, TIBTECH 11(5): 155-215. Methods. commonly known in the art of recombinant DNA technology which can be used are described in Ausubel et al. (eds.), 1993, Current Protocols in Molecular Biology, John Wiley & Sons, NY; and Kriegler, 1990, Gene Transfer and Expression, A Laboratory Manual, Stockton Press, NY. Delivery of a therapeutic antibody to appropriate cells can be effected via gene therapy ex vivo, in situ, or in vivo by use of any suitable approach known in the art, including by use of physical DNA transfer methods (e.g., liposomes or chemical treatments) or by use of viral vectors (e.g., adenovirus, adeno-associated virus, or a retrovirus). For example, for in vivo therapy, a nucleic acid encoding the desired antibody, either alone or in conjunction with a vector, liposome, or precipitate may be injected directly into the subject, and in some embodiments, may be injected at the site where the expression of the antibody compound is desired. For ex vivo treatment, the subject's cells are removed, the nucleic acid is introduced into these cells, and the modified cells are returned to the subject either directly or, for example, encapsulated within porous membranes which are implanted into the patient. See, e.g. U.S. Pat. Nos. 4,892,538 and 5,283,187. There are a variety of techniques available for introducing nucleic acids into viable cells. The techniques vary depending upon whether the nucleic acid is transferred into cultured cells in vitro, or in vivo in the cells of the intended host. Techniques suitable for the transfer of nucleic acid into mammalian cells in vitro include the use of liposomes, electroporation, microinjection, cell fusion, DEAE-dextran, and calcium phosphate precipitation. A commonly used vector for ex vivo delivery of a nucleic acid is a retrovirus.

The term "host cell" as used herein refers to the particular subject cell transfected with a nucleic acid molecule and the progeny or potential progeny of such a cell. Progeny of such a cell may not be identical to the parent cell transfected with the nucleic acid molecule due to mutations or environmental influences that may occur in succeeding generations or integration of the nucleic acid molecule into the host cell genome.

Other in vivo nucleic acid transfer techniques include transfection with viral vectors (such as adenovirus, Herpes simplex I virus, or adeno-associated virus) and lipid-based systems. The nucleic acid and transfection agent are optionally associated with a microparticle. Exemplary transfection agents include calcium phosphate or calcium chloride co-precipitation, DEAE-dextran-mediated transfection, quaternary ammonium amphiphile DOTMA ((dioleoyloxypropyl) trimethylammonium bromide, commercialized as Lipofectin by GIBCO-BRL))(Felgner et al., (1987) Proc. Natl. Acad. Sci. USA 84, 7413-7417; Malone et al. (1989) Proc. Natl Acad. Sci. USA 86 6077-6081); lipophilic glutamate diesters with pendent trimethylammonium heads (Ito et al. (1990) Biochem. Biophys. Acta 1023, 124-132); the metabolizable parent lipids such as the cationic lipid dioctadecylamido glycylspermine (DOGS, Transfectam, Promega) and dipalmitoylphosphatidyl ethanolamylspermine (DPPES) (J. P. Behr (1986) Tetrahedron Lett. 27, 5861-5864; J. P. Behr et al. (1989) Proc. Natl. Acad. Sci. USA 86, 6982-6986); metabolizable quaternary ammonium salts (DOTB, N-(1-[2,3-dioleoyloxylpropyl)-N,N,N-trimethylammonium methylsulfate (DOTAP) (Boehringer Mannheim), polyethyleneimine (PEI), dioleoyl esters, ChoTB, ChoSC, DOSC) (Leventis et al. (1990) Biochim. Inter. 22, 235-241); 3beta[N—(N',N'-dimethylaminoethane)-carbamoyl]cholesterol (DC-Chol), dioleoylphosphatidyl ethanolamine (DOPE)/3beta[N—(N',Ndimethylaminoethane)-carbamoyl] cholesterolDC-Chol in one to one mixtures (Gao et al., (1991) Biochim. Biophys. Acta 1065, 8-14), spermine, spermidine, lipopolyamines (Behr et al., Bioconjugate Chem, 1994, 5: 382-389), lipophilic polylysines (LPLL) (Zhou et al., (1991) Biochim. Biophys. Acta 939, 8-18), [[(1,1,3,3 tetramethylbutyl)cresoxy]ethoxy]ethyl]dimethylbnzylammonium hydroxide (DEBDA hydroxide) with excess phosphatidylcholine/cholesterol (Ballas et al., (1988) Biochim. Biophys. Acta 939, 8-18), cetyltrimethylammonium bromide (CTAB)/DOPE mixtures (Pinnaduwage et al., (1989) Biochim. Biophys. Acta 985, 33-37), lipophilic diester of glutamic acid (TMAG) with DOPE, CTAB, DEBDA, didodecylammonium bromide (DDAB), and stearylamine in admixture with phosphatidylethanolamine (Rose et al. (1991) Biotechnique 10, 520-525), DDAB/DOPE (TransfectACE, GIBCO BRL), and oligogalactose bearing lipids. Exemplary transfection enhancer agents that increase the efficiency of transfer include, for example, DEAE-dextran, polybrene, lysosome-disruptive peptide (Ohmori N I et al., Biochem Biophys Res Commun Jun. 27, 1997; 235(3):726-9), chondroitan-based proteoglycans, sulfated proteoglycans, polyethylenimine, polylysine (Pollard H et al. J Biol Chem, 1998 273 (13):7507-11), integrin-binding peptide CYGGRGDTP, linear dextran nonasaccharide, glycerol, cholesteryl groups tethered at the 3'-terminal internucleoside link of an oligonucleotide (Letsinger, R. L. 1989 Proc Natl Acad Sci USA 86: (17):6553-6), lysophosphatide, lysophosphatidylcholine, lysophosphatidylethanolamine, and 1-oleoyl lysophosphatidylcholine.

In some situations it may be desirable to deliver the nucleic acid with an agent that directs the nucleic acid containing vector to target cells. Such "targeting" molecules include antibodies specific for a cell-surface membrane protein on the target cell, or a ligand for a receptor on the target cell. Where liposomes are employed, proteins which bind to a cell-surface membrane protein associated with endocytosis may be used for targeting and/or to facilitate uptake. Examples of such proteins include capsid proteins and fragments thereof tropic for a particular cell type, antibodies for proteins which undergo internalization in cycling, and proteins that target intracellular localization and enhance intracellular half-life. In other embodiments, receptor-mediated endocytosis can be used. Such methods are described, for example, in Wu et al., 1987 or Wagner et al., 1990. For review of the currently known gene marking and gene therapy protocols, see Anderson 1992. See also WO 93/25673 and the references cited therein.

Screening Methods for Identification of Target Antigens Binding Affinity

Antibodies may be screened for binding affinity by methods known in the art. For example, gel-shift assays, Western blots, radiolabeled competition assay, co-fractionation by chromatography, co-precipitation, cross linking, ELISA, and the like may be used, which are described in, for example, Current Protocols in Molecular Biology (1999) John Wiley & Sons, NY, which is incorporated herein by reference in its entirety.

To initially screen for antibodies which bind to the desired epitope on an antigen (e.g., a cancer associated antigen), a routine cross-blocking assay such as that described in Antibodies, A Laboratory Manual, Cold Spring Harbor Laboratory, Ed Harlow and David Lane (1988), can be performed. Routine competitive binding assays may also be used, in which the unknown antibody is characterized by its ability to inhibit binding of antigen to an antigen specific antibody of the invention. Intact antigen, fragments thereof, or linear epitopes can be used. Epitope mapping is described in Champe et al., J. Biol. Chem. 270: 1388-1394 (1995).

The antibodies or antigen-binding fragment thereof, described herein, may also be useful in preventing or treating cancer. The effectiveness of a candidate antibody or antigen-binding fragment thereof in preventing or treating cancer metastasis may be screened using a human amniotic basement membrane invasion model as described in Filderman et al., Cancer Res 52: 36616, 1992. In addition, any of the animal model systems for metastasis of various types of cancers may also be used. Such model systems include, but are not limited to, those described in Wenger et al., Clin. Exp. Metastasis 19: 169 73, 2002; Yi et al., Cancer Res. 62: 917 23, 2002; Tsutsumi et al., Cancer Lett., 169: 77-85, 2001; Tsingotjidou et al., Anticancer Res. 21: 971 8, 2001; Wakabayashi et al., Oncology 59: 75 80, 2000; Culp and Kogerman, Front Biosci. 3:D672 83, 1998; Runge et al., Invest Radiol. 32: 212 7; Shioda et al., J. Surg. Oneal. 64: 122 6, 1997; Ma et al., Invest Ophthalmol Vis Sci. 37: 2293 301, 1996; Kuruppu et al., J Gastroenterol Hepatol. 11: 26 32, 1996. In the presence of an effective antibody, cancer metastases may be prevented, or inhibited to result in fewer and/or smaller metastases.

The anti-tumor activity of a particular antibody, or combination of antibodies, or fragment thereof may be evaluated in vivo using a suitable animal model. For example, xenogenic lymphoma cancer models wherein human lymphoma cells are introduced into immune com-promised animals, such as nude or SCID mice. Efficacy may be predicted using assays which measure inhibition of tumor formation, tumor regression or metastasis, and the like.

In one variation of an in vitro assay, the present disclosure provides a method comprising the steps of (a) contacting an immobilized antigen with a candidate antibody and (b) detecting binding of the candidate antibody to the antigen. In an alternative embodiment, the candidate antibody is immobilized and binding of antigen is detected. Immobilization is accomplished using any of the methods well known in the art, including covalent bonding to a support, a bead, or a chromatographic resin, as well as non-covalent, high affinity interaction such as antibody binding, or use of streptavidin/biotin binding wherein the immobilized compound includes a biotin moiety. Detection of binding can be accomplished (i) using a radioactive label on the compound that is not immobilized, (ii) using a fluorescent label on the non-immobilized compound, (iii) using an antibody immunospecific for the non-immobilized compound, (iv) using a label on the non-immobilized compound that excites a fluorescent support to which the immobilized compound is attached, as well as other techniques well known and routinely practiced in the art.

Modulator Activity

Antibodies that modulate (i.e., increase, decrease, or block) the activity or expression of desired target may be identified by incubating a putative modulator with a cell expressing the desired target and determining the effect of the putative modulator on the activity or expression of the target. The selectivity of an antibody that modulates the activity of a target polypeptide or polynucleotide can be evaluated by comparing its effects on the target polypeptide or polynucleotide to its effect on other related compounds. Selective modulators may include, for example, antibodies and other proteins, peptides, or organic molecules which specifically bind to target polypeptides or to a nucleic acid encoding a target polypeptide. Modulators of target activity will be therapeutically useful in treatment of diseases and physiological conditions in which normal or aberrant activity of target polypeptide is involved. The target can be a for example, but not limited to a cancer associated antigen.

The invention also comprehends high throughput screening (HTS) assays to identify antibodies that interact with or inhibit biological activity (i.e., inhibit enzymatic activity, binding activity, etc.) of an antigen. HTS assays permit screening of large numbers of compounds in an efficient manner. Cell-based HTS systems are contemplated to investigate the interaction between antibodies and their target antigen and their binding partners. FITS assays are designed to identify "hits" or "lead compounds" having the desired property, from which modifications can be designed to improve the desired property. Chemical modification of the "hit" or "lead compound" is often based on an identifiable structure/activity relationship between the "hit" and target antigen.

Another aspect of the present invention is directed to methods of identifying antibodies which modulate (i.e., decrease) activity of a target antigen comprising contacting a target antigen with an antibody, and determining whether the antibody modifies activity of the antigen. The activity in the presence of the test antibody is compared to the activity in the absence of the test antibody. Where the activity of the sample containing the test antibody is lower than the activity in the sample lacking the test antibody, the antibody will have inhibited activity.

A variety of heterologous systems is available for functional expression of recombinant polypeptides that are well known to those skilled in the art. Such systems include bacteria (Strosberg, et al., Trends in Pharmacological Sciences (1992) 13:95-98), yeast (Pausch, Trends in Biotechnology (1997) 15:487-494), several kinds of insect cells (Vanden Broeck, Int. Rev. Cytology (1996) 164:189-268), amphibian cells (Jayawickreme et al., Current Opinion in Biotechnology (1997) 8: 629-634) and several mammalian cell lines (CHO, HEK293, COS, etc.; see Gerhardt, et al., Eur. J. Pharmacology (1997) 334:1-23). These examples do not preclude the use of other possible cell expression systems, including cell lines obtained from nematodes (see, PCT application WO 98/37177).

In one embodiment of the invention, methods of screening for antibodies which modulate the activity of target antigen comprise contacting antibodies with a target antigen polypeptide and assaying for the presence of a complex between the antibody and the target antigen. In such assays, the ligand is typically labeled. After suitable incubation, free ligand is separated from that present in bound form, and the amount of free or uncomplexed label is a measure of the ability of the particular antibody to bind to the target antigen.

High Throughput Screening

The present disclosure encompasses the use of HTS to identify and characterize target antigens. A HTS can be protein arrays (e.g., antibody arrays, antibody microarrays, protein microarray). The array can comprise one or more antibodies or antigen-binding fragment thereof, disclosed herein, immobilized on a solid support. Methods of production and use of such arrays are known well known in art (e.g., (Buessow et al., Nucleic Acids Res. 1998, Lueking et al., Mol Cell Proteomics., 2003; Angenendt et al., Mol Cell Proteomics., 2006) In some embodiments, very small amounts (e.g., 1 to 500m) of antibody or antigen-binding fragment thereof is immobilized. In some embodiments, there will be from 1 µg to 100 µg, from 1 µg to 50 µg, from 1 µg to 20 µg, from 3 µg to 100 µg, from 3 µg to 50 µg, from 3 µg to 20, from 5 µg to 100 µg, from 5 µg to 50 µg, from 5 µg to 20 µg of antibody present in a single sample. In one aspect, at least one of the samples in a plurality of samples will have from 1 µg to 100 µg, from 1 µg to 50 µg, from 1 µg to 20 µg, from 3 µg to 100 µg, from 3 µg to 50 µg, from 3 µg to 20, from 5 µg to 100 µg, from 5 µg to 50 µg, from 5 µg to 20 µg of antibody present. A solid support refers to an insoluble, functionalized material to which the antibodies can be reversibly attached, either directly or indirectly, allowing them to be separated from unwanted materials, for example, excess reagents, contaminants, and solvents. Examples of solid supports include, for example, functionalized polymeric materials, e.g., agarose, or its bead form Sepharose®, dextran, polystyrene and polypropylene, or mixtures thereof; compact discs comprising microfluidic channel structures; protein array chips; pipet tips; membranes, e.g., nitrocellulose or PVDF membranes; and microparticles, e.g., paramagnetic or non-paramagnetic beads. In some embodiments, an affinity medium will be bound to the solid support and the antibody will be indirectly attached to solid support via the affinity medium. In one aspect, the solid support comprises a protein A affinity medium or protein G affinity medium. A "protein A affinity medium" and a "protein G affinity medium" each refer to a solid phase onto which is bound a natural or synthetic protein comprising an Fc-binding domain of protein A or protein G, respectively, or a mutated variant or fragment of an Fc-binding domain of protein A or protein G, respectively, which variant or fragment retains the affinity for an Fc-portion of an antibody. Antibody arrays can be fabricated by the transfer of antibodies onto the solid surface in an organized high-density format followed by chemical immobilization. Representative techniques for fabrication of an array include photolithography, ink jet and contact printing, liquid dispensing and piezoelectrics. The patterns and dimensions of antibody arrays are to be determined by each specific application. The sizes of each antibody spot may be easily controlled by the users. Antibodies may be attached to various kinds of surfaces via diffusion, adsorption/absorption, or covalent cross-linking and affinity. Antibodies may be directly spotted onto a plain glass surface. To keep antibodies in a wet environment during the printing process, high percent glycerol (e.g., 30-40%) may be used in sample buffer and the spotting is carried out in a humidity-controlled environment.

Antibody Arrays

The surface of a substrate may be modified to achieve better binding capacity. For example, the glass surface may be coated with a thin nitrocellulose membrane or poly-L-lysine such that antibodies can be passively adsorbed to the modified surface through non-specific interactions. Antibodies may be immobilized onto a support surface either by chemical ligation through a covalent bond or non-covalent binding. There are many known methods for covalently immobilizing antibodies onto a solid support. For example, MacBeath et al., (1999) J. Am. Chem. Soc. 121:7967-7968) use the Michael addition to link thiol-containing compounds to maleimide-derivatized glass slides to form a microarray of small molecules. See also, Lam & Renil (2002) Current Opin. Chemical Biol. 6:353-358. Depending upon, if the potential antigen is associated with a specific type of cancer, an antibody specific to a further biomarker may be included in the antibody array. Representative examples of biomarkers include, TROP/TNFRSF19, IL-1 sRI, uPAR, IL-10, VCAM-1 (CD106), IL-10 receptor-β, VE-cadherin, IL-13 receptor-α1, VEGF, IL-13 receptor-α2, VEGF R2 (KDR), IL-17, VEGF R3

The arrays can employ single-antibody (label-base) detection or 2-antibody (sandwich-based) detection. In some embodiments, an ELISA (also known as an antibody sandwich assay) may be performed following standard techniques as follows. Antibodies used as the capture antibodies for an antigen disposed on (e.g., coated onto) a solid support, which may then be washed at least once (e.g., with water and/or a buffer such as PBS-t), followed by a standard blocking buffer, and then at least one more wash. The solid support may then be brought into contact with the sample/biosample under conditions to allow antibody-antigen complexes to form (e.g., incubating from 1 hour to about 24 hours at a temperature from about 4° C. to about room temperature). As used herein, "biosample" and "sample" are used interchangeably and embrace both fluids (also referred to herein as fluid samples and biofluids) and tissue obtained from the subject. The term "biofluid" as used herein refers to a biological fluid sample such as blood samples, cerebral spinal fluid (CSF), urine and other liquids obtained from the subject, or a solubilized preparation of such fluids wherein the cell components have been lysed to release intra-cellular contents into a buffer or other liquid medium. The definition also includes samples that have been manipulated in any way after their procurement, such as by treatment with reagents, or enrichment for certain components, such as proteins or polynucleotides. The term "blood sample" embraces whole blood, plasma, and serum. Solid tissue samples include biopsy specimens and tissue cultures or cells derived therefrom, and the progeny thereof. A sample may comprise a single cell or more than a single cell. The biosample may also be a cultured population of cells derived from the subject human or animal. However, whenever the biosample comprises a population of cells, the method will first require that the constituents of the cells be solubilized by lysing the cells, and removing solid cell debris, thereby providing a solution of the biomarkers. Samples can be prepared by methods known in the art such as lysing, fractionation, purification, including affinity purification, FACS, laser capture micro-dissection or iospycnic centrifugation. The support may then be washed at least once (e.g., with a buffer such as PBS-t). To detect the complexation between the capture antibodies and the antigen that may be present in the sample, secondary or "detection" antibodies are applied to the solid support (e.g., diluted in blocking buffer) under conditions to allow complexation between the secondary antibodies and the respective biomarkers (e.g., at room temperature for at least one hour). The secondary antibodies are selected so as to bind a different epitope on the antigen than the capture antibody. The optimum concentrations of capture and detection antibodies are determined using standard techniques such as the "criss-cross" method of dilutions. The detection antibody may be conjugated, directly or indirectly, to a detectable label.

The term "detectable label" as used herein refers to labeling moieties known in the art. Said moiety may be, for example, a radiolabel (e.g., 3H, 125I, 35S, 14C, 32P, etc.), detectable enzyme (e.g., horse radish peroxidase (HRP), alkaline phosphatase etc.), a dye (e.g., a fluorescent dye), a colorimetric label such as colloidal gold or colored glass or plastic (e.g., polystyrene, polypropylene, latex, etc.), beads, or any other moiety capable of generating a detectable signal such as a colorimetric, fluorescent, chemiluminescent or electrochemiluminescent (ECL) signal. The term "dye" as used herein refers to any reporter group whose presence can be detected by its light absorbing or light emitting properties. For example, Cy5 is a reactive water-soluble fluorescent dye of the cyanine dye family. Cy5 is fluorescent in the red region (about 650 to about 670 nm). It may be synthesized with reactive groups on either one or both of the nitrogen side chains so that they can be chemically linked to either nucleic acids or protein molecules. Labeling is done for visualization and quantification purposes. Cy5 is excited maximally at about 649 nm and emits maximally at about 670 nm, in the far red part of the spectrum; quantum yield is 0.28 (FW=792). Suitable fluorophores (chromes) for the probes of the disclosure may be selected from, but not intended to be limited to, fluorescein isothiocyanate (FITC, green), cyanine dyes Cy2, Cy3, Cy3.5, Cy5, Cy5.5 Cy7, Cy7.5 (ranging from green to near-infrared), Texas Red, and the like. Derivatives of these dyes for use in the embodiments of the disclosure may be, but are not limited to, Cy dyes (Amersham Bioscience), Alexa Fluors (Molecular Probes Inc.), HILYTE™ Fluors (AnaSpec), and DYLITE™ Fluors (Pierce, Inc). In some embodiments, the detectable label is a chromogenic label such as biotin, in which case the detection antibody-biotin conjugate is detected using Streptavidin/Horseradish Peroxidase (HRP) or the equivalent. The streptavidin may be diluted in an appropriate block and incubated for 30 minutes at room temperature. Other detectable labels suitable for use in the present invention include fluorescent labels and chemiluminescent labels.

The support may then be washed and the label (e.g., HRP enzymatic conjugate on the streptavidin) is detected using the following standard protocols such as a chromogenic system (the SIGMA FAST™ OPD system), a fluorescent system or a chemiluminescent system. The amounts of antigen present in the sample may then be read on an ELISA plate reader (e.g., SpectraMax 384 or the equivalent). The concentration of each of the antigens may then be back-calculated (e.g., by using the standard curve generated from purified antigens and multiplied by the dilution factor following standard curve fitting methods), and then compared to a control (generated from tissue samples obtained from healthy subjects).

In one embodiment, a biosample, e.g., a biofluid, is contacted with a system of reagents, well-known in the art, that can attach biotin moieties to some or all of the constituent components of the sample, and especially to the protein or peptide constituents thereof, including the biomarkers. Following this biotinylation step, the biotinylated biosample may then be contacted with the antibody array that contains an array of antibodies specific to each of the antigens.

After an adequate incubation period, readily selected to allow the binding of any antigen in the sample to its corresponding antibody of the array, the fluid sample is washed from the array. The array is then contacted with a biotin-binding polypeptide such as avidin or streptavidin, that has been conjugated with a detectable label (as described above in connection with the ELISA). Detection of the label on the array (relative to a control) will indicate which of the biomarkers captured by the respective antibody is present in the sample.

Regardless of the specific assay format, the biotin-label-based array methods are relatively advantageous from several standpoints. Biotin-label can be used as signal amplification. Biotin is the most common method for labeling protein and the label process can be highly efficient. Furthermore, biotin can be detected using fluorescence-streptavidin and, therefore, visualized via laser scanner, or HRP-streptavidin using chemiluminescence. Using biotin-label-based antibody arrays, most targeted proteins can be detected at pg/ml levels. The detection sensitivity of the present methods can be further enhanced by using 3-DNA detection technology or rolling circle amplification (Schweitzer et al., (2000) Proc. Natl. Acad. Sci. U.S.A. 97:10113-10119; Horie et al., (1996) Int. J. Hematol. 63:303-309).

As it relates to the present disclosure, the sample can be obtained from a subject having disease (e.g., cancer) and a healthy subject.

Protein Arrays

In some embodiments, protein arrays can be used where protein antigens with known identities are immobilized on a solid support as capture molecules and one seeks to determine whether the known antigens binds to a candidate antibody. The antigen can be labeled with a tag that allows detection or immunoprecipitation after capture by an immobilized antibody. Protein antigens can be obtained, for example, from a cancer patient or a cancer cell. A number of commercial protein arrays are available e.g., PROTOARRAY®, KINEX™, RAYBIO® Human RTK Phosphorylation Antibody Array. The antibody-antigen complexes can be obtained by methods known in the art (e.g., immunoprecipitation or Western blot). For reviews on Protein array and antibody array that can be of interest in this study, see Reymond Sutandy, et al. 2013; Liu, B. C.-S., et al. 2012; Haab B B, 2005.

In an exemplary immunoprecipitation method, an antibody or antigen-binding fragment thereof, described herein is added first to a sample comprising an antigen, and incubated to allow antigen-antibody complexes to form. Subsequently, the antigen-antibody complexes are or with protein A/G-coated beads to allow them to absorb the complexes. In a modified approach, the antibody or antigen-binding fragment thereof is fused to a His tag or other tags (e.g., FLAG tag, Biotin Tag) by recombinant DNA techniques, and immunoprecipitated using an antibody to the tag (pull-down assay). The beads are then thoroughly washed, and the antigen is eluted from the beads by an acidic solution or SDS. The eluted sampled can be analyzed using Mass Spectrometry or SDS page to identify and confirm the antigen. Methods to analyze antibody-antigen complexes formed on a protein microarray and identify the antigen via mass spec are known.

ADCC and CDC Assays

In one aspect, the antibodies or antigen-binding fragment thereof, disclosed herein, are contemplated as therapeutic antibodies for treatment of cancer. Accordingly, the antibodies or antigen-binding fragment thereof, can be further screened in an antibody-dependent cell-mediated cytotoxicity (ADCC) assay and/or Complement-dependent cytotoxicity (CDC) assay. "ADCC activity" refers to the ability of an antibody to elicit an ADCC reaction. ADCC is a cell-mediated reaction in which antigen-nonspecific cytotoxic cells that express FcRs (e.g., natural killer (NK) cells, neutrophils, and macrophages) recognize antibody bound to the surface of a target cell and subsequently cause lysis of (i.e., "kill") the target cell (e.g., cancer cell). The primary mediator cells are natural killer (NK) cells. NK cells express FcγRIII only, with FcγRIIIA being an activating receptor and FcγRIIIB an inhibiting one; monocytes express FcγRI, FcγRII and FcγRIII (Ravetch et al. (1991) Annu. Rev. Immunol., 9:457-92). ADCC activity can be assessed directly using an in vitro assay, e.g., a 51Cr release assay using peripheral blood mononuclear cells (PBMC) and/or NK effector cells as described in the Examples and Shields et al. (2001) J. Biol. Chem., 276:6591-6604, or another suitable method known in the art. ADCC activity may be expressed as a concentration of antibody at which the lysis of target cells is half-maximal. Accordingly, in some embodiments, the concentration of an antibody or antigen-binding fragment thereof of the disclosure, at which the lysis level is the same as the half-maximal lysis level by the wild-type control, is at least 2-, 3-, 5-, 10-, 20-, 50-, 100-fold lower than the concentration of the wild-type control itself Additionally, in some embodiments, the antibody or antigen-binding fragment thereof of the present disclosure may exhibit a higher maximal target cell lysis as compared to the wild-type control. For example, the maximal target cell lysis of an antibody or Fc fusion protein of the invention may be 10%, 15%, 20%, 25% or more higher than that of the wild-type control. "Complement dependent cytotoxicity" or "CDC" refer to the ability of a molecule to lyse a target (e.g. cancer cell) in the presence of complement. The complement activation pathway is initiated by the binding of the first component of the complement system (C1q) to a molecule (e.g. an antibody) complexed with a cognate antigen. To assess complement activation, a CDC assay, e.g. as described in Gazzano-Santoro et al., J. Immunol. Methods 202:163 (1996), may be performed.

Epitope Mapping

The term "epitope," as used herein, refers to an antigenic determinant that interacts with a specific antigen-binding site in the variable region of an antibody molecule known as a paratope. A single antigen may have more than one epitope. Thus, different antibodies may bind to different areas on an antigen and may have different biological effects. Epitopes may be either conformational or linear. A conformational epitope is produced by spatially juxtaposed amino acids from different segments of the linear polypeptide chain. A linear epitope is one produced by adjacent amino acid residues in a polypeptide chain. In certain circumstance, an epitope may include moieties of saccharides, phosphoryl groups, or sulfonyl groups on the antigen.

Various techniques known to persons of ordinary skill in the art can be used to determine whether an antigen-binding domain of an antibody "interacts with one or more amino acids" within a polypeptide or protein. Exemplary techniques include, e.g., routine cross-blocking assay such as that described Antibodies, Harlow and Lane (Cold Spring Harbor Press, Cold Spring Harb., NY), alanine scanning mutational analysis, peptide blots analysis (Reineke, 2004, Methods Mol Biol 248:443-463), and peptide cleavage analysis. In addition, methods such as epitope excision, epitope extraction and chemical modification of antigens can be employed (Tomer, 2000, Protein Science 9:487-496). Another method that can be used to identify the amino acids within a polypeptide with which an antigen-binding domain of an antibody interacts is hydrogen/deuterium exchange detected by mass spectrometry. In general terms, the hydrogen/deuterium exchange method involves deuterium-labeling the protein of interest, followed by binding the antibody to the deuterium-labeled protein. Next, the protein/antibody complex is transferred to water to allow hydrogen-deuterium exchange to occur at all residues except for the residues protected by the antibody (which remain deuterium-labeled). After dissociation of the antibody, the target protein is subjected to protease cleavage and mass spectrometry analysis, thereby revealing the deuterium-labeled residues, which correspond to the specific amino acids with which the antibody interacts. See, e.g., Ehring (1999) Analytical Biochemistry 267(2):252-259; Engen and Smith (2001) Anal. Chem. 73:256A-265A. X-ray crystallography of the antigen/antibody complex may also be used for epitope mapping purposes.

The epitope on an antigen to which the antibody or antigen-binding fragment, disclosed herein, bind may consist of a single contiguous sequence of 3 or more (e.g., 3, 4, 5, 6, 7, 8, 9, 10, 11, 12, 13, 14, 15, 16, 17, 18, 19, 20 or more) amino acids of the antigen. Alternatively, the epitope may consist of a plurality of non-contiguous amino acids (or amino acid sequences) of antigen.

Antigens

In some embodiments, the antibodies or antigen biding fragment thereof, disclosed herein, are directed to a cancer associated antigen. In some embodiments, the cancer associated antigen is a tumor antigen, i.e., a part of a tumor cell such as a protein or peptide expressed in a tumor cell which may be derived from the cytoplasm, the cell surface or the cell nucleus, in particular those which primarily occur intracellularly or as surface antigens of tumor cells. For example, tumor antigens include the carcinoembryonal antigen, α1-fetoprotein, isoferritin, and fetal sulphoglycoprotein, α2-H-ferroprotein and γ-fetoprotein. The term "cancer associated antigen" as used herein can be any type of cancer antigen that may be associated with a cancer as is known in the art and includes antigens found on the cell surface, including tumor cells, as well as soluble cancer antigens. Several cell surface antigens on tumors and normal cells have soluble counterparts. A cancer associated antigen can be a cell surface antigen or a soluble cancer antigen located in the tumor microenvironment or otherwise in close proximity to the tumor being treated. Such antigens include but are not limited to those found on cancer-associated fibroblasts (CAFs), tumor endothelial cells (TEC) and tumor-associated macrophages (TAM). Examples of cancer-associated fibroblasts (CAFs) target antigens include but are not limited to: carbonic anhydrase IX (CAIX); fibroblast activation protein alpha (FAPα); and matrix metalloproteinases (MMPs) including MMP-2 and MMP-9. Examples of Tumor endothelial cell (TECs) target antigens include, but are not limited to vascular endothelial growth factor (VEGF) including VEGFR-1, 2, and 3; CD-105 (endoglin), tumor endothelia markers (TEMs) including TEM1 and TEM8; MMP-2; Survivin; and prostate-specific membrane antigen (PMSA). Examples of tumor associated macrophage antigens include, but are not limited to: CD105; MMP-9; VEGFR-1, 2, 3 and TEM8. In one embodiment, the cancer associated antibody specific for a cancer associated antigen may be specific for cancer antigens located on non-tumor cells, for example, VEGFR-2, MMPs, Survivin, TEM8 and PMSA. The cancer associated antigen may be an epithelial cancer antigen, (e.g., breast, gastrointestinal, lung), a prostate specific cancer antigen (PSA) or prostate specific membrane antigen (PSMA), a bladder cancer antigen, a lung (e.g., small cell lung) cancer antigen, a colon cancer antigen, an ovarian cancer antigen, a brain cancer antigen, a gastric cancer antigen, a renal cell carcinoma antigen, a pancreatic cancer antigen, a liver cancer antigen, an esophageal cancer antigen, or a head and neck cancer antigen. A cancer antigen can also be a lymphoma antigen (e.g., non-Hodgkin's lymphoma or Hodgkin's lymphoma), a B-cell lymphoma cancer antigen, a leukemia antigen, a myeloma (i.e., multiple myeloma or plasma cell myeloma) antigen, an acute lymphoblastic leukemia antigen, a chronic myeloid leukemia antigen, or an acute myelogenous leukemia antigen.

According to the present invention, a cancer associated antigen preferably comprises any antigen which is expressed in and optionally characteristic with respect to type and/or expression level for tumors or cancers as well as for tumor or cancer cells. In one embodiment, the term "tumor antigen" or "tumor-associated antigen" or "cancer antigen" or "cancer associated antigen" relates to proteins that are under normal conditions specifically expressed in a limited number of tissues and/or organs or in specific developmental stages, for example, the cancer associated antigen may be under normal conditions specifically expressed in stomach tissue, preferably in the gastric mucosa, in reproductive organs, e.g., in testis, in trophoblastic tissue, e.g., in placenta, or in germ line cells, and are expressed or aberrantly expressed in one or more tumor or cancer tissues. In this context, "a limited number" preferably means not more than 3, more preferably not more than 2. The cancer associated antigen in the context of the present invention include, for example, differentiation antigens, preferably cell type specific differentiation antigens, i.e., proteins that are under normal conditions specifically expressed in a certain cell type at a certain differentiation stage, cancer/testis antigens, i.e., proteins that are under normal conditions specifically expressed in testis and sometimes in placenta, and germ line specific antigens. Preferably, the cancer associated antigen or the aberrant expression of the cancer associated antigen identifies cancer cells. In the context of the present invention, the cancer associated antigen that is expressed by a cancer cell in a subject, e.g., a patient suffering from a cancer disease, is preferably a self-protein in said subject. In preferred embodiments, the cancer associated antigen in the context of the present invention is expressed under normal conditions specifically in a tissue or organ that is non-essential, i.e., tissues or organs which when damaged by the immune system do not lead to death of the subject, or in organs or structures of the body which are not or only hardly accessible by the immune system. A "cancer associated antigen", as used herein can be any antigenic substance (antigen) produced or overexpressed in tumor cells. It can, for example, trigger an immune response in the host. Alternatively, for purposes of this disclosure, cancer associated antigens can be proteins that are expressed by both healthy and tumor cells, but because they identify a certain tumor type, they can be a suitable therapeutic target. Non-limiting examples of cancer associated antigen include CD19, CD20, CD30, CD33, CD38, Her2/neu, ERBB2, CA125, MUC-1, prostate-specific membrane antigen (PSMA), CD44 surface adhesion molecule, mesothelin, carcinoembryonic antigen (CEA), epidermal growth factor receptor (EGFR), EGFRvIII, vascular endothelial growth factor receptor-2 (VEGFR2), high molecular weight-melanoma associated antigen (HMW-MAA), MAGE-A1, IL-13R-a2, GD2, or any combination thereof.

In some embodiments, the cancer associated antigen is 1p19q, ABL1, AKT1, ALK, APC, AR, ATM, BRAF, BRCA1, BRCA2, cKIT, cMET, CSF1R, CTNNB1, EGFR, EGFRvIII, ER, ERBB2 (HER2), FGFR1, FGFR2, FLT3, GNA11, GNAQ, GNAS, HER2, HRAS, IDH1, IDH2, JAK2, KDR (VEGFR2), KRAS, MGMT, MGMT-Me, MLH1, MPL, NOTCH1, NRAS, PDGFRA, Pgp, PIK3CA, PR, PTEN, RET, RRM1, SMO, SPARC, TLE3, TOP2A, TOPO1, TP53, TS, TUBB3, VHL, CDH1, ERBB4, FBXW7, HNF1A, JAK3, NPM1, PTPN11, RB1, SMAD4, SMARCB1, STK1, MLH1, MSH2, MSH6, PMS2, microsatellite instability (MSI), ROS1, ERCC1, or any combination thereof. According to the invention, the terms "cancer associated antigen" "tumor antigen", "tumor expressed antigen", "cancer antigen" "cancer associated antigen" and "cancer expressed antigen" are equivalents and are used interchangeably herein. In some embodiments, an antibody or antigen binding fragment thereof of the present disclosure binds an antigen provided in the Table 3 and table 4.

Immunotherapy

In one aspect of the present disclosure, the antibodies or antigen-binding fragment thereof, disclosed herein, can initiate a potent immune response against the tumor and/or are capable of direct cytotoxicity. In this regard, the antibodies or antigen-binding fragment thereof herein may elicit tumor cell lysis by either complement-mediated or antibody-dependent cell cytotoxicity (ADCC) mechanisms, both of which require an intact Fc portion of the immunoglobulin molecule for interaction with effector cell Fc receptor sites or complement proteins. In addition, antibodies that exert a direct biological effect on tumor growth are useful in the practice of the disclosure. Potential mechanisms by which such directly cytotoxic antibodies may act include inhibition of cell growth, modulation of cellular differentiation, modulation of tumor angiogenesis factor profiles, and the induction of apoptosis. The mechanism by which a particular antibody or an antigen-binding fragment thereof, disclosed herein, exerts an anti-tumor effect may be evaluated using any number of in vitro assays designed to determine ADCC, ADMMC, complement-mediated cell lysis, and so forth, as is generally known in the art.

Immunoconjugates

The antibodies or antigen-binding fragment thereof, disclosed herein, may be administered in their "naked" or unconjugated form, or may have therapeutic agents conjugated to them. In one embodiment, antibodies or antigen-binding fragment thereof are used as a radiosensitizer. In such embodiments, the antibodies or antigen-binding fragment are conjugated to a radiosensitizing agent. The term "radiosensitizer," as used herein, is defined as a molecule, preferably a low molecular weight molecule, administered to animals in therapeutically effective amounts to increase the sensitivity of the cells to be radiosensitized to electromagnetic radiation and/or to promote the treatment of diseases that are treatable with electromagnetic radiation. Diseases that are treatable with electromagnetic radiation include neoplastic diseases, benign and malignant tumors, and cancerous cells.

Conjugation with Radiosensitizing Agents

The terms "electromagnetic radiation" and "radiation" as used herein include, but are not limited to, radiation having the wavelength of 10-20 to 100 meters. Preferred embodiments of the present disclosure can employ for example, the electro-magnetic radiation of: gamma-radiation c10-20 to 10-13 m), X-ray radiation (10-12 to 10-9 m), ultraviolet light (10 nm to 400 nm), visible light (400 nm to 700 nm), infrared radiation (700 nm to 1.0 mm), and microwave radiation (1 mm to 30 cm).

Radiosensitizers are known to increase the sensitivity of cancerous cells to the toxic effects of electromagnetic radiation. Many cancer treatment protocols currently employ radiosensitizers activated by the electromagnetic radiation of X-rays. Examples of X-ray activated radiosensitizers include, but are not limited to, the following: metronidazole, misonidazole, desmethylmisonidazole, pimonidazole, etanidazole, nimorazole, mitomycin C, RSU 1069, SR 4233, E09, RB 6145, nicotinamide, 5-bromode-oxyuridine (BUdR), 5-iododeoxyuridine (IUdR), bromode-oxycytidine, fluorodeoxyuridine (FUdR), hydroxyurea, cisplatin, and therapeutically effective analogs and derivatives of the same.

Photodynamic therapy (PDT) of cancers employs visible light as the radiation activator of the sensitizing agent. Examples of photodynamic radiosensitizers include the following, but are not limited to: hematoporphyrin derivatives, PHOTOFRIN®, benzoporphyrin derivatives, NPe6, tin etioporphyrin (SnET2), pheoborbide-a, bacteriochlorophyll-a, naphthalocyanines, phthalocyanines, zinc phthalocyanine, and therapeutically effective analogs and derivatives of the same.

In another embodiment, the antibody may be conjugated to a receptor (such streptavidin) for utilization in tumor pretargeting wherein the antibody-receptor conjugate is administered to the patient, followed by removal of unbound conjugate from the circulation using a clearing agent and then administration of a ligand (e.g., avidin) which is conjugated to a cytotoxic agent (e.g., a radionuclide).

Conjugation with Detectable Labels

The present disclosure further provides the above-described antibodies or antigen-binding thereof in detectably labeled form. Antibodies can be detectably labeled through the use of radioisotopes, affinity labels (such as biotin, avidin, etc.), enzymatic labels (such as horseradish peroxidase, alkaline phosphatase, etc.) fluorescent or luminescent or bioluminescent labels (such as FITC or rhodamine, etc.), paramagnetic atoms, and the like. Procedures for accomplishing such labeling are well known in the art; for example, see (Sternberger, L. A. et al., J. Histochem. Cytochem. 18:315 (1970); Bayer, E. A. et al., Meth. Enzym. 62:308 (1979); Engval, E. et al., Immunol. 109:129 (1972); Goding, J. W. J. Immunol. Meth. 13:215 (1976)).

"Label" refers to a detectable compound or composition which is conjugated directly or indirectly to the antibody. The label may itself be detectable by itself (e.g., radioisotope labels or fluorescent labels) or, in the case of an enzymatic label, may catalyze chemical alteration of a substrate compound or composition which is detectable. Alternatively, the label may not be detectable on its own but may be an element that is bound by another agent that is detectable (e.g., an epitope tag or one of a binding partner pair such as biotin-avidin, etc.). Thus, the antibody may comprise a label or tag that facilitates its isolation, and methods of the invention to identify antibodies include a step of isolating the antigen/antibody through interaction with the label or tag.

Exemplary therapeutic immunoconjugates comprise the antibody described herein conjugated to a cytotoxic agent such as a chemotherapeutic agent, toxin (e.g., an enzymatically active toxin of bacterial, fungal, plant or animal origin, or fragments thereof), or a radioactive isotope (i.e., a radioconjugate). Fusion proteins are described in further detail below.

In some embodiments, antibodies and antigen-binding fragments thereof disclosed herein can be conjugated to a therapeutic agent such as a chemotherapeutic cytotoxin, such as a cytostatic or cytocidal agent (e.g., paclitaxol, cytochalasin B or diphtheria toxin, taxol, cytochalasin B, gramicidin D, ethidium bromide, emetine, mitomycin, etoposide, tenoposide, vincristine, vinblastine, colchicin, doxorubicin, daunorubicin, dihydroxy anthracindione, mitoxantrone, mithramycin, actinomycin D, 1-dehydrotestosterone, glucocorticoids, procaine, tetracaine, lidocaine, propranolol, and puromycin and analogs or homologs thereof), antimetabolites (e.g., methotrexate, 6-mercaptopurine, 6-thioguanine, cytarabine, fludarabin, 5-fluorouracil decarbazine), alkylating agents (e.g., mechlorethamine, thioepa chlorambucil, melphalan, carmustine (BSNU) and lomustine (CCNU), cyclophosphamide, busulfan, dibromomannitol, streptozotocin, mitomycin C, and cis-dichlorodiamine platinum (II) (DDP) cisplatin), anthracyclines (e.g., daunorubicin (formerly daunomycin) and doxorubicin), antibiotics (e.g., dactinomycin (formerly actinomycin), bleomycin, mithramycin, and anthramycin (AMC), and anti-mitotic agents, a thrombotic or anti-angiogenic agent or a radioactive label. Examples of suitable cytotoxic agents and chemotherapeutic agents for forming immunoconjugates are known in the art; see, for example, WO 05/103081. In another embodiment, antibodies and antigen-binding fragments thereof disclosed herein are conjugated to a detectable substrate such as, e.g., an enzyme, fluorescent marker, chemiluminescent marker, bioluminescent material, or radioactive material. In some embodiments of the aspects described herein, the antibody and antibody fragments thereof disclosed herein are conjugated to a toxin (e.g., an enzymatically active toxin of bacterial, fungal, plant or animal origin, or fragments thereof), a small molecule, an siRNA, a nanoparticle, a targeting agent (e.g., a microbubble), or a radioactive isotope (i.e., a radioconjugate). Such conjugates are referred to herein as "immunoconjugates". Such immunoconjugates can be used, for example, in diagnostic, theranostic, or targeting methods.

Enzymatically active toxins and fragments thereof which can be used include diphtheria A chain, nonbinding active fragments of diphtheria toxin, exotoxin A chain (from *Pseudomonas aeruginosa*), ricin A chain, abrin A chain, modeccin A chain, alpha-sarcin, *Aleurites fordii* proteins, dianthin proteins, *Phytolacca americana* proteins (PAPI, PAPII, and PAP-S), *Momordica charantia* inhibitor, curcin, crotin, *Sapaonaria officinalis* inhibitor, gelonin, mitogellin, restrictocin, phenomycin, enomycin and the tricothecenes. A variety of radioisotopes are available for the production of radioconjugate antibodies. Examples include, but are not limited to, 212 Bi, 131 I, 131 In, 90Y and 186Re.

Conjugates of the antibodies or antigen-binding fragments thereof described herein and a cytotoxic agent can be made using any of a variety of bifunctional protein coupling agents such as N-succinimidyl-3-(2-pyridyldithiol) propionate (SPDP), iminothiolane (IT), bifunctional derivatives of imidoesters (such as dimethyl adipimidate HCL), active esters (such as disuccinimidyl suberate), aldehydes (such as glutareldehyde), bis-azido compounds (such as bis (p-azidobenzoyl) hexanediamine), bis-diazonium derivatives (such as bis-(p-diazoniumbenzoyl)-ethylenediamine), diisocyanates (such as tolyene 2,6-diisocyanate), and bis-active fluorine compounds (such as 1,5-difluoro-2,4-dinitrobenzene). For example, a ricin immunotoxin can be prepared as described in Vitetta et al., 238 Science 1098 (1987). Carbon-14-labeled 1-isothiocyanatobenzyl-3-methyldiethylene triaminepentaacetic acid (MX-DTPA) is an exemplary chelating agent for conjugation of radionucleotide to the antibody. See WO 94/11026.

In other embodiments, the antibody or portion thereof can be conjugated to a "receptor" (e.g., streptavidin) for utilization in tumor pretargeting wherein the antibody-receptor conjugate is administered to the subject, followed by removal of unbound conjugate from the circulation using a clearing agent and then administration of a "ligand" (e.g., avidin) which is conjugated to a cytotoxic agent (e.g., a radionucleotide). In some embodiments, the antibody or antibody fragment thereof can be conjugated to biotin, and the biotin conjugated antibody or antibody fragment thereof can be further conjugated or linked to a streptavidin-bound or -coated agent, such as a streptavidin-coated microbubble, for use in, for example, molecular imaging of angiogenesis.

Immunoconjugate Production Techniques

Techniques for conjugating such therapeutic moiety to antibodies are well known, see, e.g., Amon et al., "Monoclonal Antibodies For Immunotargeting Of Drugs In Cancer Therapy", in Monoclonal Antibodies And Cancer Therapy, Reisfeld et al. (eds.), pp. 243-56 (Alan R. Liss, Inc. 1985); Hellstrom et al., "Antibodies For Drug Delivery", in Controlled Drug Delivery (2nd Ed.), Robinson et al. (eds.), pp. 623-53 (Marcel Dekker, Inc. 1987); Thorpe, "Antibody Carriers Of Cytotoxic Agents In Cancer Therapy: A Review", in Monoclonal Antibodies '84: Biological And Clinical Applications, Pinchera et al. (eds.), pp. 475-506 (1985); "Analysis, Results, And Future Prospective Of The Therapeutic Use Of Radiolabeled Antibody In Cancer Therapy", in Monoclonal Antibodies For Cancer Detection And Therapy, Baldwin et al. (eds.), pp. 303-16 (Academic Press 1985), and Thorpe et al., "The Preparation And Cytotoxic Properties Of Antibody-Toxin Conjugates", Immunol. Rev., 62: 119-58 (1982).

Production of immunoconjugates is described in, for example, U.S. Pat. No. 6,306,393. Immunoconjugates can be prepared by indirectly conjugating a therapeutic agent to an antibody component. General techniques are described in Shih et al., Int. J. Cancer 41:832-839 (1988); Shih et al., Int. J. Cancer 46:1101-1106 (1990); and Shih et al., U.S. Pat. No. 5,057,313. The general method involves reacting an antibody component having an oxidized carbohydrate portion with a carrier polymer that has at least one free amine function and that is loaded with a plurality of drug, toxin, chelator, boron addends, or other therapeutic agent. This reaction results in an initial Schiff base (imine) linkage, which can be stabilized by reduction to a secondary amine to form the final conjugate.

The carrier polymer is preferably an aminodextran or polypeptide of at least 50 amino acid residues, although other substantially equivalent polymer carriers can also be used. Preferably, the final immunoconjugate is soluble in an aqueous solution, such as mammalian serum, for ease of administration and effective targeting for use in therapy. Thus, solubilizing functions on the carrier polymer will enhance the serum solubility of the final immunoconjugate. In particular, an aminodextran will be preferred.

The process for preparing an immunoconjugate with an aminodextran carrier typically begins with a dextran polymer, advantageously a dextran of average molecular weight of about 10,000-100,000. The dextran is reacted with an oxidizing agent to affect a controlled oxidation of a portion of its carbohydrate rings to generate aldehyde groups. The oxidation is conveniently affected with glycolytic chemical reagents such as NaIO4, according to conventional procedures.

The oxidized dextran is then reacted with a polyamine, preferably a diamine, and more preferably, a mono- or polyhydroxy diamine. Suitable amines include ethylene diamine, propylene diamine, or other like polymethylene diamines, diethylene triamine or like polyamines, 1,3-diamino-2-hydroxypropane, or other like hydroxylated diamines or polyamines, and the like. An excess of the amine relative to the aldehyde groups of the dextran is used to ensure substantially complete conversion of the aldehyde functions to Schiff base groups.

A reducing agent, such as NaBH4, NaBH3CN or the like, is used to effect reductive stabilization of the resultant Schiff base intermediate. The resultant adduct can be purified by passage through a conventional sizing column to remove cross-linked dextrans. Other conventional methods of derivatizing a dextran to introduce amine functions can also be used, e.g., reaction with cyanogen bromide, followed by reaction with a diamine. The aminodextran is then reacted with a derivative of the particular drug, toxin, chelator, immunomodulator, boron addend, or other therapeutic agent to be loaded, in an activated form, preferably, a carboxyl-activated derivative, prepared by conventional means, e.g., using dicyclohexylcarbodiimide (DCC) or a water soluble variant thereof, to form an intermediate adduct.

Alternatively, polypeptide toxins such as poke-weed antiviral protein or ricin A-chain, and the like, can be coupled to aminodextran by glutaraldehyde condensation or by reaction of activated carboxyl groups on the protein with amines on the aminodextran. Chelators for radiometals or magnetic resonance enhancers are well-known in the art. Typical are derivatives of ethylenediaminetetraacetic acid (EDTA) and diethylen-etriaminepentaacetic acid (DTPA). These chelators typically have groups on the side chain by which the chelator can be attached to a carrier. Such groups include, e.g., benzylisothiocyanate, by which the DTPA or EDTA can be coupled to the amine group of a carrier. Alternatively, carboxyl groups or amine groups on a chelator can be coupled to a carrier by activation or prior derivatization and then coupling, all by well-known means.

Boron addends, such as carboranes, can be attached to antibody components by conventional methods. For example, carboranes can be prepared with carboxyl functions on pendant side chains, as is well known in the art. Attachment of such carboranes to a carrier, e.g., aminodextran, can be achieved by activation of the carboxyl groups of the carboranes and condensation with amines on the carrier to produce an intermediate conjugate. Such intermediate conjugates are then attached to antibody components to produce therapeutically useful immunoconjugates, as described below.

A polypeptide carrier can be used instead of aminodextran, but the polypeptide carrier should have at least 50 amino acid residues in the chain, preferably 100-5000 amino acid residues. At least some of the amino acids should be lysine residues or glutamate or aspartate residues. The pendant amines of lysine residues and pendant carboxylates of glutamine and aspartate are convenient for attaching a drug, toxin, immunomodulator, chelator, boron addend or other therapeutic agent. Examples of suitable polypeptide carriers include polylysine, polyglutamic acid, polyaspartic acid, co-polymers thereof, and mixed polymers of these amino acids and others, e.g., serines, to confer desirable solubility properties on the resultant loaded carrier and immunoconjugate.

Conjugation of the intermediate conjugate with the antibody component is effected by oxidizing the carbohydrate portion of the antibody component and reacting the resulting aldehyde (and ketone) carbonyls with amine groups remaining on the carrier after loading with a drug, toxin, chelator, immunomodulator, boron addend, or other therapeutic agent. Alternatively, an intermediate conjugate can be attached to an oxidized antibody component via amine groups that have been introduced in the intermediate conjugate after loading with the therapeutic agent. Oxidation is conveniently effected either chemically, e.g., with NaIO4 or other glycolytic reagent, or enzymatically, e.g., with neuraminidase and galactose oxidase. In the case of an aminodextran carrier, not all of the amines of the aminodextran are typically used for loading a therapeutic agent. The remaining amines of aminodextran condense with the oxidized antibody component to form Schiff base adducts, which are then reductively stabilized, normally with a borohydride reducing agent.

Analogous procedures are used to produce other immunoconjugates according to the invention. Loaded polypeptide carriers preferably have free lysine residues remaining for condensation with the oxidized carbohydrate portion of an antibody component. Carboxyls on the polypeptide carrier can, if necessary, be converted to amines by, e.g., activation with DCC and reaction with an excess of a diamme.

The final immunoconjugate is purified using conventional techniques, such as sizing chromatography on Sephacryl S-300 or affinity chromatography using one or more CD84Hy epitopes. Alternatively, immunoconjugates can be prepared by directly conjugating an antibody component with a therapeutic agent. The general procedure is analogous to the indirect method of conjugation except that a therapeutic agent is directly attached to an oxidized antibody component. It will be appreciated that other therapeutic agents can be substituted for the chelators described herein. Those of skill in the art will be able to devise conjugation schemes without undue experimentation.

As a further illustration, a therapeutic agent can be attached at the hinge region of a reduced antibody component via disulfide bond formation. For example, the tetanus toxoid peptides can be constructed with a single cysteine residue that is used to attach the peptide to an antibody component. As an alternative, such peptides can be attached to the antibody component using a heterobifunctional cross-linker, such as N-succinyl 3-(2-pyridyldithio)propionate (SPDP). Yu et al., Int. J. Cancer 56:244 (1994). General techniques for such conjugation are well-known in the art. See, for example, Wong, Chemistry Of Protein Conjugation and Cross-Linking (CRC Press 1991); Upeslacis et al., "Modification of Antibodies by Chemical Methods," in Monoclonal Antibodies: Principles and Applications, Birch et al. (eds.), pages 187-230 (Wiley-Liss, Inc. 1995); Price, "Production and Characterization of Synthetic Peptide-Derived Antibodies," in Monoclonal Antibodies: Production, Engineering and Clinical Application, Ritter et al. (eds.), pages 60-84 (Cambridge University Press 1995).

Conjugates of the antibody and cytotoxic agent are made using a variety of bifunctional protein coupling agents such as N-succinimidyl-3-(2-pyridyldithiol) propionate (SPDP), iminothiolane (IT), bifunctional derivatives of imidoesters (such as dimethyl adipimidate HCL), active esters (such as disuccinimidyl suberate), aldehydes (such as glutaraldehyde), bis-azido compounds (such as bis (p-azido-benzoyl) hexanediamine), bis-diazonium derivatives (such as bis-(p-diazoniumbenzoyl)-ethylenediamine), diisocyanates (such as tolyene 2,6-diisocyanate), and bis-active fluorine compounds (such as 1,5-difluoro-2,4-dinitrobenzene). For example, a ricin immunotoxin can be prepared as described in Vitetta et al., Science 238: 1098 (1987). Carbon-14-labeled 1-isothiocyanatobenzyl-3-methyldiethylene triaminepentaacetic acid (MX-DTPA) is an exemplary chelating agent for conjugation of radionuclide to the antibody (see, e.g., WO 94/11026).

As described above, carbohydrate moieties in the Fe region of an antibody can be used to conjugate a therapeutic agent. However, the Fe region may be absent if an antibody fragment is used as the antibody component of the immunoconjugate. Nevertheless, it is possible to introduce a carbohydrate moiety into the light chain variable region of an antibody or antibody fragment. See, for example, Leung et al., J. Immunol. 154:5919 (1995); Hansen et al., U.S. Pat. No. 5,443,953. The engineered carbohydrate moiety is then used to attach a therapeutic agent. In addition, those of skill in the art will recognize numerous possible variations of the conjugation methods. For example, the carbohydrate moiety can be used to attach polyethyleneglycol in order to extend the half-life of an intact antibody, or antigen-binding fragment thereof, in blood, lymph, or other extracellular fluids. Moreover, it is possible to construct a "divalent immunoconjugate" by attaching therapeutic agents to a carbohydrate moiety and to a free sulfhydryl group. Such a free sulfhydryl group may be located in the hinge region of the antibody component.

Pharmaceutical Compositions and Medicaments

The antibodies or antigen binding fragment thereof, or the compositions, described herein can be used screening for a disease, detecting a presence or a severity of a disease, providing prognosis of a disease, monitoring disease progression or relapse, as well as assessment of treatment efficacy and/or relapse of a disease, disorder or condition, as well as selecting a therapy and/or a treatment for a disease, optimization of a given therapy for a disease, monitoring the treatment of a disease, and/or predicting the suitability of a therapy for specific patients or subpopulations or determining the appropriate dosing of a therapeutic product in patients or subpopulations. In some embodiments, the disease is cancer.

For the clinical use of the methods described herein, administration of the antibodies or antigen binding fragments thereof of the present disclosure can include formulation into pharmaceutical compositions, pharmaceutical formulations, or medicaments, for administration, e.g., subcutaneous, intravenous, intradermal, intraperitoneal, oral, intramuscular, intracranial or other routs of administration. In some embodiments, the antibodies or antigen binding fragments thereof, described herein can be administered along with any pharmaceutically acceptable carrier, excipient, or diluent, which results in an effective treatment in the subject. Thus, in one aspect, the present disclosure provides pharmaceutical compositions comprising one or more antibodies or antigen binding fragment thereof, described herein, in combination with one or more pharmaceutically acceptable carrier, excipient, or diluent.

The phrase "pharmaceutically acceptable" refers to those compounds, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit/risk ratio. The phrase "pharmaceutically acceptable carrier" as used herein means a pharmaceutically acceptable material, composition or vehicle, such as a liquid or solid filler, diluent, excipient, solvent, media, encapsulating material, manufacturing aid (e.g., lubricant, talc magnesium, calcium or zinc stearate, or steric acid), or solvent encapsulating material, involved in maintaining the stability, solubility, or activity of, an antibody or antigen binding fragment thereof of the present disclosure. Examples include, but are not limited to, any of a number of standard pharmaceutical carriers such as sterile phosphate buffered saline solutions, bacteriostatic water, and the like. A variety of aqueous carriers may be used, e.g., water, buffered water, 0.4% saline, 0.3% glycine and the like, and may include other proteins for enhanced stability, such as albumin, lipoprotein, globulin, etc., subjected to mild chemical modifications or the like. Each carrier must be "acceptable" in the sense of being compatible with the other ingredients of the formulation and not injurious to the patient. The terms "excipient", "carrier", "pharmaceutically acceptable carrier", or the like are used interchangeably herein. The compositions of the present disclosure may further comprise one or more pharmaceutically acceptable carriers, excipients, and other agents that are incorporated into formulations to provide improved transfer, delivery, tolerance, and the like (herein collectively referred to as "pharmaceutically acceptable carriers or diluents"). A multitude of appropriate formulations can be found in the formulary known to all pharmaceutical chemists: Remington's Pharmaceutical Sciences, Mack Publishing Company, Easton, Pa. These formulations include, for example, powders, pastes, ointments, jellies, waxes, oils, lipids, lipid (cationic or anionic) containing vesicles (such as LIPOFECTIN™), DNA conjugates, anhydrous absorption pastes, oil-in-water and water-in-oil emulsions, emulsions carbowax (polyethylene glycols of various molecular weights), semi-solid gels, and semi-solid mixtures containing carbowax. See also Powell et al. "Compendium of excipients for parenteral formulations" PDA, 1998, J Pharm Sci Technol 52:238-311.

Acceptable carriers, excipients, or stabilizers are nontoxic to recipients at the dosages and concentrations employed, and include buffers such as phosphate, citrate, and other organic acids; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g., Zn-protein complexes); and/or non-ionic surfactants such as TWEEN®, PLURONICS® or polyethylene glycol (PEG).

Optionally, the formulations comprising the compositions described herein contain a pharmaceutically acceptable salt, typically, e.g., sodium chloride, and preferably at about physiological concentrations. Optionally, the formulations of the invention can contain a pharmaceutically acceptable preservative. In some embodiments the preservative concentration ranges from 0.1 to 2.0%, typically v/v. Suitable preservatives include those known in the pharmaceutical arts. Benzyl alcohol, phenol, m-cresol, methylparaben, and propylparaben are examples of preservatives. Optionally, the formulations of the invention can include a pharmaceutically acceptable surfactant at a concentration of 0.005 to 0.02%.

The compositions described herein can be specially formulated for administration of the antibody or antigen binding fragment thereof to a subject in solid, liquid or gel form, including those adapted for the following: (1) parenteral administration, for example, by subcutaneous, intramuscular, intravenous or epidural injection as, for example, a sterile solution or suspension, or sustained-release formulation; (2) topical application, for example, as a cream, ointment, or a controlled-release patch or spray applied to the skin; (3) intravaginally or intrarectally, for example, as a pessary, cream or foam; (4) ocularly; (5) transdermally; (6) transmucosally; or (7) nasally. Additionally, an antibody or antigen binding fragment thereof, or compositions of the present disclosure can be implanted into a patient or injected using a drug delivery system. See, e.g., Urquhart et al., 24 Ann. Rev. Pharmacol. Toxicol. 199 (1984); Controlled Release of Pesticides & Pharmaceuticals (Lewis, ed., Plenum Press, New York, 1981); U.S. Pat. Nos. 3,773,919, 3,270,960.

The compositions disclosed herein, comprising an antibody or antigen binding fragment, described herein, can also contain more than one active compound as necessary for the particular indication being treated, preferably those with complementary activities that do not adversely affect each other. For example, the composition can further comprise a cytotoxic agent, cytokine, growth inhibitory agent and/or an angiogenesis inhibitor such as a VEGFR antagonist. Such molecules are suitably present in combination in amounts that are effective for the purpose intended. The active ingredients of the compositions comprising an antibody or antigen binding fragment thereof described herein can also be entrapped in microcapsules prepared, for example, by coacervation techniques or by interfacial polymerization, for example, hydroxymethylcellulose or gelatin-microcapsules and poly-(methylmethacylate) microcapsules, respectively, in colloidal drug delivery systems (for example, liposomes, albumin microspheres, microparticle, microemulsions, nano-particles and nanocapsules) or in macroemulsions. Such techniques are disclosed in Remington's Pharmaceutical Sciences (16th ed., Osol, ed., 1980). The pharmaceutical composition can be also delivered in a vesicle, in particular a liposome (see Langer 1990 Science 249:1527-1533; Treat et al. (1989) in Liposomes in the Therapy of Infectious Disease and Cancer, Lopez-Berestein and Fidler (eds.), Liss, New York, pp. 353-365; Lopez-Berestein, ibid., pp. 317-327; see generally ibid.). Liposomes include emulsions, foams, micelles, insoluble monolayers, phospholipid dispersions, lamellar layers and the like, and can serve as vehicles to target the M-CSF antibodies to a particular tissue as well as to increase the half-life of the composition. A variety of methods are available for preparing liposomes, as described in, e.g., U.S. Pat. Nos. 4,837,028 and 5,019,369, which patents are incorporated herein by reference.

Liposomes containing the antibody are prepared by methods known in the art, such as described in Epstein et al., Proc. Natl. Acad. Sci. USA 82: 3688 (1985); Hwang et al., Proc. Natl Acad. Sci. USA 77: 4030 (1980); and U.S. Pat. Nos. 4,485,045 and 4,544,545. Liposomes with enhanced circulation time are disclosed in U.S. Pat. No. 5,013,556. Particularly useful liposomes can be generated by the reverse phase evaporation method with a lipid composition comprising phosphatidylcholine, cholesterol and PEG-derivatized phosphatidylethanolamine (PEG-PE). Liposomes are extruded through filters of defined pore size to yield liposomes with the desired diameter. Fab' fragments of the antibody of the present invention can be conjugated to the liposomes as described in Martin et al., J. Biol. Chem. 257: 286-288 (1982) via a disulfide interchange reaction. A chemotherapeutic agent (such as Doxorubicin) is optionally contained within the liposome [see, e.g., Gabizon et al., J. National Cancer Inst. 81(19): 1484 (1989)].

In some embodiments, sustained-release preparations can be used. Suitable examples of sustained-release preparations include semipermeable matrices of solid hydrophobic polymers containing an antibody or antigen binding fragment of the present disclosure, in which the matrices are in the form of shaped articles, e.g., films, or microcapsule. Examples of sustained-release matrices include polyesters, hydrogels (for example, poly(2-hydroxyethyl-methacrylate), or poly(vinylalcohol)), polylactides (U.S. Pat. No. 3,773,919), copolymers of L-glutamic acid and y ethyl-L-glutamate, non-degradable ethylene-vinyl acetate, degradable lactic acid-glycolic acid copolymers such as the LUPRON DEPOT™ (injectable microspheres composed of lactic acid-glycolic acid copolymer and leuprolide acetate), and poly-D-(–)-3-hydroxybutyric acid. While polymers such as ethylene-vinyl acetate and lactic acid-glycolic acid enable release of molecules for over 100 days, certain hydrogels release proteins for shorter time periods. When encapsulated antibodies remain in the body for a long time, they can denature or aggregate as a result of exposure to moisture at 37° C., resulting in a loss of biological activity and possible changes in immunogenicity. Rational strategies can be devised for stabilization depending on the mechanism involved. For example, if the aggregation mechanism is discovered to be intermolecular S—S bond formation through thio-disulfide interchange, stabilization can be achieved by modifying sulfhydryl residues, lyophilizing from acidic solutions, controlling moisture content, using appropriate additives, and developing specific polymer matrix compositions. In certain situations, the pharmaceutical composition can be delivered in a controlled release system. In one embodiment, a pump may be used (see Langer, supra; Sefton 1987 CRC Crit. Ref. Biomed. Eng. 14:201). In another embodiment, polymeric materials can be used. In yet another embodiment, a controlled release system can be placed in proximity of the composition's target, thus requiring only a fraction of the systemic dose (see, e.g., Goodson, 1984, in Medical Applications of Controlled Release, supra, vol. 2, pp. 115-138).

A pharmaceutical composition of the present disclosure can be delivered, e.g., subcutaneously or intravenously with a standard needle and syringe. In addition, with respect to subcutaneous delivery, a pen delivery device readily has applications in delivering a pharmaceutical composition of the present invention. Such a pen delivery device can be reusable or disposable. A reusable pen delivery device generally utilizes a replaceable cartridge that contains a pharmaceutical composition. Once all of the pharmaceutical composition within the cartridge has been administered and the cartridge is empty, the empty cartridge can readily be discarded and replaced with a new cartridge that contains the pharmaceutical composition. The pen delivery device can then be reused. In a disposable pen delivery device, there is no replaceable cartridge. Rather, the disposable pen delivery device comes prefilled with the pharmaceutical composition held in a reservoir within the device. Once the reservoir is emptied of the pharmaceutical composition, the entire device is discarded. Numerous reusable pen and autoinjector delivery devices have applications in the subcutaneous delivery of a pharmaceutical composition of the present invention. Examples include, but certainly are not limited to AUTOPEN™ (Owen Mumford, Inc., Woodstock, UK), DISETRONIC™ pen (Disetronic Medical Systems, Burghdorf, Switzerland), HUMALOG MIX 75/25™ pen, HUMALOG™ pen, HUMALIN70130™ pen (Eli Lilly and Co., Indianapolis, Ind.), NOVOPEN™ I, II and III (Novo Nordisk, Copenhagen, Denmark), NOVOPEN JUNIOR™ (Novo Nordisk, Copenhagen, Denmark), BD™ pen (Becton Dickinson, Franklin Lakes, N.J.), OPTIPEN™, OPTIPEN PRO™, OPTIPEN STARLET™, and OPTICLIK™ (Sanofi-Aventis, Frankfurt, Germany), to name only a few. Examples of disposable pen delivery devices having applications in subcutaneous delivery of a pharmaceutical composition include, but certainly are not limited to the SOLO-STAR™ pen (Sanofi-Aventis), the FLEXPEN™ (Novo Nordisk), and the KWIKPEN™ (Eli Lilly).

The injectable preparations may include dosage forms for intravenous, subcutaneous, intracutaneous and intramuscular injections, drip infusions, etc. These injectable preparations may be prepared by methods publicly known. For example, the injectable preparations may be prepared, e.g., by dissolving, suspending or emulsifying the antibody or its salt described above in a sterile aqueous medium or an oily medium conventionally used for injections. As the aqueous medium for injections, there are, for example, physiological saline, an isotonic solution containing glucose and other auxiliary agents, etc., which may be used in combination with an appropriate solubilizing agent such as an alcohol (e.g., ethanol), a polyalcohol (e.g., propylene glycol, polyethylene glycol), a nonionic surfactant [e.g., polysorbate 80, HCO-50 (polyoxyethylene (50 mol) adduct of hydrogenated castor oil)], etc. As the oily medium, there are employed, e.g., sesame oil, soybean oil, etc., which may be used in combination with a solubilizing agent such as benzyl benzoate, benzyl alcohol, etc. The injection thus prepared is preferably filled in an appropriate ampoule.

Compositions of the present disclosure can be in the form of, for example, granules, powders, tablets, capsules, syrup, suppositories, injections, emulsions, elixirs, suspensions or solutions. The amount of the aforesaid antibody contained can be about 5 to about 500 mg per dosage form in a unit dose; especially in the form of injection, it is preferred that the aforesaid antibody is contained in about 5 to about 100 mg and in about 10 to about 250 mg for the other dosage forms.

For oral, buccal, and sublingual administration, powders, suspensions, granules, tablets, pills, capsules, gelcaps, and caplets are acceptable as solid dosage forms. These can be prepared, for example, by mixing one or more compounds of the instant invention, or pharmaceutically acceptable salts or tautomers thereof, with at least one additive such as a starch or other additive. Suitable additives are sucrose, lactose, cellulose sugar, mannitol, maltitol, dextran, starch, agar, alginates, chitins, chitosans, pectins, tragacanth gum, gum arabic, gelatins, collagens, casein, albumin, synthetic or semi-synthetic polymers or glycerides. Optionally, oral dosage forms can contain other ingredients to aid in administration, such as an inactive diluent, or lubricants such as magnesium stearate, or preservatives such as paraben or sorbic acid, or anti-oxidants such as ascorbic acid, tocopherol or cysteine, a disintegrating agent, binders, thickeners, buffers, sweeteners, flavoring agents or perfuming agents. Tablets and pills may be further treated with suitable coating materials known in the art.

Liquid dosage forms for oral administration may be in the form of pharmaceutically acceptable emulsions, syrups, elixirs, suspensions, and solutions, which may contain an inactive diluent, such as water. Pharmaceutical formulations and medicaments may be prepared as liquid suspensions or solutions using a sterile liquid, such as, but not limited to, an oil, water, an alcohol, and combinations of these. Pharmaceutically suitable surfactants, suspending agents, emulsifying agents, may be added for oral or par-enteral administration.

As noted above, suspensions may include oils. Such oils include, but are not limited to, peanut oil, sesame oil, cottonseed oil, corn oil and olive oil. Suspension preparation may also contain esters of fatty acids such as ethyl oleate, isopropyl myristate, fatty acid glycerides and acetylated fatty acid glycerides. Suspension formulations may include alcohols, such as, but not limited to, ethanol, iso-propyl alcohol, hexadecyl alcohol, glycerol and propylene glycol. Ethers, such as but not limited to, poly(ethyleneglycol), petroleum hydrocarbons such as mineral oil and petrolatum; and water may also be used in suspension formulations.

For nasal administration, the pharmaceutical formulations and medicaments may be a spray or aerosol containing an appropriate solvent(s) and optionally other compounds such as, but not limited to, stabilizers, antimicrobial agents, antioxidants, pH modifiers, surfactants, bio-availability modifiers and combinations of these. A propellant for an aerosol formulation may include compressed air, nitrogen, carbon dioxide, or a hydrocarbon based low boiling solvent.

Injectable dosage forms generally include aqueous suspensions or oil suspensions which may be prepared using a suitable dispersant or wetting agent and a suspending agent. Injectable forms may be in solution phase or in the form of a suspension, which is prepared with a solvent or diluent. Acceptable solvents or vehicles include sterilized water, Ringer's solution, or an isotonic aqueous saline solution. Alternatively, sterile oils may be employed as solvents or suspending agents. Preferably, the oil or fatty acid is non-volatile, including natural or synthetic oils, fatty acids, mono-, di-, or tri-glycerides.

For injection, the pharmaceutical formulation and/or medicament may be a powder suitable for reconstitution with an appropriate solution as described above. Examples of these include, but are not limited to, freeze dried, rotary dried or spray dried powders, amorphous powders, granules, precipitates, or particulates. For injection, the formulations may optionally contain stabilizers, pH modifiers, surfactants, bioavailability modifiers and combinations of these.

For rectal administration, the pharmaceutical formulations and medicaments may be in the form of a suppository, an ointment, an enema, a tablet or a cream for release of compound in the intestines, sigmoid flexure and/or rectum. Rectal suppositories are prepared by mixing one or more compounds of the instant invention, or pharmaceutically acceptable salts or tautomers of the compound, with acceptable vehicles, for example, cocoa butter or polyethylene glycol, which is present in a solid phase at normal storing temperatures, and present in a liquid phase at those temperatures suitable to release a drug inside the body, such as in the rectum. Oils may also be employed in the preparation of formulations of the soft gelatin type and suppositories. Water, saline, aqueous dextrose and related sugar solutions, and glycerols may be employed in the preparation of suspension formulations which may also contain suspending agents such as pectins, carbomers, methyl cellulose, hydroxypropyl cellulose or carboxymethyl cellulose, as well as buffers and preservatives.

The concentration of an antibody or an antigen binding fragment thereof in these compositions can vary widely, i.e., from less than about 10%, usually at least about 25% to as much as 75% or 90% by weight and will be selected primarily by fluid volumes, viscosities, etc., in accordance with the particular mode of administration selected. Actual methods for preparing orally, topically and parenterally administrable compositions will be known or apparent to those skilled in the art and are described in detail in, for example, Remington's Pharmaceutical Science, 19th ed., Mack Publishing Co., Easton, Pa. (1995), which is incorporated herein by reference.

In another embodiment of the invention, an article of manufacture containing materials useful for the treatment of the diseases, disorders or conditions described above is provided, including for treatment of cancer. The article of manufacture comprises a container and a label. Suitable containers include, for example, bottles, vials, syringes, and test tubes. The containers may be formed from a variety of materials such as glass or plastic. The container holds a composition which is effective for treating the condition and may have a sterile access port (for example the container may be an intravenous solution bag or a vial having a stopper pierceable by a hypodermic injection needle). The active agent in the composition is the antibody of the invention. The label on or associated with, the container indicates that the composition is used for treating the condition of choice. The article of manufacture may further comprise a second container comprising a pharmaceutically-acceptable buffer, such as phosphate-buffered saline, Ringer's solution and dextrose solution. It may further include other materials desirable from a commercial and user standpoint, including other buffers, diluents, filters, needles, syringes, and package inserts with instructions for use.

Pharmaceutical compositions and medicaments described herein are useful in treating a cancerous disease.

Methods of Treatment

The disclosure provides methods for treatment or prevention of a cancer, including, but not limited to, neoplasms, tumors, metastases, or any disease or disorder characterized by uncontrolled cell growth, by the administration of an antibody or antigen-binding fragment thereof disclosed herein, to a patient in an amount effective to treat the patient.

Treatment Terminology

As used herein, a "subject", "patient", "individual" and like terms are used interchangeably and refers to a vertebrate, a mammal, a primate, or a human. Mammals include, without limitation, humans, primates, rodents, wild or domesticated animals, including feral animals, farm animals, sport animals, and pets. Primates include, for example, chimpanzees, cynomologous monkeys, spider monkeys, and macaques, e.g., Rhesus. Rodents include, for example, mice, rats, woodchucks, ferrets, rabbits and hamsters. Domestic and game animals include, for example, cows, horses, pigs, deer, bison, buffalo, feline species, e.g., domestic cat, and canine species, e.g., dog, fox, wolf, avian species, e.g., chicken, emu, ostrich, and fish, e.g., trout, catfish and salmon. The terms, "individual," "patient" and "subject" are used interchangeably herein. A subject can be male or female.

The term "in need thereof" when used in the context of a therapeutic or prophylactic treatment, means having a disease, being diagnosed with a disease, or being in need of preventing a disease, e.g., for one at risk of developing the disease. Thus, a subject in need thereof can be a subject in need of treating or preventing a disease.

As used herein, the term "administering," refers to the placement of a compound (e.g., an antibody or antigen binding fragment thereof as disclosed herein) into a subject by a method or route that results in at least partial delivery of the agent at a desired site. Pharmaceutical compositions comprising an antibody or antigen binding fragment thereof, disclosed herein can be administered by any appropriate route which results in an effective treatment in the subject, including but not limited to intravenous, intraarterial, injection or infusion directly into a tissue parenchyma, etc. Where necessary or desired, administration can include, for example, intracerebroventricular ("icy") administration, intranasal administration, intracranial administration, intracelial administration, intracerebellar administration, or intrathecal administration.

In some embodiments, the subject is a mammal. The mammal can be a human, non-human primate, mouse, rat, dog, cat, horse, or cow, but is not limited to these examples. Mammals other than humans can be advantageously used as subjects that represent animal models of conditions or disorders associated with uncontrolled cell growth (e.g., a cancer). Non-limiting examples include murine tumor models. In addition, the compositions and methods described herein can be used to treat domesticated animals and/or pets. A subject can be one who has been previously diagnosed with or identified as suffering from a cancer. A subject can be one who is diagnosed and currently being treated for, or seeking treatment, monitoring, adjustment or modification of an existing therapeutic treatment, or is at a risk of developing a given disorder (e.g., cancer).

The terms "disease", "disorder", or "condition" are used interchangeably herein, refer to any alternation in state of the body or of some of the organs, interrupting or disturbing the performance of the functions and/or causing symptoms such as discomfort, dysfunction, distress, or even death to the person afflicted or those in contact with a person. A disease or disorder can also be related to a distemper, ailing, ailment, malady, disorder, sickness, illness, complaint, or affectation.

The term "cancer" refers to a disease characterized by the rapid and uncontrolled growth of aberrant cells. Cancer cells can spread locally or through the bloodstream and lymphatic system to other parts of the body. The term "anti-tumor effect" refers to a biological effect which can be manifested by various means, including but not limited to, e.g., a decrease in tumor volume, a decrease in the number of tumor cells, a decrease in the number of metastases, an increase in life expectancy, decrease in tumor cell proliferation, decrease in tumor cell survival, or amelioration of various physiological symptoms associated with the cancerous condition. An "anti-tumor effect" can also be manifested by the ability of the peptides, polynucleotides, cells and antibodies of the invention in prevention of the occurrence of tumor in the first place.

Exemplary Cancers

In some embodiments, the cancer can be a carcinoma, a sarcoma, a lymphoma, a leukemia, germ cell tumor, a blastoma, or a melanoma. In some embodiments, the cancer can be a cancer from the bladder, blood, bone, bone marrow, brain, breast, colon, esophagus, gastrointestine, gum, head, kidney, liver, lung, nasopharynx, neck, ovary, prostate, skin, stomach, testis, tongue, or uterus. In some embodiments, the cancer may be a neoplasm, malignant carcinoma, carcinoma, undifferentiated, giant and spindle cell carcinoma, small cell carcinoma, papillary carcinoma, squamous cell carcinoma, lymphoepithelial carcinoma, basal cell carcinoma, pilomatrix carcinoma, transitional cell carcinoma, papillary transitional cell carcinoma, adenocarcinoma; gastrinoma, cholangiocarcinoma, hepatocellular carcinoma, combined hepatocellular carcinoma and cholangiocarcinoma, trabecular adenocarcinoma, adenoid cystic carcinoma, adenocarcinoma in adenomatous polyp, adenocarcinoma, Familial adenomatous polyposis, solid carcinoma, carcinoid tumor, branchiolo-alveolar adenocarcinoma, papillary adenocarcinoma, chromophobe carcinoma, acidophil carcinoma, oxyphilic adenocarcinoma, basophil carcinoma, clear cell adenocarcinoma, granular cell carcinoma, follicular adenocarcinoma, papillary and follicular adenocarcinoma, nonencapsulating sclerosing carcinoma, adrenal cortical carcinoma, endometroid carcinoma, skin appendage carcinoma, apocrine adenocarcinoma, sebaceous adenocarcinoma, ceruminous adenocarcinoma, mucoepidermoid carcinoma, cystadenocarcinoma, papillary cystadenocarcinoma, papillary serous cystadenocarcinoma, mucinous cystadenocarcinoma, mucinous adenocarcinoma, signet ring cell carcinoma, infiltrating duct carcinoma, medullary carcinoma, lobular carcinoma, inflammatory carcinoma, Paget's disease, mammary acinar cell carcinoma, adenosquamous carcinoma, adenocarcinoma w/squamous metaplasia, thymoma, ovarian stromal tumor, thecoma, granulosa cell tumor, androblastoma, sertoli cell carcinoma, Leydig cell tumor, lipid cell tumor, paraganglioma, extra-mammary paraganglioma, pheochromocytoma, glomangiosarcoma, melanoma, Lentigo maligna, Lentigo maligna melanoma, Acral lentiginous melanoma, mucosal melanoma, nodular melanoma, polypoid melanoma, desmoplastic melanoma, skin cutaneous melanoma, amelanotic melanoma, superficial spreading melanoma, melanoma in giant pigmented nevus, epithelioid cell melanoma, blue nevus, sarcoma, fibrosarcoma, fibrous histiocytoma, myxosarcoma, liposarcoma, leiomyosarcoma, rhabdomyosarcoma, embryonal rhabdomyosarcoma, alveolar rhabdomyosarcoma, stromal sarcoma, mixed tumor, mullerian mixed tumor, nephroblastoma, hepatoblastoma, carcinosarcoma, mesenchymoma, Brenner tumor, phyllodes tumor, synovial sarcoma, mesothelioma, dysgerminoma, embryonal carcinoma, teratoma, struma ovarii, choriocarcinoma, mesonephroma, hemangiosarcoma, hemangioendothelioma, Kaposi's sarcoma, hemangiopericytoma, lymphangiosarcoma, osteosarcoma, juxtacortical osteosarcoma, chondrosarcoma, chondroblastoma, mesenchymal chondrosarcoma, giant cell tumor of bone, Ewing's sarcoma, odontogenic tumor, ameloblastic odontosarcoma, ameloblastoma, ameloblastic fibrosarcoma, pinealoma, chordoma glioma, ependymoma, astrocytoma, protoplasmic astrocytoma, fibrillary astrocytoma, astroblastoma, glioblastoma, oligodendroglioma, oligodendroblastoma, primitive neuroectodermal, cerebellar sarcoma, ganglioneuroblastoma, neuroblastoma, retinoblastoma, olfactory neurogenic tumor, meningioma, neurofibrosarcoma, neurilemmoma, granular cell tumor, malignant lymphoma, Hodgkin's disease, Hodgkin's, paragranuloma, lymphoma, small lymphocytic, malignant lymphoma, diffuse large B-cell lymphoma, follicular lymphoma, mycosis fungoides, other specified non-Hodgkin's lymphomas, histiocytosis, multiple myeloma, mast cell sarcoma, immunoproliferative small intestinal disease, leukemia, lymphoid leukemia, plasma cell leukemia, erythroleukemia, lymphosarcoma cell leukemia, myeloid leukemia, basophilic leukemia, eosinophilic leukemia, monocytic leukemia, mast cell leukemia, megakaryoblastic leukemia, myeloid sarcoma, hairy cell leukemia, or a combination thereof. In some embodiments, the cancer is lung cancer. In some embodiments, the lung cancer is non-small cell lung carcinoma, small-cell lung carcinoma, lung adenocarcinoma, lung squamous cell carcinoma, large cell carcinoma, carcinoid tumors, bronchial gland carcinomas, carcinosarcomas, pulmonary blastomas, giant and spindle cell carcinomas, and sarcomatoid carcinomas. In some embodiments, the lung cancer is stage 0, IA, IB, IIA, IIB, IIIA, IIIB, or IV. In some embodiments, the lung cancer is limited stage or extensive stage cancer. In some embodiments, the cancer is T1a, T1b, T1c, T2a, T2v, T3 size, T3 inv, T3 centr, T3 satell, T4 inv, T4 ipis, N1, or N2.

Combination Treatment with a Second Therapeutic Agent

An antibody of the present disclosure may be administered to a subject per se or in the form of a pharmaceutical composition disclosed herein for the treatment or prevention of diseases, e.g., cancer. The antibodies or antigen binding fragment thereof or the compositions described herein may be administered alone or in combination a second therapeutic agent or therapy useful for treating cancer. Examples of second therapy useful for treating cancer can include, but not limited to radiotherapy, cryotherapy, antibody therapy, chemotherapy, photodynamic therapy, surgery, hormonal therapy, immunotherapy, cytokine therapy, or a combination therapy with conventional drugs. In some embodiments, a second therapeutic agent, can be a cytotoxic drug, tumor vaccine, a peptide, a pepti-body, a small molecule, a cytotoxic agent, a cytostatic agent, immunological modifier, interferon, interleukin, immunostimulatory growth hormone, cytokine, vitamin, mineral, aromatase inhibitor, RNAi, Histone Deacetylase Inhibitor, proteasome inhibitor, a cancer chemotherapeutic agent, Tregs targeting agent, another antibody, Immunostimulatory antibody, a NSAID, a corticosteroid, a dietary supplement such as an antioxidant, cisplatin, ifosfamide, paclitaxel, taxanes, topoisomerase I inhibitors (e.g., CPT-11, topotecan, 9-AC, and GG-211), gemcitabine, vinorelbine, oxaliplatin, 5-fluorouracil (5-FU), leucovorin, vinorelbine, temodal, and taxol. In some embodiments, the second therapeutic agent is a chemotherapeutic agent selected from a group consisting of platinum based compounds, antibiotics with anti-cancer activity, Anthracyclines, Anthracenediones, alkylating agents, antimetabolites, Antimitotic agents, Taxanes, Taxoids, microtubule inhibitors, Vinca alkaloids, Folate antagonists, Topoisomerase inhibitors, Antiestrogens, Antiandrogens, Aromatase inhibitors, GnRh analogs, and inhibitors of 5α-reductase, biphosphonates.

A "cytotoxic agent" refers to an agent that has a cytotoxic and/or cytostatic effect on a cell. A "cytotoxic effect" refers to the depletion, elimination and/or the killing of a target cell(s). A "cytostatic effect" refers to the inhibition of cell proliferation.

In some embodiments, the second therapeutic agent can be a PD-1 inhibitor, histone deacetylase (HDAC) inhibitor, proteasome inhibitor, mTOR pathway inhibitor, JAK2 inhibitor, tyrosine kinase inhibitor (TKIs), PI3K inhibitor, Protein kinase inhibitor, Inhibitor of serine/threonine kinases, inhibitor of intracellular signaling, inhibitors of Ras/Raf signaling, MEK inhibitor, AKT inhibitor, inhibitor of survival signaling proteins, cyclin dependent kinase inhibitor, therapeutic monoclonal antibodies, TRAIL pathway agonist, anti-angiogenic agent, metalloproteinase inhibitor, cathepsin inhibitor, inhibitor of urokinase plasminogen activator receptor function, immunoconjugate, antibody drug conjugate, antibody fragments, bispecific antibodies, bispecific T cell engagers (BiTEs). In some embodiments, the another antibody is selected from cetuximab, panitumumab, nimotuzumab, trastuzumab, pertuzumab, rituximab, ofatumumab, veltuzumab, alemtuzumab, labetuzumab, adecatumumab, oregovomab, onartuzumab; apomab, mapatumumab, lexatumumab, conatumumab, tigatuzumab, catumaxomab, blinatumomab, ibritumomab triuxetan, tositumomab, brentuximab vedotin, gemtuzumab ozogamicin, clivatuzumab tetraxetan, pemtumomab, trastuzumab emtansine, bevacizumab, etaracizumab, volociximab, ramucirumab, aflibercept. In yet another embodiment, the second therapeutic agent can be antibodies currently used for the treatment of cancer. Examples of such antibodies include, but are not limited to, HERCEPTIN®, RETUXAN®, OvaRex, Panorex, BEC2, IMC-C225, Vitaxin, Campath I/H, Smart MI95, LymphoCide, Smart I D10, and Oncolym. In some embodiments, the another antibody is an immunostimulatory antibody is selected from antagonistic antibodies targeting one or more of CTLA4, PD-1, PDL-1, LAG-3, TIM-3, BTLA, B7-H4, B7-H3, VISTA, and/or Agonistic antibodies targeting one or more of CD40, CD137, OX40, GITR, CD27, CD28, ICOS or a combination thereof. In some embodiments, the second therapeutic agent targeting immunosuppressive cells Tregs and/or MDSCs is selected from antimitotic drugs, cyclophosphamide, gemcitabine, mitoxantrone, fludarabine, thalidomide, thalidomide derivatives, COX-2 inhibitors, depleting or killing antibodies that directly target Tregs through recognition of Treg cell surface receptors, anti-CD25 daclizumab, basiliximab, ligand-directed toxins, denileukin diftitox (ONTAK®)—a fusion protein of human IL-2 and diphtheria toxin, or LMB-2—a fusion between an scFv against CD25 and the *pseudomonas* exotoxin, antibodies targeting Treg cell surface receptors, TLR modulators, agents that interfere with the adenosinergic pathway, ectonucleotidase inhibitors, or inhibitors of the A2A adenosine receptor, TGF-β inhibitors, chemokine receptor inhibitors, retinoic acid, all-trans retinoic acid (ATRA), Vitamin D3, phosphodiesterase 5 inhibitors, sildenafil, ROS inhibitors and nitroaspirin. In some embodiments, the second therapeutic agent is cytokine therapy selected from one or more of the following cytokines such as IL-2, IL-7, IL-12, IL-15, IL-17, IL-18 and IL-21, IL23, IL-27, GM-CSF, IFNα (interferon alpha), IFNα-2b, IFNβ, IFNγ, and their different strategies for delivery. In some embodiments, the second therapeutic agent is a therapeutic cancer vaccine selected from a group consisting of exogenous cancer vaccines including proteins or peptides used to mount an immunogenic response to a tumor antigen, recombinant virus and bacteria vectors encoding tumor antigens, DNA-based vaccines encoding tumor antigens, proteins targeted to dendritic cell-based vaccines, whole tumor cell vaccines, gene modified tumor cells expressing GM-CSF, ICOS and/or Flt3-ligand, oncolytic virus vaccines.

In some embodiments, the second therapeutic agent include EPO, G-CSF, ganciclovir; antibiotics, leuprolide; meperidine; zidovudine (AZT); interleukins 1 through 18, including mutants and analogues; interferons or cytokines, such as interferons a, ' and y hormones, such as luteinizing hormone releasing hormone (LHRH) and analogues and, gonadotropin releasing hormone (GnRH); growth factors, such as transforming growth factor, fibroblast growth factor (FGF), nerve growth factor (NGF), growth hormone releasing factor (GHRF), epidermal growth factor (EGF), fibroblast growth factor homologous factor (FGFHF), hepatocyte growth factor (HGF), and insulin growth factor (IGF); tumor necrosis factor-alpha (TNF-α); invasion inhibiting factor-2 (IIF-2); bone morphogenetic proteins 1-7 (BMP 1-7); somatostatin; thymosin-a-1; y-globulin; superoxide dismutase (SOD); complement factors; anti-angiogenesis factors; antigenic materials; and pro-drugs.

Prodrug refers to a precursor or derivative form of a pharmaceutically active substance that is less cytotoxic or non-cytotoxic to tumor cells compared to the parent drug and is capable of being enzymatically activated or converted into an active or the more active parent form. See, e.g., Wilman, "Prodrugs in Cancer Chemotherapy" Biochemical Society Transactions, 14, pp. 375-382, 615th Meeting Belfast (1986) and Stella et al., "Prodrugs: A Chemical Approach to Targeted Drug Delivery," Directed Drug Delivery, Borchardt et al., (ed.), pp. 247-267, Humana Press (1985). Prodrugs include, but are not limited to, phosphate-containing prodrugs, thiophosphate-containing prodrugs, sulfate-containing prodrugs, peptide-containing prodrugs, D-amino acid-modified prodrugs, glycosylated prodrugs, lactam-containing prodrugs, optionally substituted phenoxyacetamide-containing prodrugs or optionally substituted phenylacetamide-containing prodrugs, 5-fluorocyto-sine and other 5-fluorouridine prodrugs which can be converted into the more active cytotoxic free drug. Examples of cytotoxic drugs that can be derivatized into a prodrug form for use herein include, but are not limited to, those chemotherapeutic agents described above.

In another embodiment, the antibodies or antigen binding fragment thereof disclosed herein are administered, for the prevention or treatment of cancer prior to (e.g., 1 minute, 15 minutes, 30 minutes, 45 minutes, 1 hour, 2 hours, 4 hours, 6 hours, 8 hours, 12 hours, 24 hours, 2 days, or 1 week before), subsequent to (e.g., 1 minute, 15 minutes, 30 minutes, 45 minutes, 1 hour, 2 hours, 4 hours, 6 hours, 8 hours, 12 hours, 24 hours, 2 days, or 1 week after), or concomitantly with the second therapeutic agent. In another embodiment, the second therapeutic agent can be antibodies immunospecific for one or more cancer cell antigens. In some embodiments, the cancer is refractory to other anti-cancer treatments or a second therapeutic agent. In some embodiments, the cancer is in remission. In some embodiments, one or more antibodies disclosed herein or antigen binding fragments thereof are administered to an animal, preferably a mammal and most preferably a human. In some embodiments, the antibodies disclosed herein or antigen binding fragment thereof are administered after surgical resection of cancer. The method and compositions of the present disclosure contemplate single antibody or antigen binding fragment thereof, disclosed herein, as well as combinations, or "cocktails", of more than one antibody or antigen binding fragment thereof, disclosed herein. In some embodiments, more than one antibody comprises at least 2, at least 3, at least 4, all 5 antibodies or antigen binding fragment thereof, disclosed herein. Such antibody cocktails may have certain advantages inasmuch as they contain antibodies which exploit different effector mechanisms or combine directly cytotoxic antibodies with antibodies that rely on immune effector functionality.

Antibody Based Gene Therapy

In another aspect of the disclosure, nucleic acids molecules comprising sequences encoding antibodies or antigen binding fragment thereof, are administered to treat, inhibit or prevent a disease or disorder by way of gene therapy. In some embodiments, the disease is a cancer. In some embodiments, the disease is a skin cancer. In some embodiments, the disease is a skin cutaneous melanoma. In some embodiments, the disease is associated with aberrant expression and/or activity of an antigen that the antibody binds. Gene therapy refers to therapy performed by the administration to a subject of an expressed or expressible nucleic acid molecule. In this embodiment of the disclosure, the nucleic acid molecules produce their encoded protein (e.g., an antibody or antigen binding fragment disclosed herein) that mediates a therapeutic effect. Any of the methods for gene therapy available can be used according to the present invention. Exemplary methods are described below. For general reviews of the methods of gene therapy, see Goldspiel et al., Clinical Pharmacy 12:488-505 (1993); Wu and Wu, Biotherapy 3:87-95 (1991);

In a one aspect, the nucleic acid molecule comprising nucleic acid sequences encoding an antibody, said nucleic acid molecule being part of expression vectors that express the antibody or fragments or chimeric proteins or heavy or light chains thereof in a suitable host. In particular, such nucleic acid sequences have promoters operably linked to the antibody coding region, said promoter being inducible or constitutive, and, optionally, tissue-specific.

In another particular embodiment, nucleic acid molecules are used in which the antibody coding sequences and any other desired sequences are flanked by regions that promote homologous recombination at a desired site in the genome, thus providing for intrachromosomal expression of the antibody encoding nucleic acids (Koller and Smithies, Proc. Natl. Acad. Sci. USA 86:8932-8935 (1989); Zijistra et al., Nature 342:435-438 (1989). In some embodiments, the expressed antibody is a single chain antibody; alternatively, the nucleic acid sequences include sequences encoding both the heavy and light chains, or fragments thereof, of the antibody.

Delivery of the nucleic acid molecules into a patient may be either direct, in which case the patient is directly exposed to the nucleic acid or nucleic acid-carrying vectors, or indirect, in which case, cells are first transformed with the nucleic acids in vitro, then transplanted into the patient. These two approaches are known, respectively, as in vivo or ex vivo gene therapy.

In a specific embodiment, the nucleic acid molecules are directly administered in vivo, where it is expressed to produce the encoded product. This can be accomplished by any of numerous methods known in the art, e.g., by constructing them as part of an appropriate nucleic acid expression vector and administering it so that they become intracellular, e.g., by infection using defective or attenuated retrovirals or other viral vectors (see U.S. Pat. No. 4,980, 286), or by direct injection of naked DNA, or by use of microparticle bombardment (e.g., a gene gun; Biolistic, Dupont), or coating with lipids or cell-surface receptors or transfecting agents, encapsulation in liposomes, microparticles, or microcapsules, or by administering them in linkage to a peptide which is known to enter the nucleus, by administering it in linkage to a ligand subject to receptor-mediated endocytosis (see, e.g., Wu and Wu, J. Biol. Chem. 262:4429-4432 (1987)) (which can be used to target cell types specifically expressing the receptors), etc. In another embodiment, nucleic acid-ligand complexes can be formed in which the ligand comprises a fusogenic viral peptide to disrupt endosomes, allowing the nucleic acid to avoid lysosomal degradation. In yet another embodiment, the nucleic acid can be targeted in vivo for cell specific uptake and expression, by targeting a specific receptor (see, e.g., PCT Publications WO 92/06180; WO 92/22635; WO92/20316; WO93/14188, WO 93/20221). Alternatively, the nucleic acid can be introduced intracellularly and incorporated within host cell DNA for expression, by homologous recombination (Koller and Smithies, Proc. Natl. Acad. Sci. USA 86:8932-8935 (1989); Zijistra et al., Nature 342:435-438 (1989)).

In a specific embodiment, viral vectors that contain nucleic acid sequences encoding an antibody of the invention are used. For example, a retroviral vector can be used (see Miller et al., Meth. Enzymol. 217:581-599 (1993)). These retroviral vectors contain the components necessary for the correct packaging of the viral genome and integration into the host cell DNA. The nucleic acid molecules encoding the antibody to be used in gene therapy are cloned into one or more vectors, which facilitates the delivery of the gene into a patient. More detail about retroviral vectors can be found in Boesen et al., Biotherapy 6:291-302 (1994).

Adenoviruses may also be used in the present invention. Another approach to gene therapy involves transferring a gene to cells in tissue culture by such methods as electroporation, lipofection, calcium phosphate mediated transfection, or viral infection. Usually, the method of transfer includes the transfer of a selectable marker to the cells. The cells are then placed under selection to isolate those cells that have taken up and are expressing the transferred gene. Those cells are then delivered to a patient.

In this embodiment, the nucleic acid molecule is introduced into a cell prior to administration in vivo of the resulting recombinant cell. Such introduction can be carried out by any method known in the art, including but not limited to transfection, electroporation, microinjection, infection with a viral or bacteriophage vector containing the nucleic acid sequences, cell fusion, chromosome-mediated gene transfer, microcell-mediated gene transfer, spheroplast fusion, etc. Numerous techniques are known in the art for the introduction of foreign genes into cells (see, e.g., Loeffler and Behr, Meth. Enzymol. 217:599-618 (1993)) and may be used in accordance with the present invention, provided that the necessary developmental and physiological functions of the recipient cells are not disrupted. The technique should provide for the stable transfer of the nucleic acid to the cell, so that the nucleic acid is expressible by the cell and preferably heritable and expressible by its cell progeny. The resulting recombinant cells can be delivered to a patient by various methods known in the art. Recombinant blood cells (e.g., hematopoietic stem or progenitor cells) are preferably administered intravenously. The amount of cells envisioned for use depends on the desired effect, patient state, etc., and can be determined by one skilled in the art.

Cells into which a nucleic acid can be introduced for purposes of gene therapy encompass any desired, available cell type, and include but are not limited to epithelial cells, endothelial cells, keratinocytes, fibroblasts, muscle cells, hepatocytes; blood cells such as T lymphocytes, B lymphocytes, monocytes, macrophages, neutrophils, eosinophils, megakaryocytes, granulocytes; various stem or progenitor cells, in particular hematopoietic stem or progenitor cells, e.g., as obtained from bone marrow, umbilical cord blood, peripheral blood, fetal liver, etc.

In a one embodiment, the cell used for gene therapy is autologous to the patient. Nucleic acid sequences encoding an antibody of the present invention are introduced into the cells such that they are expressible by the cells or their progeny, and the recombinant cells are then administered in vivo for therapeutic effect. In a specific embodiment, stem or progenitor cells are used. Any stem and/or progenitor cells which can be isolated and maintained in vitro can potentially be used in accordance with this embodiment of the present invention (see e.g. PCT Publication WO 94/08598; Stemple and Anderson, Cell 71:973-985 (1992); Rheinwald, Meth. Cell Bio. 21A:229 (1980); and Pittelkow and Scott, Mayo Clinic Proc. 61:771 (1986)).

Dosages

The compositions are to be used for in vivo administration to a subject by any available means, such as parenteral administration. For administration to a subject, a composition or medicament described herein can be sterile, which can readily accomplished by filtration through sterile filtration membranes, or other methods known to those of skill in the art. In one embodiment, a composition of medicament has been treated to be free of pyrogens or endotoxins. Testing pharmaceutical compositions or medicaments for pyrogens or endotoxins and preparing pharmaceutical compositions or medicaments free of pyrogens or endotoxins, or preparing pharmaceutical compositions or medicaments that have endotoxins at a clinically-acceptable level, are well understood to one of ordinary skill in the art. Commercial kits are available to test pharmaceutical compositions or medicaments for pyrogens or endotoxins.

The antibodies or antigen binding fragments thereof, describe herein, are formulated, dosed, and administered in a fashion consistent with good medical practice. Factors for consideration in this context include the particular disorder being treated, the particular subject being treated, the clinical condition of the individual subject, the cause of the disorder, the site of delivery of the agent, the method of administration, the scheduling of administration, and other factors known to medical practitioners. The "therapeutically effective amount" to be administered will be governed by such considerations, and refers to the minimum amount necessary to ameliorate, treat, or stabilize, the cancer; to increase the time until progression (duration of progression free survival) or to treat or prevent the occurrence or recurrence of a tumor, a dormant tumor, or a micrometastases. The antibodies or antigen binding fragment thereof, disclosed herein, is optionally formulated with one or more additional therapeutic agents currently used to prevent or treat cancer or a risk of developing a cancer. The effective amount of such other agents depends on the amount of antibody or antigen binding fragment thereof present in the formulation, the type of disorder or treatment, and other factors discussed above. These are generally used in the same dosages and with administration routes as used herein before or about from 1 to 99% of the heretofore employed dosages.

The dose of antibody may vary depending upon the age and the size of a subject to be administered, target disease, conditions, route of administration, and the like. The preferred dose is typically calculated according to body weight or body surface area. When an antibody or antigen binding fragment thereof disclosed herein is used for treating a condition or disease in an adult patient, it may be advantageous to intravenously administer the antibody of the present invention normally at a single dose of about 0.01 to about 20 mg/kg body weight, more preferably about 0.02 to about 7, about 0.03 to about 5, or about 0.05 to about 3 mg/kg, about 5 mg/kg, about 7.5 mg/kg, about 10 mg/kg, or about 15 mg/kg body weight. Depending on the severity of the condition, the frequency and the duration of the treatment can be adjusted. Effective dosages and schedules for administering may be determined empirically; for example, patient progress can be monitored by periodic assessment, and the dose adjusted accordingly. Moreover, interspecies scaling of dosages can be performed using well-known methods in the art (e.g., Mordenti et al., 1991, Pharmaceut. Res. 8:1351).

Advantageously, the pharmaceutical compositions for oral or parenteral use described above are prepared into dosage forms in a unit dose suited to fit a dose of the active ingredients. Such dosage forms in a unit dose include, for example, tablets, pills, capsules, injections (ampoules), suppositories, etc.

The administration can be, for example, by one or more separate administrations, or by continuous infusion. For repeated administrations over several days or longer, depending on the condition, the treatment is sustained until, for example, the cancer is treated, as measured by the methods known in the art. However, other dosage regimens can be useful. In one non-limiting example, an antibody or antigen binding fragment thereof, disclosed herein is administered once every week, every two weeks, or every three weeks, at a dose range from about 5 mg/kg to about 15 mg/kg, including but not limited to 5 mg/kg, 7.5 mg/kg, 10 mg/kg or 15 mg/kg. The progress of using the methods described herein can be easily monitored by conventional techniques and assays. The duration of a therapy using the methods described herein will continue for as long as medically indicated or until a desired therapeutic effect (e.g., those described herein) is achieved. In certain embodiments, the administration of one or more antibodies or antigen binding fragment thereof, or compositions, described herein, is continued for 1 month, 2 months, 4 months, 6 months, 8 months, 10 months, 1 year, 2 years, 3 years, 4 years, 5 years, 10 years, 20 years, or for a period of years up to the lifetime of the subject.

Efficacy of Treatment

The efficacy of the treatment methods for cancer, comprising administering the antibodies or antigen binding fragment thereof, or pharmaceutical compositions of the present disclosure can be measured by various endpoints commonly used in evaluating cancer treatments, including but not limited to, tumor regression, tumor weight or size shrinkage, time to progression, duration of survival, progression free survival, overall response rate, duration of response, and quality of life. The antibodies or antigen binding fragments thereof disclosed herein can require unique measures and definitions of clinical responses to drugs. In the case of cancers, the therapeutically effective amount of the antibodies, antigen binding fragments thereof disclosed herein or compositions comprising the same can reduce the number of cancer cells; reduce the tumor size; inhibit (i.e., slow to some extent and preferably stop) cancer cell infiltration into peripheral organs; inhibit (i.e., slow to some extent and preferably stop) tumor metastasis; inhibit, to some extent, tumor growth; and/or relieve to some extent one or more of the symptoms associated with the disorder. To the extent the antibodies or antigen binding fragment thereof, disclosed herein, act to prevent growth and/or kill existing cancer cells; it can be cytostatic and/or cytotoxic. For cancer therapy, efficacy in vivo can, for example, be measured by assessing the duration of survival, duration of progression free survival (PFS), the response rates (RR), duration of response, and/or quality of life.

In those embodiments related to the treatment or prevention of bladder cancer (e.g., bladder urothelial carcinoma), symptoms associated with bladder cancer include, but are not limited to, lower back pain, blood in the urine, painful or frequent urination, and weight loss.

In those embodiments related to the treatment or prevention of brain cancer (e.g., low-grade glioma), symptoms associated with brain cancer include, but are not limited to, headaches, vomiting, and seizures. Visual loss can be caused by glioma of the optic nerve. Pain, weakness or numbness in the extremities can be caused by spinal cord glioma. Poor reasoning, inappropriate social behavior, personality changes, poor planning, lower inhibition, and decreased production of speech can occur, for example, due to tumor in the frontal lobe. Poor memory, loss of hearing, difficulty in language comprehension can occur, for example, due to tumor in the temporal lobe. Poor interpretation of languages and difficulty speaking, difficulty writing, drawing, naming, and recognizing, and poor spatial and visual perception can occur, for example, due to tumor in the parietal lobe. Poor balance, muscle movement, and posture can occur, for example, due to tumor in the cerebellum. Seizures, endocrine problems, respiratory changes, visual changes, headaches and partial paralysis can occur, for example, due to brain stem tumor.

In those embodiments related to the treatment or prevention of breast cancer, symptoms associated with breast cancer include, but are not limited to, new lumps in the breast or underarm (armpit); swelling of all or part of a breast (even if no distinct lump is felt), armpit, or collarbone; skin irritation or dimpling (sometimes looking like an orange peel), breast or nipple pain, nipple retraction (turning inward), redness, discoloration, scaliness, flaking, or thickening of the nipple or breast skin, nipple discharge (other than breast milk), tingling, itching, increased sensitivity, burning, pain, tenderness of the breast or nipple, and fibroadenoma.

In those embodiments related to the treatment or prevention of cervical cancer, symptoms associated with cervical cancer include, but are not limited to, blood spots or light bleeding between or following periods, menstrual bleeding that is longer and heavier than usual, bleeding after intercourse, douching, or a pelvic examination, increased vaginal discharge, pain during sexual intercourse, bleeding after menopause, and unexplained, persistent pelvic and/or back pain.

In those embodiments related to the treatment or prevention of cholangiocarcinoma, symptoms associated with cholangiocarcinoma include, but are not limited to, abdominal pain, yellowing of skin and the whites of eyes (jaundice), intensely itchy skin, white-colored stools, fatigue, unintended weight loss.

In those embodiments related to the treatment or prevention of colorectal cancer, symptoms associated with colorectal cancer include, but are not limited to, a change in bowel habits such as diarrhea, constipation, or narrowing of the stool that lasts for more than a few days, rectal bleeding, dark stools, or blood in the stool, cramping or gnawing stomach pain, decreased appetite, vomiting, weight loss, weakness and fatigue, Jaundice-yellowing of the skin and eyes, a feeling that the bowel does not empty properly after a bowel movement, blood in feces that makes stools look black, bright red blood coming from the rectum, pain and bloating in the abdomen, a feeling of fullness in the abdomen, even after not eating for a while, a lump in the abdomen or the back passage felt by your doctor, and unexplained iron deficiency in men, or in women after menopause.

In those embodiments related to the treatment or prevention of esophageal cancer, symptoms associated with esophageal cancer include, but are not limited to, dysphagia, vomiting, weight loss, cough, voice changes, pain and discomfort, acid reflux, chest pain, difficulty and pain with swallowing, enlarged lymph nodes around the collarbone, pain behind the breastbone or in the throat, nausea, regurgitation of food, and vomiting of blood.

In those embodiments related to the treatment or prevention of head and neck squamous cell carcinoma, symptoms associated with head and neck squamous cell carcinoma include, but are not limited to, swelling or a sore that does not heal; this is the most common symptom, red or white patch in the mouth, lump, bump, or mass in the head or neck area, with or without pain, persistent sore throat, foul mouth odor not explained by hygiene, hoarseness or change in voice, nasal obstruction or persistent nasal congestion, frequent nose bleeds and/or unusual nasal discharge, difficulty breathing, double vision, numbness or weakness of a body part in the head and neck region, pain or difficulty chewing, swallowing, or moving the jaw or tongue, jaw pain, blood in the saliva or phlegm, which is mucus discharged into the mouth from respiratory passages, loosening of teeth, dentures that no longer fit, unexplained weight loss, fatigue, and ear pain or infection.

In those embodiments related to the treatment or prevention of kidney cancer, symptoms associated with kidney cancer include, but are not limited to, blood in the urine, a lump in the abdomen, loss of appetite and/or unexpected weight loss, anemia, fatigue, a high temperature, heavy sweating, elevated blood calcium levels and hypertension.

In those embodiments related to the treatment or prevention of liver cancer, symptoms associated with liver cancer include, but are not limited to, abdominal discomfort, pain, and tenderness, yellowing of the skin and the whites of the eyes, which is called jaundice, white, chalky stools, nausea, vomiting, bruising or bleeding easily, weakness, fatigue, liver enlargement, itching, abdominal mass, fever, anemia, emesis, back pain, enlarged spleen, and swollen legs.

In those embodiments related to the treatment or prevention of lung cancer, symptoms associated with lung cancer include, but are not limited to coughing, especially if it persists or becomes intense, pain in the chest, shoulder, or back unrelated to pain from coughing, a change in color or volume of sputum, shortness of breath, changes in the voice or being hoarse, harsh sounds with each breath (stridor), recurrent lung problems, such as bronchitis or pneumonia, coughing up phlegm or mucus, especially if it is tinged with blood, coughing up blood, loss of appetite or unexplained weight loss, muscle wasting (also known as cachexia), fatigue, headaches, bone or joint pain, bone fractures not related to accidental injury, neurological symptoms, such as unsteady gait or memory loss, neck or facial swelling, general weakness, bleeding, blood clots, chest pain, bone pain, superior vena cava obstruction, and difficulty swallowing.

In those embodiments related to the treatment or prevention of mesothelioma, symptoms associated with mesothelioma include, but are not limited to, anemia, blood clotting disorder, bowel obstruction, chest pain, persistent dry cough, persistent raspy cough, coughing up blood (hemoptysis), shortness of breath (dyspnea), pain in the lower back or rib area, chest wall pain, painful breathing, development of lumps under the skin on the chest, difficulty with swallowing (dysphagia), night sweats, fever, nausea, unexplained weight loss, fatigue, swollen abdomen, abdomen effusion, pericardium effusion, peritoneal effusion, pleural effusion, or a combination thereof.

In some embodiments related to the treatment of a cystadenocarcinoma, the cancer comprises a serous cystadenocarcinoma such as, for example, an ovarian serous cystadenocarcinoma. In those embodiments related to the treatment or prevention of an ovarian serous cystadenocarcinoma, symptoms associated with an cystadenocarcinoma include, but are not limited to, abdominal pain, abdominal swelling, increased abdominal girth, bloating, ascites, nausea, vomiting, unusual bowel movement, anorexia, weight loss, fatigue, or a combination thereof.

In those embodiments related to the treatment or prevention of a pancreatic cancer such as, for example, a pancreatic adenocarcinoma (PAAD), symptoms associated with pancreatic cancer include, but are not limited to, abdominal pain, mid-back pain, boating, constipation, diarrhea, poor appetite, difficulty digesting food, nausea, vomiting, gall bladder enlargement, liver enlargement, blood clots, jaundice {e.g., dark urine, light colored greasy stools, itching skin, or a combination thereof), weight loss, or a combination thereof. Weight loss can arise from anorexia, maldigestion from pancreatic ductal obstruction, and cachexia. Occasionally, pancreatic duct obstruction can result in attacks of pancreatitis. Deep and superficial venous thrombosis is, in some embodiments, also a symptom of pancreatic cancer, and can be a sign of malignant disease. Gastric outlet obstruction with nausea and vomiting sometimes happens with more advanced disease. In some embodiments, symptoms of pancreatic cancer to be inhibited or treated using the compositions and methods described herein include, but are not limited to, panniculitis and depression. In some embodiments, symptoms of pancreatic cancer to be inhibited or treated using the compositions and methods described herein include, but are not limited to, diabetes mellitus and/or impaired glucose tolerance.

In those embodiments related to the treatment or prevention of a pheochromocytoma, paraganglioma, or a combination thereof, symptoms associated with a pheochromocytoma, a paraganglioma, or a combination thereof include, but are not limited to, high blood pressure, heavy sweating, headache, rapid heartbeat (tachycardia), tremors, paleness in the face (pallor), shortness of breath (dyspnea), anxiety or sense of doom, constipation, weight loss, flushed skin, sweating, or a combination thereof.

In those embodiments related to the treatment or prevention of a prostate adenocarcinoma, symptoms associated with a prostate adenocarcinoma include, but are not limited to, trouble urinating; decreased force or interrupted flow in the stream of urine; a need to urinate frequently, especially at night, some-times urgently; difficulty starting or holding back urination; blood in semen; blood in urine; discomfort in the pelvic area; bone pain (e.g., pain in the back, hips, thighs, pelvis, shoulders, or other bones); erectile dysfunction; painful or burning urination; a decrease in the amount of fluid ejaculated; painful ejaculation; swelling or fluid buildup in the legs or feet; unexplained weight loss; fatigue; change in bowel habits; pressure or pain in the rectum; or a combination thereof.

In those embodiments related to the treatment or prevention of a sarcoma, symptoms associated with a sarcoma include, but are not limited to, a new lump or a lump that's growing anywhere on a subject's body; abdominal pain; blood in stool or vomit; black, tarry stools; or a combination thereof. When sarcomas grow in the back of the abdomen (the retroperitoneum), symptoms may also, or alternatively, include, but are not limited to, blockage or bleeding of the stomach or bowels; pain from the sarcoma pressing on nerves, blood vessels, or nearby organs; or a combination thereof.

In those embodiments related to the treatment or prevention of a melanoma, symptoms associated with a melanoma such as a skin cutaneous melanoma include, but are not limited to, a change in an existing mole (e.g., a mole with an asymmetrical shape, an irregular border, changes in color, changes in diameter, an evolving mole, itchiness, bleeding, or a combination thereof); development of a new pigmented or unusual-looking growth on a subject's skin; a sore that doesn't heal; spread of pigment from the border of a spot into surrounding skin; redness or a new swelling beyond the border of a mole; change in sensation, such as itchiness, tenderness, or pain; change in the surface of a mole (e.g., scaliness, oozing, bleeding, or the appearance of a lump or bump); or a combination thereof.

In those embodiments related to the treatment or prevention of an adenocarcinoma such as, for example, a stomach adenocarcinoma, symptoms associated with the adenocarcinoma include, but are not limited to, fatigue; feeling bloated after eating; feeling full after eating small amounts of food; a sensation of being very full during meals; swallowing difficulties (dysphagia); frequent burping; persistent and/or severe heartburn; persistent and/or severe indigestion; unexplained and/or persistent nausea; stomach pain; pain in the breastbone; persistent vomiting; vomiting which contains blood; unintentional or unexpected weight loss; breathlessness; gastritis, inflammation of the lining of the stomach; anemia; a history of stomach ulcers; a buildup of fluid in the stomach which may cause the stomach to feel lumpy; black stools that contain blood; loss of appetite; or a combination thereof.

In those embodiments related to the treatment or prevention of testicular cancer, symptoms associated with testicular cancer include, but are not limited to, a lump or enlargement in either, or both, testicle(s); a feeling of heaviness in the scrotum; a dull ache in the abdomen, tenderness in the abdomen; pain in the abdomen; a dull ache in the groin; a sudden collection of fluid in the scrotum; pain or discomfort in a testicle; pain or discomfort in the scrotum; enlargement of the breast tissue; tenderness of the breast tissue; back pain, early puberty in boys; shortness of breath; chest pain; a cough; headaches, confusion, or a combination thereof.

In those embodiments related to the treatment or prevention of a carcinoma such as a thyroid carcinoma, symptoms associated with a carcinoma include, but are not limited to, a lump in the neck; swelling in the neck; pain in the neck, sometimes going up to the ears; pain in the throat; hoarseness that does not go away; voice changes that do not go away; difficulty swallowing; trouble breathing; a constant cough that is not due to a cold; swollen lymph nodes in the neck; or a combination thereof.

In those embodiments related to the treatment or prevention of a uterine cancer, symptoms associated with a uterine cancer such as a uterine carcinosarcoma (UCS), a uterine corpus endometrial carcinoma (UCEC), or a combination thereof, include, but are not limited to, abnormal bleeding or spotting; vaginal discharge; vaginal bleeding after menopause; bleeding between periods, pelvic pain; a pelvic mass; or a combination thereof.

In those embodiments related to the treatment or prevention of a uveal melanoma, symptoms associated with a uveal melanoma include, but are not limited to, a sensation of flashes or specks of dust in your vision (floaters); a growing dark spot on the iris; a change in the shape of the dark circle (pupil) at the center of an eye; poor or blurry vision in an eye; loss of peripheral vision; or a combination thereof.

In some embodiments, one or more symptoms of a cancer can be inhibited or treated using the compositions and methods described herein. In other embodiments, described herein are methods for increasing progression free survival of a human subject susceptible to or diagnosed with a cancer. Time to disease progression is defined as the time from administration of the drug until disease progression or death. In a preferred embodiment, the combination treatment of the invention using an antibody or antigen binding fragment thereof, disclosed herein, and one or more chemotherapeutic agents may significantly increase progression free survival by at least about 1 month, 1.2 months, 2 months, 2.4 months, 2.9 months, 3.5 months, such as by about 1 to about 5 months, when compared to a treatment with chemotherapy alone. In another embodiment, the methods described herein may significantly increase response rates in a group of human subjects susceptible to or diagnosed with a cancer that are treated with various therapeutics. Response rate is defined as the percentage of treated subjects who responded to the treatment. In one embodiment, the combination treatment described herein using an antibody or antigen binding fragment thereof, disclosed herein, such as a recombinant antibody or antigen binding fragment thereof, and one or more chemotherapeutic agents significantly increases response rate in the treated subject group compared to the group treated with chemotherapy alone.

For example, for pancreatic cancer therapies, CT is the standard method for measurement of tumor burden, and clinical trials usually use RECIST (response evaluation criteria in solid tumors) criteria to gauge tumor response. In some embodiments related to treatment can be used to predict treatment response or disease relapse.

As used herein, the terms "treat," "treatment," "treating," or "amelioration" refer to therapeutic treatments, wherein the object is to reverse, alleviate, ameliorate, inhibit, slow down or stop the progression or severity of a condition associated with, a disease or disorder. The term "treating" includes reducing or alleviating at least one adverse effect or symptom of a condition, disease or disorder associated with a chronic immune condition, such as, but not limited to, a chronic infection or a cancer. Treatment is generally "effective" if one or more symptoms or clinical markers are reduced. Alternatively, treatment is "effective" if the progression of a disease is reduced or halted. That is, "treatment" includes not just the improvement of symptoms or markers, but also a cessation of at least slowing of progress or worsening of symptoms that would be expected in absence of treatment. Beneficial or desired clinical results include, but are not limited to, alleviation of one or more symptom(s), diminishment of extent of disease, stabilized (i.e., not worsening) state of disease, delay or slowing of disease progression, amelioration or palliation of the disease state, and remission (whether partial or total), whether detectable or undetectable. The term "treatment" of a disease also includes providing relief from the symptoms or side-effects of the disease (including palliative treatment).

For example, in some embodiments, the methods described herein comprise administering an effective amount of the antibodies or antigen binding fragment thereof, described herein, to a subject in order to alleviate a symptom of a cancer. As used herein, "alleviating a symptom of a cancer" is ameliorating or reducing any condition or symptom associated with the cancer. As compared with an equivalent untreated control, such reduction or degree of prevention is at least 5%, 10%, 20%, 40%, 50%, 60%, 80%, 90%, 95%, or 100% as measured by any standard technique. Ideally, the cancer is completely cleared as detected by any standard method known in the art, in which case the cancer is considered to have been treated. A patient who is being treated for a cancer is one who a medical practitioner has diagnosed as having such a condition. Diagnosis can be by any suitable means. Diagnosis and monitoring can involve, for example, detecting the level of cancer cells in a biological sample (for example, a tissue or lymph node biopsy, blood test, or urine test), detecting the level of a surrogate marker of the cancer in a biological sample, detecting symptoms associated with the specific cancer, or detecting immune cells involved in the immune response typical of such a cancer.

The term "effective amount" as used herein refers to the amount of an antibody or antigen binding fragment thereof or composition comprising the same needed to alleviate at least one or more symptom of the disease or disorder, and relates to a sufficient amount of pharmacological composition to provide the desired effect. The term "therapeutically effective amount" therefore refers to an amount of a recombinant antibody or antigen binding fragment thereof using the methods as disclosed herein, that is sufficient to effect a particular effect when administered to a typical subject. An effective amount as used herein would also include an amount sufficient to delay the development of a symptom of the disease, alter the course of a symptom disease (for example but not limited to, slow the progression of a symptom of the disease), or reverse a symptom of the disease. Thus, it is not possible to specify the exact "effective amount". For any given case, however, an appropriate "effective amount" can be determined by one of ordinary skill in the art using only routine experimentation.

Effective amounts, toxicity, and therapeutic efficacy can be determined by standard pharmaceutical procedures in cell cultures or experimental animals, e.g., for determining the LD50 (the dose lethal to 50% of the population) and the ED50 (the dose therapeutically effective in 50% of the population). The dosage can vary depending upon the dosage form employed and the route of administration utilized. The dose ratio between toxic and therapeutic effects is the therapeutic index and can be expressed as the ratio LD50/ED50—Compositions and methods that exhibit large therapeutic indices are preferred. A therapeutically effective dose can be estimated initially from cell culture assays. Also, a dose can be formulated in animal models to achieve a circulating plasma concentration range that includes the IC50 (i.e., the concentration of the antibody or antigen binding fragment thereof), which achieves a half-maximal inhibition of symptoms as determined in cell culture, or in an appropriate animal model. Levels in plasma can be measured, for example, by high performance liquid chromatography. The effects of any particular dosage can be monitored by a suitable bioassay. The dosage can be determined by a physician and adjusted, as necessary, to suit observed effects of the treatment.

The treatment and/or prevention of cancer includes, but is not limited to, alleviating symptoms associated with cancer, the inhibition of the progression of cancer, the promotion of the regression of cancer, the promotion of the immune response, inhibition of tumor growth, inhibition of tumor size, inhibition of metastasis, inhibition of cancer cell growth, inhibition of cancer cell proliferation, or cause cancer cell death.

The terms "increased", "increase", or "enhance" are all used herein to generally mean an increase by a statically significant amount; for the avoidance of doubt, the terms "increased", "increase", or "enhance", mean an increase of at least 10% as compared to a reference level, for example an increase of at least about 10%, at least about 20%, or at least about 30%, or at least about 40%, or at least about 50%, or at least about 60%, or at least about 70%, or at least about 80%, or at least about 90% or up to and including a 100% increase or any increase between 10-100% as compared to a reference level, or at least about a 2-fold, or at least about a 3-fold, or at least about a 4-fold, or at least about a 5-fold or at least about a 10-fold increase, or any increase between 2-fold and 10-fold or greater as compared to a reference level.

The terms, "decrease", "reduce", "reduction", "lower" or "lowering," or "inhibit" are all used herein generally to mean a decrease by a statistically significant amount. For example, "decrease", "reduce", "reduction", or "inhibit" means a decrease by at least 10% as compared to a reference level, for example a decrease by at least about 20%, or at least about 30%, or at least about 40%, or at least about 50%, or at least about 60%, or at least about 70%, or at least about 80%, or at least about 90% or up to and including a 100% decrease (e.g., tumor size after treatment as compared to a reference level prior to the treatment), or any decrease between 10-100% as compared to a reference level. In the context of a marker or symptom, by these terms is meant a statistically significant decrease in such level. The decrease can be, for example, at least 10%, at least 20%, at least 30%, at least 40% or more, and is preferably down to a level accepted as within the range of normal for an individual without a given disease. Reduce or inhibit can refer to, for example, the symptoms of the disorder being treated, the presence or size of metastases or micrometastases, the size of the primary tumor, the presence or the size of the dormant tumor.

Modes of Administration

The antibodies or antigen binding fragment thereof, described herein, can be administered to a subject in need thereof by any appropriate route which results in an effective treatment in the subject. As used herein, the terms "administering," and "introducing" are used interchangeably and refer to the placement of an antibody or antibody portion thereof into a subject by a method or route which results in at least partial localization of such agents at a desired site, such as a site of inflammation or cancer, such that a desired effect(s) is produced.

In some embodiments, the antibodies or antigen binding fragment thereof, described herein, or compositions comprising the same is administered to a subject having a cancer, to be inhibited by any mode of administration that delivers the agent systemically or to a desired surface or target, and can include, but is not limited to, injection, infusion, instillation, and inhalation administration. Oral administration forms are also contemplated herein. "Injection" includes, without limitation, intravenous, intramuscular, intraarterial, intrathecal, intraventricular, intracapsular, intraorbital, intracardiac, intradermal, intraperitoneal, transtracheal, subcutaneous, subcuticular, intraarticular, sub capsular, subarachnoid, intracranial, intraspinal, intracerebro spinal, and intrasternal injection and infusion.

The phrases "parenteral administration" and "administered parenterally" as used herein, refer to modes of administration other than enteral and topical administration, usually by injection. The phrases "systemic administration," "administered systemically", "peripheral administration" and "administered peripherally" as used herein refer to the administration of the bispecific or multispecific polypeptide agent other than directly into a target site, tissue, or organ, such as a tumor site, such that it enters the subject's circulatory system and, thus, is subject to metabolism and other like processes.

In some embodiments, the antibodies, or antigen binding fragment thereof, described herein, or compositions comprising the same can be administered via intravenous administration as a bolus or by continuous infusion over a period of time, by intramuscular, intraperitoneal, intracerebrospinal, subcutaneous, intra-articular, intrasynovial, intrathecal, oral, topical, or inhalation routes. Local administration, for example, to a tumor or cancer site where angiogenesis is occurring, is particularly desired if extensive side effects or toxicity is associated with the use of the antibodies, or antigen binding fragment thereof, described herein, or compositions comprising the same. An ex vivo strategy can also be used for therapeutic applications in some embodiments. Ex vivo strategies involve transfecting or transducing cells obtained from a subject with a nucleic acid sequence, disclosed herein. The transfected or transduced cells are then returned to the subject. The cells can be any of a wide range of types including, without limitation, hematopoietic cells (e.g., bone marrow cells, macrophages, monocytes, dendritic cells, T cells, or B cells), fibroblasts, epithelial cells, endothelial cells, keratinocytes, or muscle cells.

In some embodiments, an antibody or antigen binding fragment thereof, disclosed herein, or a composition comprising the same is administered by any suitable means, including parenteral, subcutaneous, intraperitoneal, intrapulmonary, and intranasal, and, if desired for local immunosuppressive treatment, intralesional administration. Parenteral infusions include intramuscular, intravenous, intraarterial, intraperitoneal, or subcutaneous administration. In some embodiments, the antibody or antigen binding fragment thereof or compositions of the disclosure are suitably administered by pulse infusion, particularly with declining doses of the antibody. Preferably the dosing is given by injections, most preferably intravenous or subcutaneous injections, depending in part on whether the administration is brief or chronic. In some embodiments, the antibody or antigen binding fragment thereof or compositions of the disclosure are administered locally, e.g., by direct injections, when the disorder or location of the tumor permits, and the injections can be repeated periodically. In some embodiments, the antibody or antigen binding fragment thereof or compositions of the disclosure can also be delivered systemically to the subject or directly to the tumor cells, e.g., to a tumor or a tumor bed following surgical excision of the tumor, in order to prevent or reduce local recurrence or metastasis, for example of a dormant tumor or micrometastases.

Antibody-targeted sonoporation methods are contemplated for use in some embodiments of the methods for inhibiting tumors described herein, in order to enhance the efficacy and potency of the therapeutic compositions comprising antibodies and antigen binding fragment thereof provided herein. As used herein, "sonoporation" refers to the use of sound, preferably at ultrasonic frequencies, or the interaction of ultrasound with contrast agents (e.g., stabilized microbubbles) for temporarily modifying the permeability of cell plasma membranes, thus allowing uptake of large molecules, such as therapeutic agents. The membrane permeability caused by the sonoporation is transient, leaving the agents trapped inside the cell after the ultrasound exposure. Sonoporation employs acoustic cavitation of microbubbles to enhance delivery of large molecules.

Accordingly, in some embodiments of the methods, the antibody or antigen binding fragment thereof described herein, mixed with ultrasound contrast agents, such as microbubbles, can be injected locally or systemically into a subject in need of treatment for cancer, and ultrasound can be coupled and even focused into the defined area, e.g., tumor site, to achieve targeted delivery. In some embodiments, the methods use focused ultrasound methods to achieve targeted delivery. As used herein, HIFU or "High Intensity Focused Ultrasound" refers to a non-invasive therapeutic method using high-intensity ultrasound to heat and destroy malignant or pathogenic tissue without causing damage to overlying or surrounding health tissue. As described in Khaibullina et al., 49 J. Nucl. Med. 295 (2008), and WO 2010/127369, HIFU can also be used as a means of delivery of therapeutic agents, such as antibodies or antibody fragments thereof.

Methods using contrast-enhanced ultrasound (CEUS) are also contemplated for use with an antibody or antigen binding fragment thereof, described herein. Contrast-enhanced ultrasound (CEUS) refers to the application of ultrasound contrast medium and ultrasound contrast agents to traditional medical sonography. Ultrasound contrast agents refer to agents that rely on the different ways in which sound waves are reflected from interfaces between substances. A variety of microbubble contrast agents are available for use with the compositions and methods described herein. Microbubbles can differ in their shell makeup, gas core makeup, and whether or not they are targeted. Targeting ligands that bind to receptors characteristic of angiogenic disorders, can be conjugated to microbubbles, enabling the microbubble complex to accumulate selectively in areas of interest, such as diseased or abnormal tissues. This form of molecular imaging, known as targeted contrast-enhanced ultrasound, will only generate a strong ultrasound signal if targeted microbubbles bind in the area of interest. Targeted contrast-enhanced ultrasound has many applications in both medical diagnostics and medical therapeutics. In some embodiments, an antibody or antigen binding fragment thereof, described herein, is administered to a subject in need of treatment for a cancer or a tumor, using a targeted ultrasound delivery.

Diagnostic Uses

Provided herein are methods of using the antibodies for detection, diagnosis and monitoring of a disease, disorder or condition associated with the antigen expression (either increased or decreased relative to a normal sample, and/or inappropriate expression, such as presence of expression in tissues(s) and/or cell(s) that normally lack the epitope expression). Provided herein are methods of determining whether a patient will respond to antibody therapy.

In some embodiments, the method comprises detecting whether the patient has cells that express target antigen using an antibody disclosed herein. In some embodiments, the method of detection comprises contacting the sample with an antibody or antigen binding fragment thereof of the disclosure, and determining whether the level of binding differs from that of a reference or comparison sample (such as a control). In some embodiments, the method may be useful to determine whether the antibodies or polypeptides described herein are an appropriate treatment for the subject. In some embodiments, the cells or cell/tissue lysate are contacted with an antibody and the binding between the antibody and the cell is determined. When the test cells show binding activity as compared to a reference cell of the same tissue type, it may indicate that the subject would benefit from treatment with an antibody. In some embodiments, the test cells are from human tissues. In some embodiments, the test cells are from human blood.

Various methods known in the art for detecting specific antibody-antigen binding can be used. Exemplary immunoassays which can be conducted include fluorescence polarization immunoassay (FPIA), fluorescence immunoassay (FIA), enzyme immunoassay (EIA), nephelometric inhibition immunoassay (NIA), enzyme linked immunosorbent assay (ELISA), and radioimmunoassay (RIA). An indicator moiety, or label group, can be attached to the subject antibodies and is selected so as to meet the needs of various uses of the method which are often dictated by the availability of assay equipment and compatible immunoassay procedures. Appropriate labels include, without limitation, radionuclides (for example 125I, 131I, 35S, 3H, or 32P), enzymes (for example, alkaline phosphatase, horseradish peroxidase, luciferase, or β-glactosidase), fluorescent moieties or proteins (for example, fluorescein, rhodamine, phycoerythrin, GFP, or BFP), or luminescent moieties (for example, Qdot™ nanoparticles supplied by the Quantum Dot Corporation, Palo Alto, Calif.). General techniques to be used in performing the various immunoassays noted above are known to those of ordinary skill in the art.

For purposes of diagnosis, the antibodies or antigen binding fragment thereof can be labeled with a detectable moiety including but not limited to radioisotopes, fluorescent labels, and various enzyme-substrate labels know in the art. Methods of conjugating labels to an antibody are known in the art. In some embodiments, the antibodies need not be labeled, and the presence thereof can be detected using a second labeled antibody which binds to the first antibody. The antibodies or antigen binding fragment thereof of the present invention may be used as affinity purification agents for a cancer associated antigen or in diagnostic assays for a cancer associated antigen protein, e.g., detecting its expression in specific cells, tissues, or serum. The antibodies or antigen binding fragment thereof, disclosed herein, may also be used for in vivo diagnostic assays. Generally, for these purposes the antibody is labeled with a radionuclide (such as ulIn, 99Tc, 14C, 131I, 12sI, 3H, 32p or 3sS) so that the tumor can be localized using immunoscintiography.

The antibodies of the present invention may be employed in any known assay method, such as competitive binding assays, direct and indirect sandwich assays, such as ELISAs, and immunoprecipitation assays. Zola, Monoclonal Antibodies: A Manual of Techniques, pp. 147-158 (CRC Press, Inc. 1987). The antibodies may also be used for immunohistochemistry, to label tumor samples using methods known in the art. As a matter of convenience, the antibody of the present invention can be provided in a kit, i.e., a packaged combination of reagents in predetermined amounts with instructions for performing the diagnostic assay. Where the antibody is labeled with an enzyme, the kit will include substrates and cofactors required by the enzyme (e.g., a substrate precursor which provides the detectable chromophore or fluorophore). In addition, other additives may be included such as stabilizers, buffers (e.g., a block buffer or lysis buffer) and the like. The relative amounts of the various reagents may be varied widely to provide for concentrations in solution of the reagents which substantially optimize the sensitivity of the assay. Particularly, the reagents may be provided as dry powders, usually lyophilized, including excipients which on dissolution will provide a reagent solution having the appropriate concentration.

Kits

Provided herein are also kits, medicines, compositions, and unit dosage forms for use in any of the methods described herein. Provided herein is a kit comprising a therapeutically effective amount of at least one of the antibody or antigen binding fragment thereof disclosed herein. In some embodiments, the kit further comprises a second therapeutic agent (e.g., a chemotherapeutic agent). In some embodiments, the antibody or antigen binding fragment thereof is an aqueous form or a lyophilized form. The kit further comprises a diluent or a reconstitution solution.

Kits can include one or more containers comprising an antibody (or unit dosage forms and/or articles of manufacture). In some embodiments, a unit dosage is provided wherein the unit dosage contains a predetermined amount of a composition comprising an antibody (e.g., a therapeutically effective amount), with or without one or more additional agents. In some embodiments, such a unit dosage is supplied in single-use prefilled syringe for injection. In some embodiments, the composition comprising the antibody or antigen binding fragment thereof can comprise saline, sucrose, or the like; a buffer, such as phosphate, or the like; and/or be formulated within a stable and effective pH range. In some embodiments, the antibody or antigen binding fragment thereof can be provided as a lyophilized powder that may be reconstituted upon addition of an appropriate liquid, for example, sterile water. In some embodiments, the antibody or antigen binding fragment thereof further comprises one or more substances that inhibit protein aggregation, including, but not limited to, sucrose and arginine. In some embodiments, the antibody or antigen binding fragment thereof further comprises heparin and/or a proteoglycan.

In some embodiments, kits further comprise instructions for use in the treatment of cancer in accordance with any of the methods described herein. The kit may further comprise a description of selection an individual suitable or treatment. Instructions supplied in the kits are typically written instructions on a label or package insert (for example, a paper sheet included in the kit), but machine-readable instructions (for example, instructions carried on a magnetic or optical storage disk) are also acceptable. In some embodiments, the kit further comprises another therapeutic agent (e.g., an anti-cancer antibody or a chemotherapeutic agent)

The kits are in suitable packaging. Suitable packaging includes, but is not limited to, vials, bottles, jars, flexible packaging (for example, sealed Mylar or plastic bags), and the like. Kits may optionally provide additional components such as buffers and interpretative information. The present application thus also provides articles of manufacture, which include vials (such as sealed vials), bottles, jars, flexible packaging, and the like.

While certain embodiments of the present application have been shown and described herein, it will be obvious that such embodiments are provided by way of example only. Numerous variations, changes, and substitutions may occur to those skilled in the art without departing from the embodiments; it should be understood that various alternatives to the embodiments described herein may be employed in practicing the methods described herein.

EXAMPLES

Provided below are exemplary methods for in silico reconstruction of consensus sequences of cancer associated antibodies. Also described herein are computational analytical approaches for estimation of immunoglobulin repertoire diversity and the identification of clonal rearranged immunoglobulin CDR3 sequences present in the repertoire. The approaches are contemplated for the reconstruction of complete consensus sequences of the variable heavy chain, variable light chain and the respective CDR3 of said immunoglobulins.

Example 1: Estimation of the Immunoglobulin Repertoire Diversity

Figure 1:
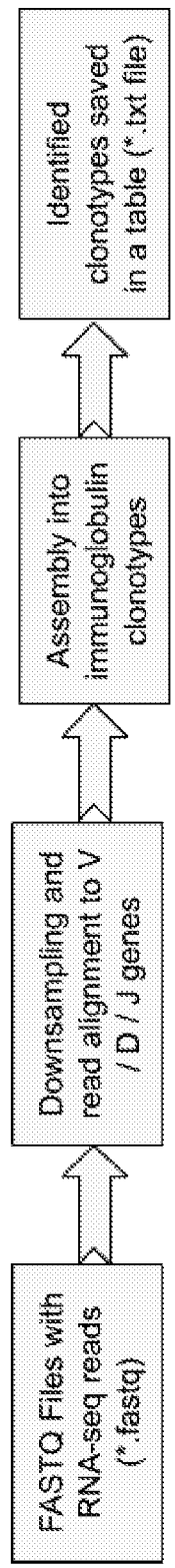
Figure 2:
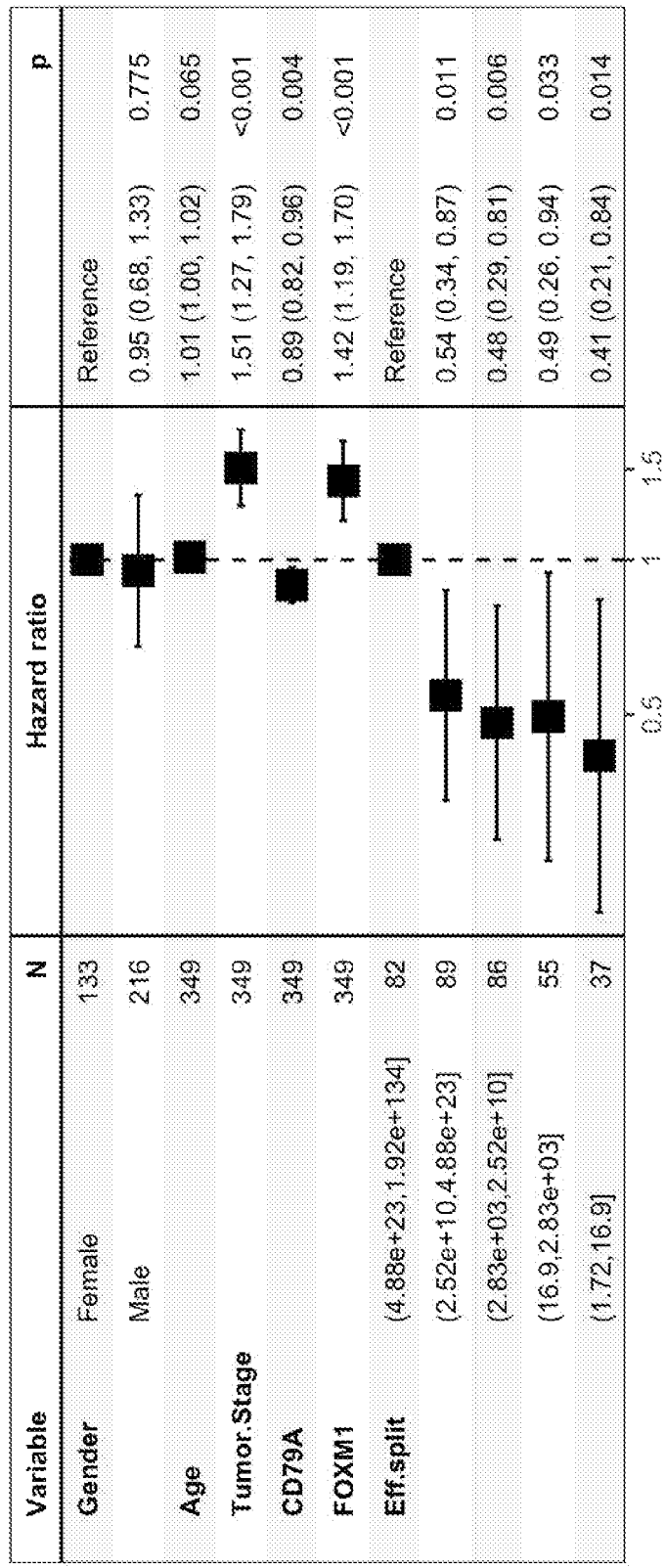
Figure 3A:
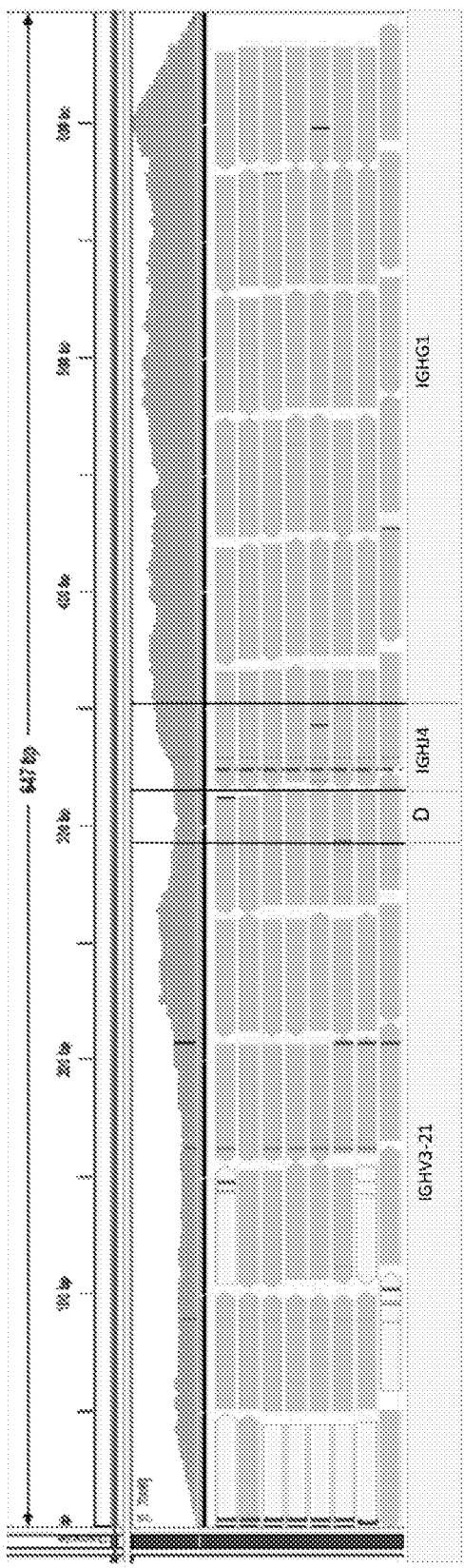
Figure 3B:
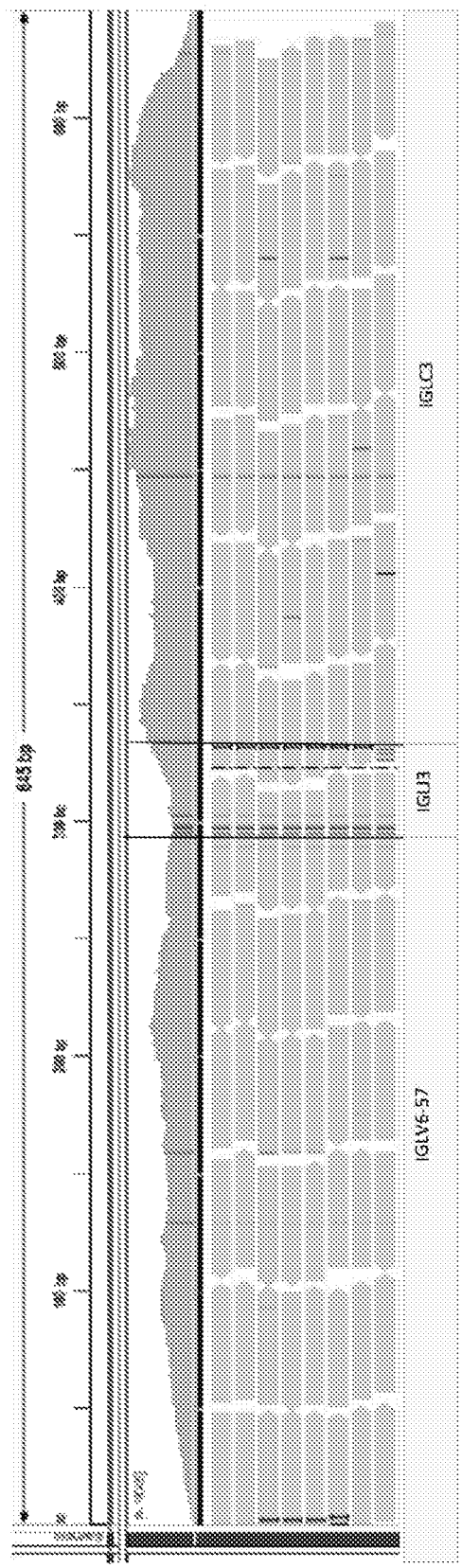
Figure 3C:
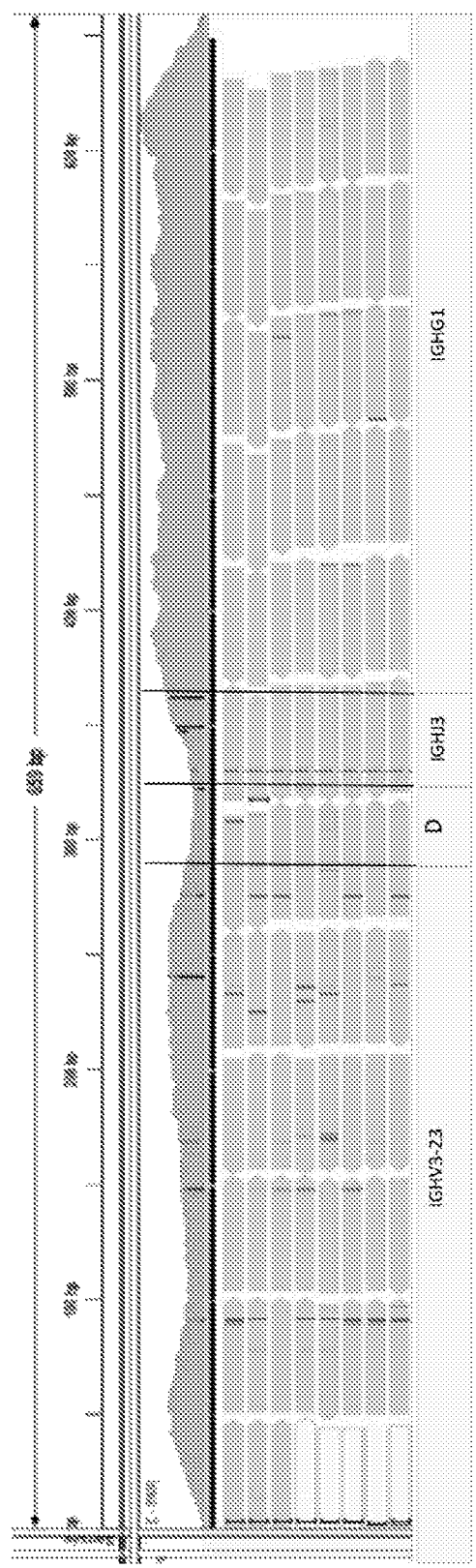
Figure 3D:
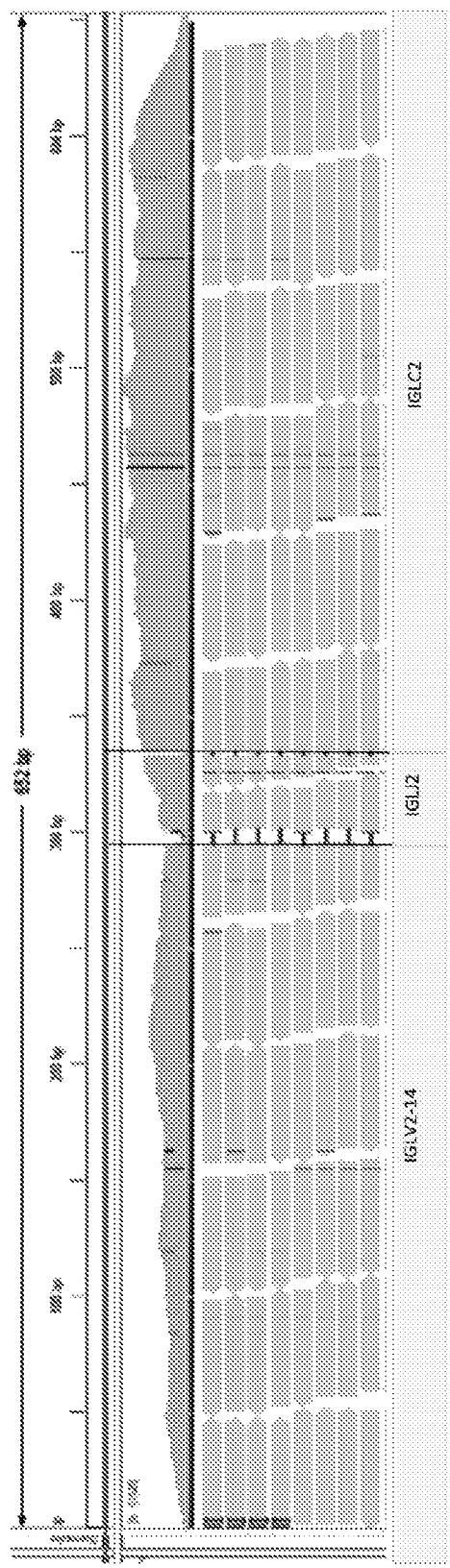
Figure 3E:
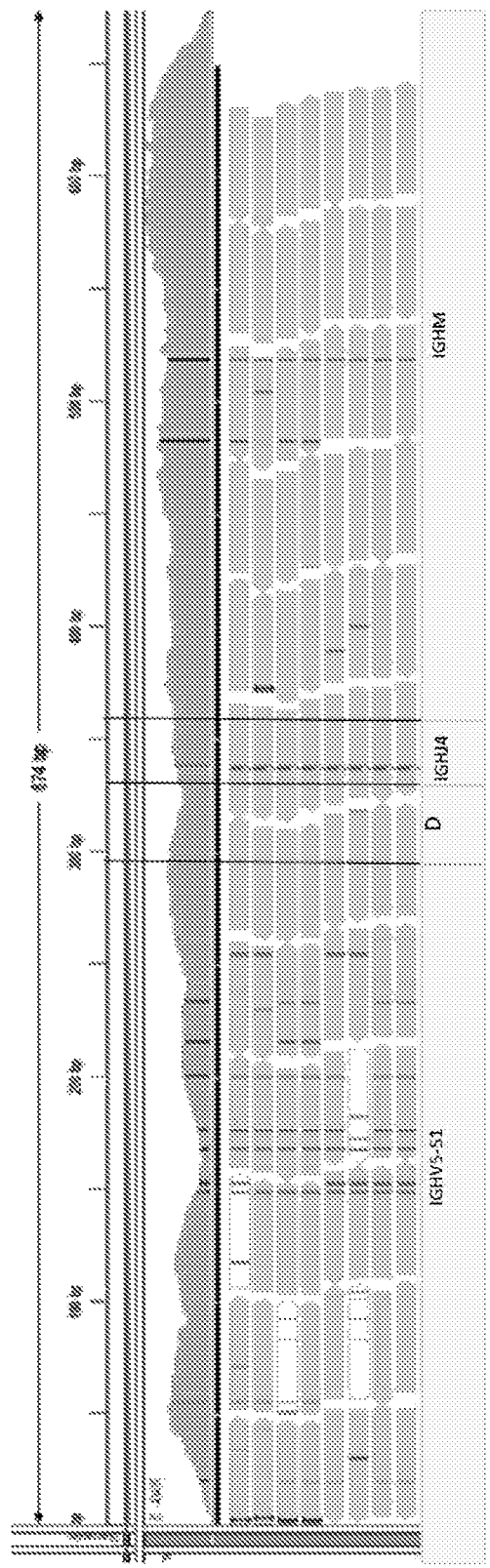
Figure 3F:
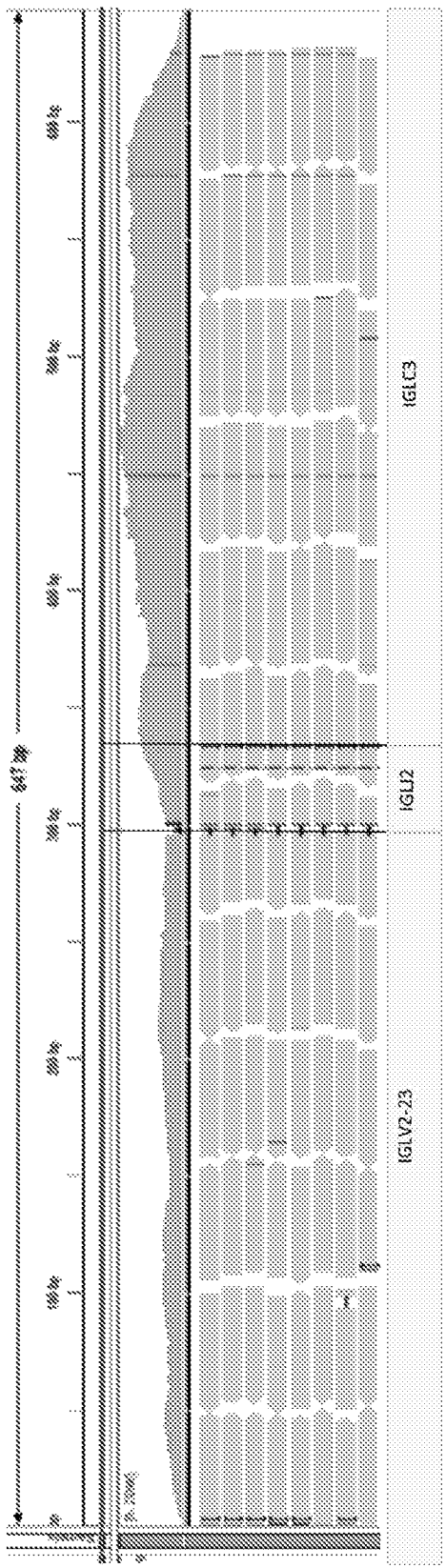
Figure 3G:
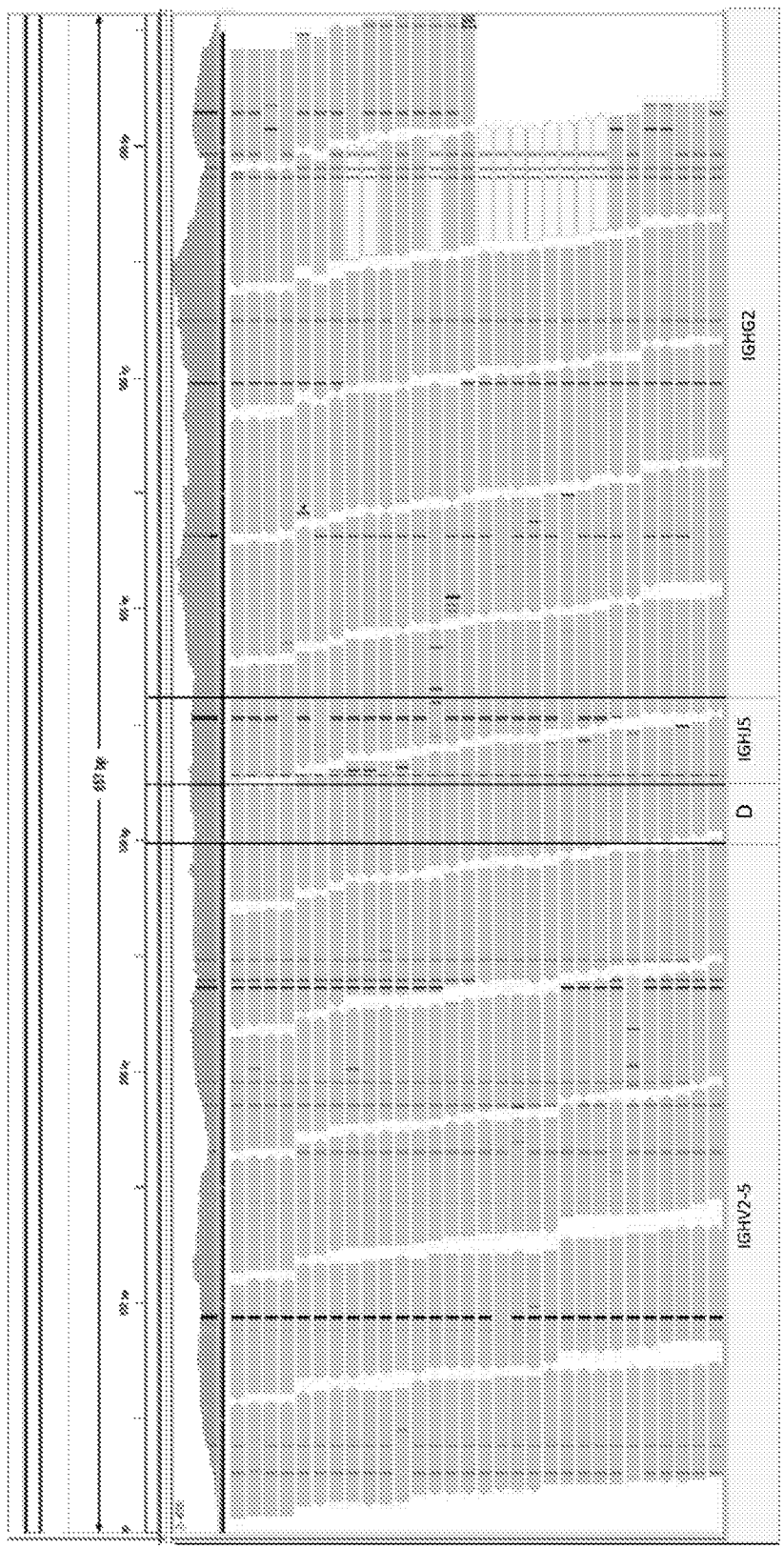
Figure 3H:
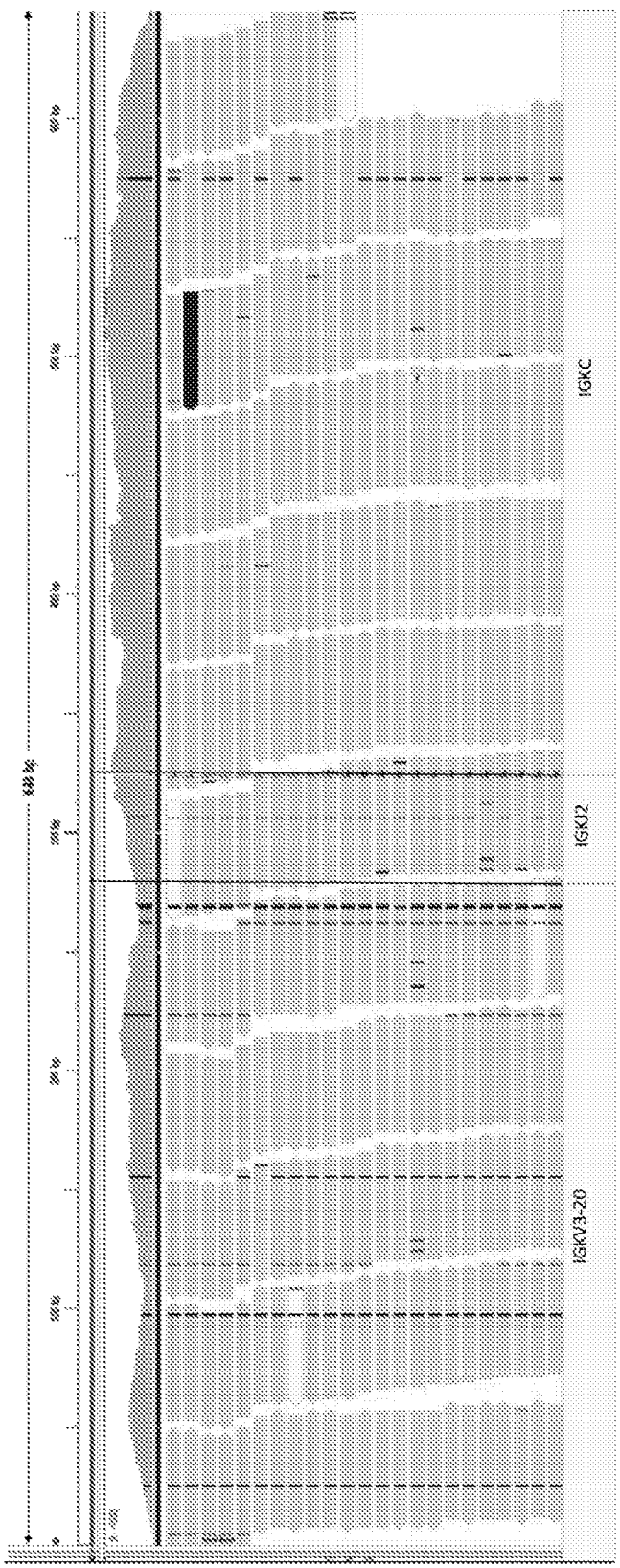
Figure 3I:
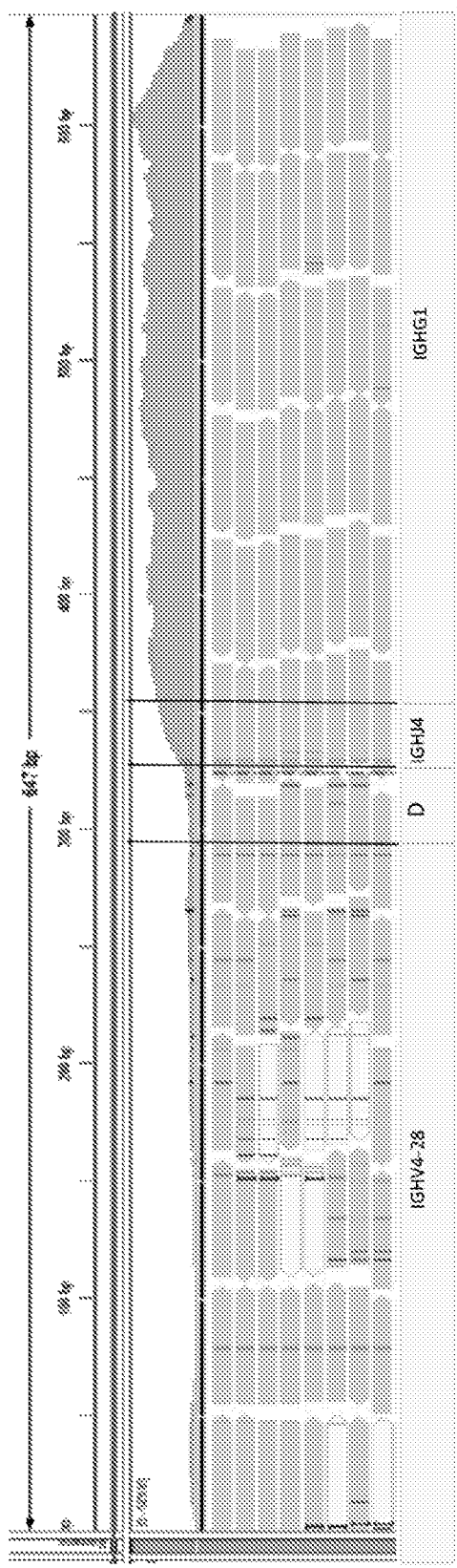
Figure 3J:

RNA-seq FASTQ files for 10177 TCGA patients representative of 30 cancer types collected by TCGA consortium (The Cancer Genome Atlas, NCI &NHGRI) were recorded and analyzed. RNA-seq samples (n=10177) were aligned to reference V, D and J genes of immunoglobulins in order to identify the repertoire present in the samples. Then, identical CDR3 sequences were identified and grouped in clonotypes. The information was exported into a tab-delimited and understandable text file (FIG. 1). From the initial 10177 samples, 4782 samples were eliminated for which there were no reads aligning to immunoglobulin heavy chain genes or the number of reads was lower than the downsampling threshold. In total, the information on immunoglobulin (Ig) diversity from 5395 samples was collected and analyzed.

VDJtools were used to filter out non-functional (non-coding) clonotypes and to compute basic diversity statistics. Non-functional clonotypes were identified as those containing a stop codon or frameshift in their receptor sequence. The diversity of the Ig repertoire was based on the corrected effective number of species which is calculated based on Chao et al., 2013, Methods in Ecology and Evolution, Volume 4, Issue 11. Here, the effective number of species refers the exponent of the Shannon-Wiener Entropy index such that a community of S species with species frequencies p1, pi, . . . , ps, then the diversity (D) is the exponent of the Shannon-Wiener Entropy index (H) given by:

$$D = \exp(H) = \exp\left(-\sum_{i=1}^{s} p_i \ln p_i\right)$$

Example 2: Identification of Clonal Immunoglobulin Sequences

The R software was used on the files obtained from the first alignment step to analyze which samples pass the clonality threshold (eHbc<20). Out of the 5395 samples, 598 pass this threshold. Next, we chose the samples with the correct pairing of heavy and light chains as the two top clonal chains that could be reliably identified. 271 samples were selected for further antibody reconstruction.

Example 3: Alignment and Assembly of VDJ Sequences

Alignments were performed against the immunoglobulin segments identified by the first alignment step for viewing the results, allowing the exploration of the frequency distribution of sequence mismatches along the V, D, J gene segments and in particular in the CDR3 region length statistics. This alignment step was useful for summarizing repertoires, as well as offering a detailed view of rearrangements and region alignments for individual query sequences. More details about the alignment and assembly methodology are given in the Example 5 below.

In brief, the identified segments by first alignment step from IMGT were first provided using the reference files provided in the BraCeR tool. The heavy D segment and light V-J junction sequences were then reconstructed using an in-house built assembler (see EXAMPLE 5 for detailed description). A FASTA file with corrected heavy D and light V-J junction sequences was generated for each sample. In addition to the assembled FASTA files using IgBLAST v1.9.0 and IMGT database were also generated. The somatic FASTA sequence was inputted to IgBLAST and to obtain the closest segment ids for the heavy and light chain. The final assembled FASTA sequences served as 'reference' sequences for the alignment and visualization steps described below. Final 'reconstructed' nucleotide and amino acid consensus sequences of antibodies associated with a cancer are provided herein.

Quality Control and Visual Confirmation of Alignments

Using the reference files generated from the assembly step, the FASTQs were aligned in BowTie2 default mode. The output BAM file can be used for IGV visualization and mutations in the patient can be observed.

Example alignments and corresponding hypermutations using BowTie2 with default parameters for 3 exemplary patients are shown in FIG. 2A-2F. The D segments of the heavy chain was identified using a custom local assembly tool and edited the corresponding part of the FASTA file, therefore, no mutations are shown in D segments of IGV plots.

Example 4: Identification of Rearranged Immunoglobulin CDR3 Amino Acid Sequences The identification of the CDR3 region and corresponding V, D, and J chains from the final assembled FASTA sequences was achieved with IgBLAST. The standardized output using version v.1.9.0 of IgBLAST was delivered by wrapping IgBLASTn with default parameters. The output from the IgBLAST service is extracted using a purpose-built parser tool designed to extract the CDR1, CDR2 and CDR3 nucleotide and amino acid sequences. Summary of identified nucleotide and amino acid consensus sequences for CDR3 for the selected tumor samples are provided herein.

Example 5: VDJ Sequence Identification Workflow

VDJ Sequence identification workflow was used to determine somatic sequences of given patient and information such as CDR regions and mutation rates. The exemplary pipeline comprised of 3 steps (FIG. 3): Step 1: Pipeline P1: Somatic Sequence Identification; Step 2: Manual IGV Investigation and (if necessary) Correction of Somatic VDJ Sequence; and Step 3: Pipeline P2: CDR Regions Identification and Amino Acid Translation.

The workflow accepted 2 inputs for each target patient: (1) the TCGA Archive File: TCGA archive file of the patient. Prefixes of all output files were determined based on metadata (i.e. aliquot id) of patients' archive file; and (2) the preliminary alignment Output File: IG clones output of preliminary alignment were used to obtain initial segment id predictions. This text file included both heavy and light chain results.

By completing all three steps of the pipeline, the following output files were obtained: Somatic Sequence: A FASTA file for a given patient's identified VDJ sequence; The amino acid translation of Somatic FASTA files; IgBLAST output log for somatic FASTA file: Contains CDR regions; Alignment Logs: Visual text representation of the heavy D region and light V-J junction of somatic sequence (For validation purpose); and Pileup logs: Contains somatic mutation rate of segments and V-C segment coverage ratio of heavy and light chain which we use as an internal quality control metric.

Step 1: Somatic Sequence Identification

Figure 4:
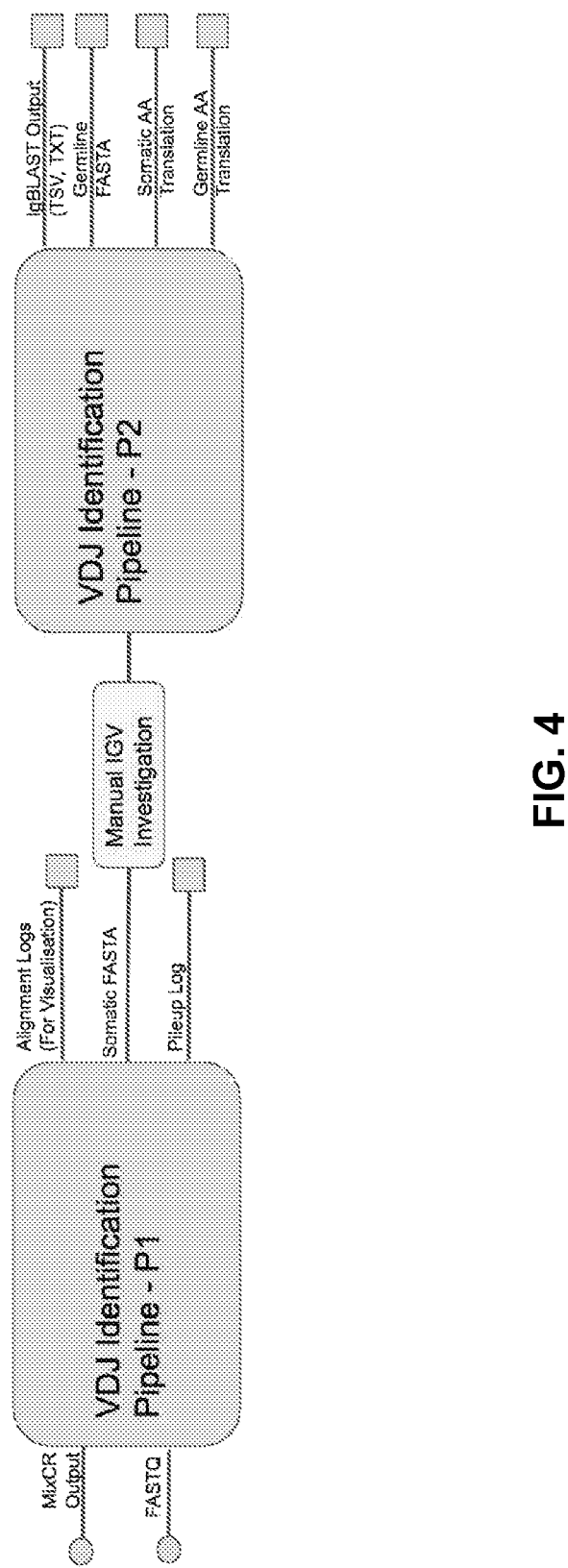
FIG. 4 depicts an exemplary schema of VDJ identification pipeline.

The first step of the VDJ sequence identification workflow was the somatic sequence identification. For this purpose, two input were initially taken, which were the IG segments id identified during the first alignment step and the FASTQ file of the patient. Somatic sequence identification was performed in 3 sub-stages (FIG. 4).

Assembly Stage

During the preliminary alignment step, the VDJC segment ids were identified for both heavy and light chain. Then with use of the segment ids and IMGT database, the heavy and light chain sequences were generated by appending segment sequences to form V(D)JC structure.

Figure 5:
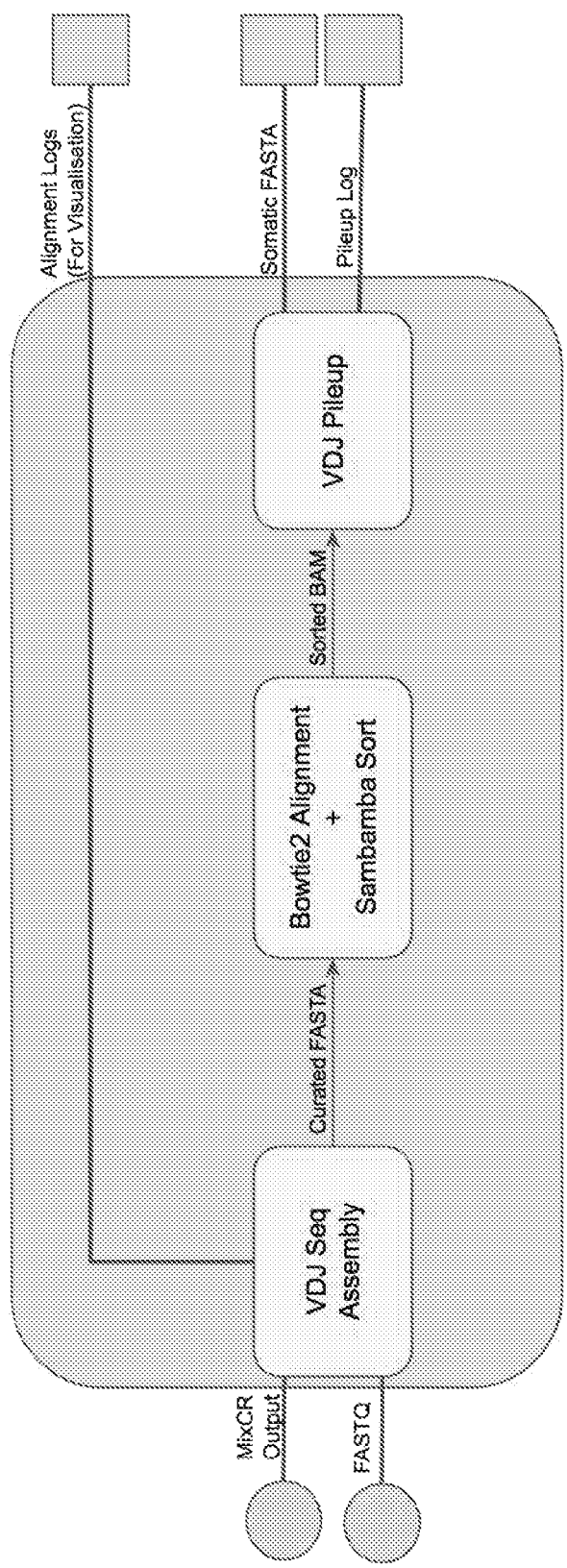
FIG. 5 shows a detailed schema of somatic VDJ sequence identification.

When the FASTQ of a patient was aligned with the reference FASTA generated by the first alignment step, it was often observed that D segment of the heavy chain (FIG. 5) did not properly align. One reason of observing a low coverage in these areas could be the high mutation rate of antibody construction. Somatic mutations in these two regions are high enough that during the alignment against IMGT reference, many reads were eliminated. In addition, sizes of the reads were typically small for TCGA patients (i.e., about 50 bp) which were harder to align to difficult (mutated) regions.

In order to identify the correct sequence in heavy D and light V-J junction, a custom assembly based algorithm was implemented. From the VDJ segments identified during the first alignment step, a 22 bp seed sequence was selected from the ending of V segments. From the end of V segment, the read length was read backwards. From that index, the next 22 bp was selected as the initial seed.

Once the seed sequence was selected, the FASTQ file was searched for the reads that contain this seed sequence. Since somatic mutations could occur, a fuzzy pattern searching algorithm was used (i.e., bitap algorithm) by allowing matches up to 4 edit distance penalty.

After the reads were selected in the first iteration, the unrelated ones were eliminated by comparing the whole read with V segment. The match ratio was checked of the intersection of reads and the V segment identified during the first alignment step. If the match ratio is less than 0.84, then the read was removed. Once the unrelated reads were removed, the reads were sorted descending by their match ratios and selected the first half of reads for pile up processing.

Figure 6A:
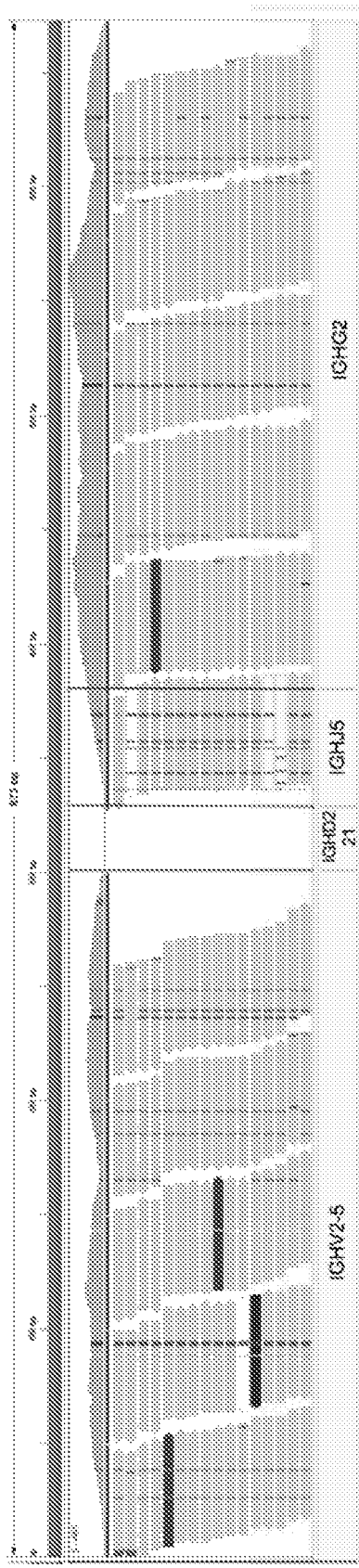
FIG. 6A shows heavy chain and FIG. 6B shows light chain refined alignment for selected patient compared to the initial alignment. Sudden coverage drop can be observed at D segment of heavy chain and the V-J junction of the light chain.
Figure 6B:
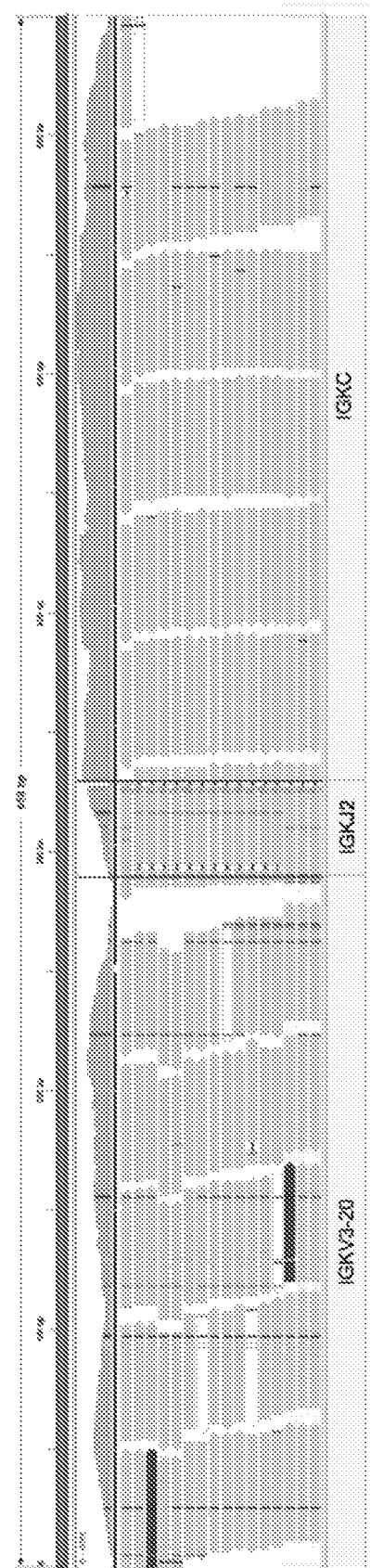

Using the selected reads, the bases were piled up and formed a single sequence. From the generated sequence, another 22 bp seed was selected and started a new iteration. For the following iterations, the maximum edit distance penalty was decreased to 1 and a read elimination was not performed in contrast to the first iteration. The iteration continued until a long enough final assembled sequence that covers more than half of the J segment was obtained (FIG. 6).

Once the assembled Heavy D region and Light V-J junction were obtained, the corresponding part of the reference was edited and produced an intermediate FASTA file for the alignment stage.

Alignment Stage

After the difficult regions (i.e., heavy D and light V-J junction) were identified using a custom assembly method, the aim was to correct the remaining variants (i.e., variants seen in FIG. 7) by using a standard variant calling pipeline which involved aligning reads followed by variant calling operation. For this purpose, BowTie2 2.2.6 with default parameters was used. To decrease the size of the output BAM file, the unaligned reads were discarded from the BAM file. After that, Sambamba 0.5.9 was used to sort the output BAM file.

Pileup Stage

In the third stage, rather than using a variant caller, the BAM file was used from the alignment stage do a pile-up processing to identify and correct variants in the reference file. For each position in the alignment, SNPs and INDELs were checked. Reads less than 20 quality threshold were ignored. In order to identify a variant in a specific position, 0.5 as the minimum ratio was applied, which meant that at least half of the total reads should contained that variant for the position. The variants in positions were also ignored where the total coverage is less than 200 reads. It was mostly observed that low coverage value in the first few base pairs of V segments and at the ending few base pairs of C segment.

Mutation Rate Calculation

Once a final sequence was obtained, the sequence was compared with the initial reference file which the BAM file was generated from. The mutation rate was calculated as the Levenshtein Distance between segments divided by the Alignment Length of segments (i.e., Python Levenshtein-.ratio (seq1, seq2)).

Coverage Ratio Between V and C Segments

The average coverage was checked between V and C segments of both chains as an internal quality control step to ensure that the patient was high clonal. In the pileup log file, if the coverage ratio was over 0.3 then this suggested high clonality. A high V/C ratio might not always mean that the patient is highly clonal. However, a low V/C ratio could be a strong sign for low clonality.

Step 2: Manual IGV Inspection & Somatic Sequence Correction

Once the somatic FASTA files were obtained through step 1, the FASTA file was manually inspected using IGV browser. The IGV browser was check on whether it showed a variant in our somatic reference file. Bases were mostly corrected which were previously skipped due to the low number of reads in pileup stage of step 1.

Step 3: Final CDR Regions Identification and Amino-Acid Translation

Figure 8:
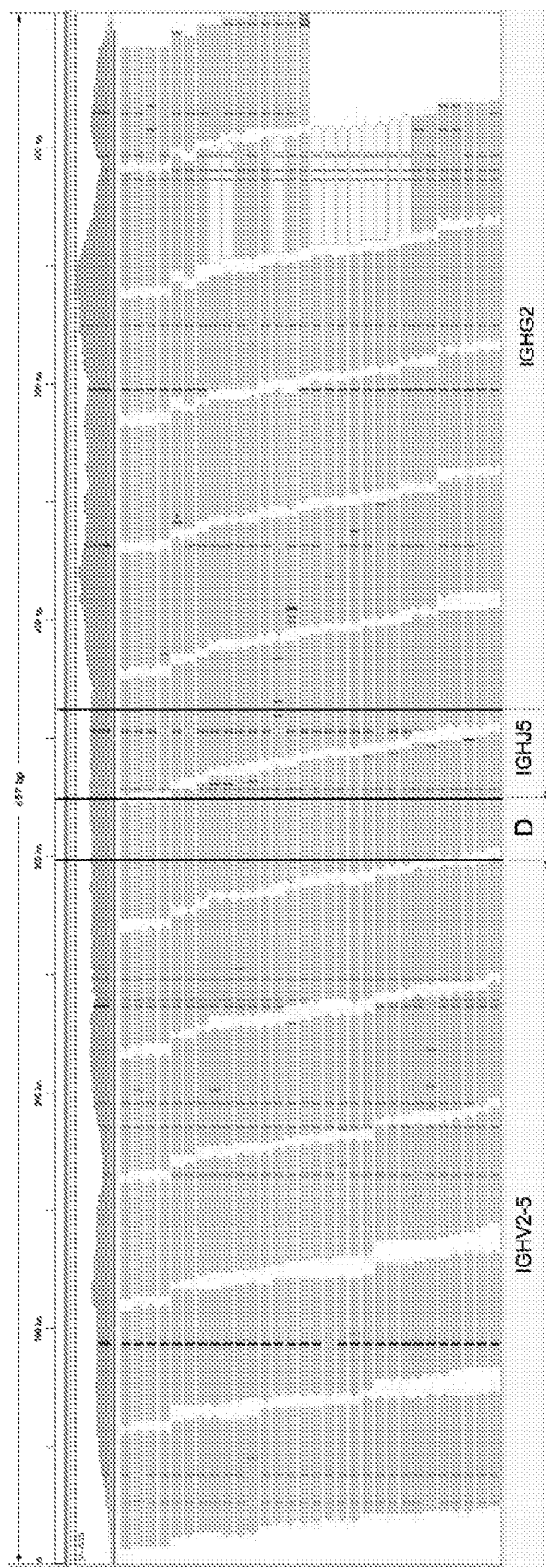
FIG. 8 shows an IGV plot of heavy chain with a corrected D segment after the alignment stage.
Figure 9:
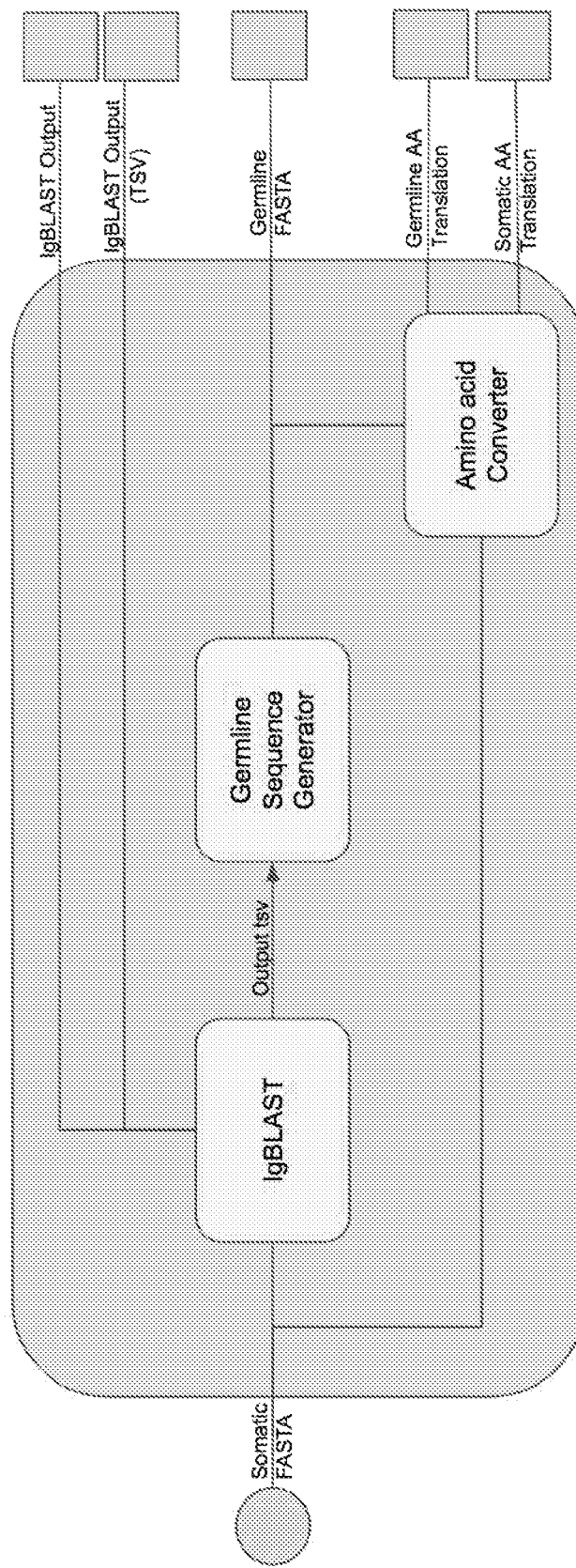
FIG. 9 illustrates a detailed schema of germline and CDR sequence identification.
Figure 11:
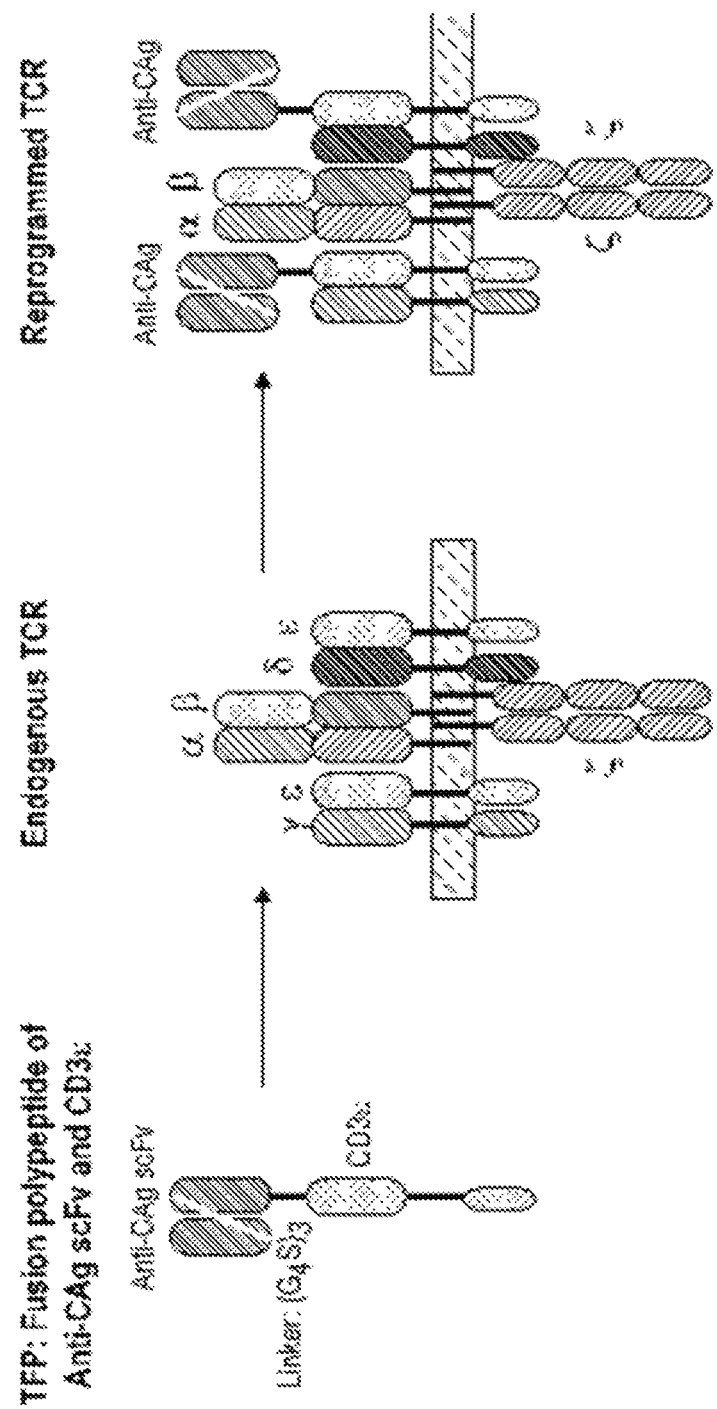
FIG. 11 is a schematic illustration demonstrating the use of T-cell receptor fusion polypeptides.
Figures 12A, 12B, 12C, 12D:
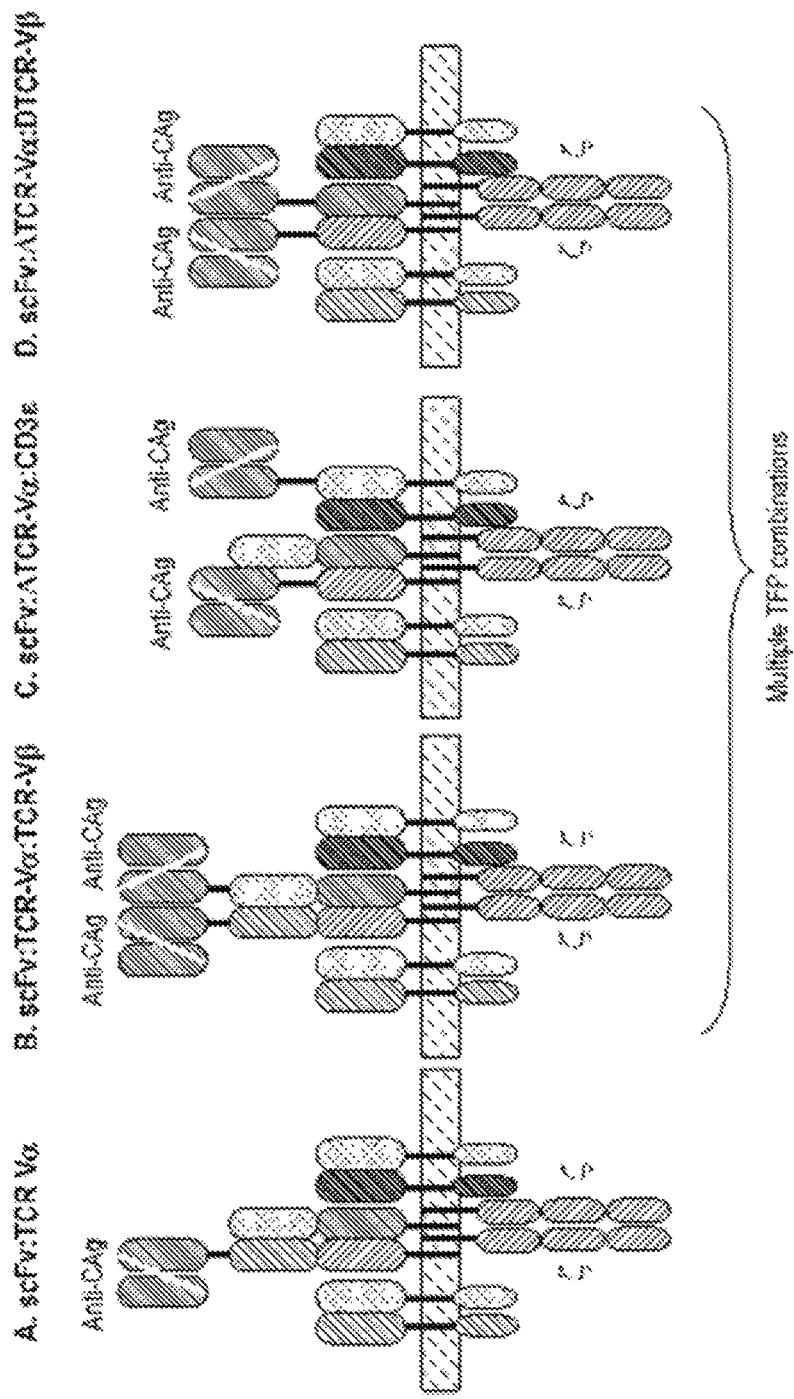
FIG. 12A represents schematic illustrations demonstrating exemplary variations of reprogrammed T-cell receptor fusion polypeptides (TFPs) of the invention. An exemplary reprogrammed TCR containing a TFP that contains an anti-CAg scFv and a full-length TCR Vα polypeptide fused via a (G4S)3 linker sequence is illustrated.
FIG. 12B illustrates a series of exemplary reprogrammed TCRs that contain multiple TFPs including i) an anti-CAg scFv and a full-length TCR Vα polypeptide fused via a (G4S)3 linker sequence and ii) an anti-CAg scFv and a full-length TCR Vβ polypeptide fused via a (G4S)3 linker sequence.
FIG. 12C illustrates an exemplary reprogrammed TCR that contains multiple TFPs including i) an anti-CAg scFv and a truncated (Δ) TCR polypeptide fused via a (G4S)3 linker sequence and ii) an anti-CAg scFv and a full-length CD3 epsilon polypeptide fused via a (G4S)3 linker sequence. The truncated (Δ) TCR polypeptide is truncated by the deletion of the Vα.
FIG. 12D illustrates an exemplary reprogrammed TCR that contains multiple TFPs including i) an anti-CAg scFv and a truncated (Δ) TCR Vα polypeptide fused via a (G4S)3 linker sequence and ii) an anti-CAg scFv and a truncated (Δ) TCR Vβ polypeptide fused via a (G4S)3 linker sequence. The truncated (Δ) TCR polypeptide is truncated by the deletion of the Vβ.

FIG. 8 illustrates detailed schema of CDR sequence identification and amino acid translation workflow. Once a final somatic sequence was identified in the first two steps, the reference was inputted to the IgBLAST tool to identify the closest segment ids from the IMGT database. IgBLAST also reported the positions of the CDR1, CDR2 and CDR3 sequences of the exemplary antibodies. Using those positions, the somatic sequence was clipped and the CDR regions returned with their amino acid translations. As a final step, the amino acid translation of reconstructed complete somatic VDJ consensus sequences was produced.

Exemplary reconstructed amino acid and nucleic acid consensus sequences of variable heavy chain, variable light chain and their corresponding CDR3 are provided herein.

Example 6: Identification of Target Cancer Antigen

To determine the target antigen and specificity and affinity for an identified target antigen, antibodies described herein are analyzed using the High-Spec® cross-reactivity assay on HUPROT™ human proteome arrays, which contain the largest human protein collection on a single array. The HUPROT™ Human Proteome Microarray allows interactions between antibodies and candidate antigen proteins to be profiled in a high-throughput manner. The full-length recombinant candidate antigen proteins are expressed in the yeast S. cerevisiae, purified, and printed on glass slides in duplicate along with a set of control proteins (GST, BSA, histones, IgG, etc.). The HUPROT™ microarray is not restricted to a particular type of surface coating, although the default is glass coated with ultra-thin nitrocellulose film for the non-covalent, yet irreversible, capture of active proteins to the surface.

Antibody samples are probed on native HUPROT™ arrays at 1 µg/ml and incubated at room temperature for 1 hour. After probing, the arrays are washed according to the standard protocols and probed with Alexa-647-anti-human IgG Fc gamma specific secondary antibodies under conditions optimized for signal detection.

Data Analysis

Non-specific hits that directly bind to the secondary antibodies are eliminated from the analysis of the samples. The specificity of each individual antibody sample to specific target antigen proteins on the array are quantified based on Z Scores.

Z score is the average Z score of the duplicate spots of a given protein (each protein is printed in duplicate on a HuProt™ array). The Z score of each spot on a given array is calculated according to the algorithm: $Z=[F635-F635(avg)]/F635(std)$.

F635(avg) and F635(std) are the average and standard deviation of the F635 values of all spots on the array, respectively. S score is the difference of the Z Scores of a given protein and the one ranked next to it. If the S score of the top hit is >3, the antibody is considered as high specific against the top hit.

F635 is the average foreground signal intensity of 2 replicate spots of a given protein in the detection channel (635 nm). B635 is the average background signal intensity of 2 replicate spots of a given protein in the detection channel (635 nm). Range includes 3 numbers, the F635 values of the 2 replicate spots and the difference between them. If the difference is too high (compared to the F635 value), it indicates the 2 spots are not consistent and the hit may be less reliable. The non-specific hits bound by the secondary antibody are removed from the analysis of the samples.

Exemplary reconstructed amino acid and nucleic acid consensus sequences of variable heavy chain, variable light chain and their corresponding CDR3 are provided below.

Table 1 lists SEQ ID NOs of exemplar, amino acid sequences of heavy chain, light chain, and complementarity-determining regions of the antibodies disclosed herein or antigen binding fragment thereof. Corresponding amino acid sequences are provided in the sequence listing submitted herewith

| | SEQ ID NO: | | | | | | | |
|---|---|---|---|---|---|---|---|---|
| | Variable Region | | CDR1 | | CDR2 | | CDR3 | |
| Antibody name | Heavy chain ($V_H$) | Light chain ($V_L$) | Heavy chain (CDR-H1) | Light chain (CDR-L1) | Heavy chain CDR-H2 | Light chain (CDR-L2) | Heavy chain (CDR-H3) | Light chain (CDR-L3) |
| TBLA1001 | 1 | 272 | 543 | 814 | 1085 | 1356 | 1627 | 1898 |
| TBLA1002 | 2 | 273 | 544 | 815 | 1086 | 1357 | 1628 | 1899 |

-continued

| | SEQ ID NO: | | | | | | | |
|---|---|---|---|---|---|---|---|---|
| | Variable Region | | CDR1 | | CDR2 | | CDR3 | |
| Antibody name | Heavy chain ($V_H$) | Light chain ($V_L$) | Heavy chain (CDR-H1) | Light chain (CDR-L1) | Heavy chain CDR-H2 | Light chain (CDR-L2) | Heavy chain (CDR-H3) | Light chain (CDR-L3) |
| TBLA1003 | 3 | 274 | 545 | 816 | 1087 | 1358 | 1629 | 1900 |
| TBLA1004 | 4 | 275 | 546 | 817 | 1088 | 1359 | 1630 | 1901 |
| TBLA1005 | 5 | 276 | 547 | 818 | 1089 | 1360 | 1631 | 1902 |
| TBLA1006 | 6 | 277 | 548 | 819 | 1090 | 1361 | 1632 | 1903 |
| TBLA1007 | 7 | 278 | 549 | 820 | 1091 | 1362 | 1633 | 1904 |
| TBLA1008 | 8 | 279 | 550 | 821 | 1092 | 1363 | 1634 | 1905 |
| TBLA1009 | 9 | 280 | 551 | 822 | 1093 | 1364 | 1635 | 1906 |
| TBLA1010 | 10 | 281 | 552 | 823 | 1094 | 1365 | 1636 | 1907 |
| TBLA1011 | 11 | 282 | 553 | 824 | 1095 | 1366 | 1637 | 1908 |
| TBLA1012 | 12 | 283 | 554 | 825 | 1096 | 1367 | 1638 | 1909 |
| TBLA1013 | 13 | 284 | 555 | 826 | 1097 | 1368 | 1639 | 1910 |
| TBRE1001 | 14 | 285 | 556 | 827 | 1098 | 1369 | 1640 | 1911 |
| TBRE1002 | 15 | 286 | 557 | 828 | 1099 | 1370 | 1641 | 1912 |
| TBRE1003 | 16 | 287 | 558 | 829 | 1100 | 1371 | 1642 | 1913 |
| TBRE1004 | 17 | 288 | 559 | 830 | 1101 | 1372 | 1643 | 1914 |
| TBRE1005 | 18 | 289 | 560 | 831 | 1102 | 1373 | 1644 | 1915 |
| TBRE1006 | 19 | 290 | 561 | 832 | 1103 | 1374 | 1645 | 1916 |
| TBRE1007 | 20 | 291 | 562 | 833 | 1104 | 1375 | 1646 | 1917 |
| TBRE1008 | 21 | 292 | 563 | 834 | 1105 | 1376 | 1647 | 1918 |
| TBRE1009 | 22 | 293 | 564 | 835 | 1106 | 1377 | 1648 | 1919 |
| TBRE1010 | 23 | 294 | 565 | 836 | 1107 | 1378 | 1649 | 1920 |
| TBRE1011 | 24 | 295 | 566 | 837 | 1108 | 1379 | 1650 | 1921 |
| TBRE1012 | 25 | 296 | 567 | 838 | 1109 | 1380 | 1651 | 1922 |
| TBRE1013 | 26 | 297 | 568 | 839 | 1110 | 1381 | 1652 | 1923 |
| TBRE1014 | 27 | 298 | 569 | 840 | 1111 | 1382 | 1653 | 1924 |
| TBRE1015 | 28 | 299 | 570 | 841 | 1112 | 1383 | 1654 | 1925 |
| TBRE1016 | 29 | 300 | 571 | 842 | 1113 | 1384 | 1655 | 1926 |
| TBRE1017 | 30 | 301 | 572 | 843 | 1114 | 1385 | 1656 | 1927 |
| TBRE1018 | 31 | 302 | 573 | 844 | 1115 | 1386 | 1657 | 1928 |
| TBRE1019 | 32 | 303 | 574 | 845 | 1116 | 1387 | 1658 | 1929 |
| TBRE1020 | 33 | 304 | 575 | 846 | 1117 | 1388 | 1659 | 1930 |
| TBRE1021 | 34 | 305 | 576 | 847 | 1118 | 1389 | 1660 | 1931 |
| TBRE1022 | 35 | 306 | 577 | 848 | 1119 | 1390 | 1661 | 1932 |
| TBRE1023 | 36 | 307 | 578 | 849 | 1120 | 1391 | 1662 | 1933 |
| TBRE1024 | 37 | 308 | 579 | 850 | 1121 | 1392 | 1663 | 1934 |
| TBRE1025 | 38 | 309 | 580 | 851 | 1122 | 1393 | 1664 | 1935 |
| TBRE1026 | 39 | 310 | 581 | 852 | 1123 | 1394 | 1665 | 1936 |
| TBRE1027 | 40 | 311 | 582 | 853 | 1124 | 1395 | 1666 | 1937 |
| TBRE1028 | 41 | 312 | 583 | 854 | 1125 | 1396 | 1667 | 1938 |
| TBRE1029 | 42 | 313 | 584 | 855 | 1126 | 1397 | 1668 | 1939 |
| TBRE1030 | 43 | 314 | 585 | 856 | 1127 | 1398 | 1669 | 1940 |
| TBRE1031 | 44 | 315 | 586 | 857 | 1128 | 1399 | 1670 | 1941 |
| TBRE1032 | 45 | 316 | 587 | 858 | 1129 | 1400 | 1671 | 1942 |
| TBRE1033 | 46 | 317 | 588 | 859 | 1130 | 1401 | 1672 | 1943 |
| TBRE1034 | 47 | 318 | 589 | 860 | 1131 | 1402 | 1673 | 1944 |
| TBRE1035 | 48 | 319 | 590 | 861 | 1132 | 1403 | 1674 | 1945 |
| TBRE1036 | 49 | 320 | 591 | 862 | 1133 | 1404 | 1675 | 1946 |
| TBRE1037 | 50 | 321 | 592 | 863 | 1134 | 1405 | 1676 | 1947 |
| TBRE1038 | 51 | 322 | 593 | 864 | 1135 | 1406 | 1677 | 1948 |
| TBRE1039 | 52 | 323 | 594 | 865 | 1136 | 1407 | 1678 | 1949 |
| TBRE1040 | 53 | 324 | 595 | 866 | 1137 | 1408 | 1679 | 1950 |
| TBRE1041 | 54 | 325 | 596 | 867 | 1138 | 1409 | 1680 | 1951 |
| TBRE1042 | 55 | 326 | 597 | 868 | 1139 | 1410 | 1681 | 1952 |
| TBRE1043 | 56 | 327 | 598 | 869 | 1140 | 1411 | 1682 | 1953 |
| TBRE1044 | 57 | 328 | 599 | 870 | 1141 | 1412 | 1683 | 1954 |
| TBRE1045 | 58 | 329 | 600 | 871 | 1142 | 1413 | 1684 | 1955 |
| TBRE1046 | 59 | 330 | 601 | 872 | 1143 | 1414 | 1685 | 1956 |
| TBRE1047 | 60 | 331 | 602 | 873 | 1144 | 1415 | 1686 | 1957 |
| TBRE1048 | 61 | 332 | 603 | 874 | 1145 | 1416 | 1687 | 1958 |
| TBRE1049 | 62 | 333 | 604 | 875 | 1146 | 1417 | 1688 | 1959 |
| TBRE1050 | 63 | 334 | 605 | 876 | 1147 | 1418 | 1689 | 1960 |
| TBRE1051 | 64 | 335 | 606 | 877 | 1148 | 1419 | 1690 | 1961 |
| TBRE1052 | 65 | 336 | 607 | 878 | 1149 | 1420 | 1691 | 1962 |
| TBRE1053 | 66 | 337 | 608 | 879 | 1150 | 1421 | 1692 | 1963 |
| TBRE1054 | 67 | 338 | 609 | 880 | 1151 | 1422 | 1693 | 1964 |
| TBRE1055 | 68 | 339 | 610 | 881 | 1152 | 1423 | 1694 | 1965 |
| TBRE1056 | 69 | 340 | 611 | 882 | 1153 | 1424 | 1695 | 1966 |
| TBRE1057 | 70 | 341 | 612 | 883 | 1154 | 1425 | 1696 | 1967 |
| TBRE1058 | 71 | 342 | 613 | 884 | 1155 | 1426 | 1697 | 1968 |
| TCER1001 | 72 | 343 | 614 | 885 | 1156 | 1427 | 1698 | 1969 |

-continued

| | SEQ ID NO: | | | | | | |
|---|---|---|---|---|---|---|---|
| | Variable Region | | CDR1 | | CDR2 | | CDR3 | |
| Antibody name | Heavy chain ($V_H$) | Light chain ($V_L$) | Heavy chain (CDR-H1) | Light chain (CDR-L1) | Heavy chain CDR-H2 | Light chain (CDR-L2) | Heavy chain (CDR-H3) | Light chain (CDR-L3) |
| TCER1002 | 73 | 344 | 615 | 886 | 1157 | 1428 | 1699 | 1970 |
| TCER1003 | 74 | 345 | 616 | 887 | 1158 | 1429 | 1700 | 1971 |
| TCER1004 | 75 | 346 | 617 | 888 | 1159 | 1430 | 1701 | 1972 |
| TCER1005 | 76 | 347 | 618 | 889 | 1160 | 1431 | 1702 | 1973 |
| TCER1006 | 77 | 348 | 619 | 890 | 1161 | 1432 | 1703 | 1974 |
| TCER1007 | 78 | 349 | 620 | 891 | 1162 | 1433 | 1704 | 1975 |
| TCHO1001 | 79 | 350 | 621 | 892 | 1163 | 1434 | 1705 | 1976 |
| TCOL1001 | 80 | 351 | 622 | 893 | 1164 | 1435 | 1706 | 1977 |
| TCOL1002 | 81 | 352 | 623 | 894 | 1165 | 1436 | 1707 | 1978 |
| TCOL1003 | 82 | 353 | 624 | 895 | 1166 | 1437 | 1708 | 1979 |
| TCOL1004 | 83 | 354 | 625 | 896 | 1167 | 1438 | 1709 | 1980 |
| TCOL1005 | 84 | 355 | 626 | 897 | 1168 | 1439 | 1710 | 1981 |
| TCOL1006 | 85 | 356 | 627 | 898 | 1169 | 1440 | 1711 | 1982 |
| TCOL1007 | 86 | 357 | 628 | 899 | 1170 | 1441 | 1712 | 1983 |
| TCOL1008 | 87 | 358 | 629 | 900 | 1171 | 1442 | 1713 | 1984 |
| TCOL1009 | 88 | 359 | 630 | 901 | 1172 | 1443 | 1714 | 1985 |
| TESO1001 | 89 | 360 | 631 | 902 | 1173 | 1444 | 1715 | 1986 |
| TESO1002 | 90 | 361 | 632 | 903 | 1174 | 1445 | 1716 | 1987 |
| TESO1003 | 91 | 362 | 633 | 904 | 1175 | 1446 | 1717 | 1988 |
| TESO1004 | 92 | 363 | 634 | 905 | 1176 | 1447 | 1718 | 1989 |
| TESO1005 | 93 | 364 | 635 | 906 | 1177 | 1448 | 1719 | 1990 |
| TESO1006 | 94 | 365 | 636 | 907 | 1178 | 1449 | 1720 | 1991 |
| TESO1007 | 95 | 366 | 637 | 908 | 1179 | 1450 | 1721 | 1992 |
| THNS1001 | 96 | 367 | 638 | 909 | 1180 | 1451 | 1722 | 1993 |
| THNS1002 | 97 | 368 | 639 | 910 | 1181 | 1452 | 1723 | 1994 |
| THNS1003 | 98 | 369 | 640 | 911 | 1182 | 1453 | 1724 | 1995 |
| THNS1004 | 99 | 370 | 641 | 912 | 1183 | 1454 | 1725 | 1996 |
| THNS1005 | 100 | 371 | 642 | 913 | 1184 | 1455 | 1726 | 1997 |
| THNS1006 | 101 | 372 | 643 | 914 | 1185 | 1456 | 1727 | 1998 |
| THNS1007 | 102 | 373 | 644 | 915 | 1186 | 1457 | 1728 | 1999 |
| THNS1008 | 103 | 374 | 645 | 916 | 1187 | 1458 | 1729 | 2000 |
| THNS1009 | 104 | 375 | 646 | 917 | 1188 | 1459 | 1730 | 2001 |
| THNS1010 | 105 | 376 | 647 | 918 | 1189 | 1460 | 1731 | 2002 |
| THNS1011 | 106 | 377 | 648 | 919 | 1190 | 1461 | 1732 | 2003 |
| THNS1012 | 107 | 378 | 649 | 920 | 1191 | 1462 | 1733 | 2004 |
| THNS1013 | 108 | 379 | 650 | 921 | 1192 | 1463 | 1734 | 2005 |
| THNS1014 | 109 | 380 | 651 | 922 | 1193 | 1464 | 1735 | 2006 |
| TKIC1001 | 110 | 381 | 652 | 923 | 1194 | 1465 | 1736 | 2007 |
| TKIC1002 | 111 | 382 | 653 | 924 | 1195 | 1466 | 1737 | 2008 |
| TKIC1003 | 112 | 383 | 654 | 925 | 1196 | 1467 | 1738 | 2009 |
| TKIC1004 | 113 | 384 | 655 | 926 | 1197 | 1468 | 1739 | 2010 |
| TKIC1005 | 114 | 385 | 656 | 927 | 1198 | 1469 | 1740 | 2011 |
| TKIC1006 | 115 | 386 | 657 | 928 | 1199 | 1470 | 1741 | 2012 |
| TKIC1007 | 116 | 387 | 658 | 929 | 1200 | 1471 | 1742 | 2013 |
| TKIC1008 | 117 | 388 | 659 | 930 | 1201 | 1472 | 1743 | 2014 |
| TKIC1009 | 118 | 389 | 660 | 931 | 1202 | 1473 | 1744 | 2015 |
| TKIC1010 | 119 | 390 | 661 | 932 | 1203 | 1474 | 1745 | 2016 |
| TKIC1011 | 120 | 391 | 662 | 933 | 1204 | 1475 | 1746 | 2017 |
| TKIC1012 | 121 | 392 | 663 | 934 | 1205 | 1476 | 1747 | 2018 |
| TKIC1013 | 122 | 393 | 664 | 935 | 1206 | 1477 | 1748 | 2019 |
| TKIC1014 | 123 | 394 | 665 | 936 | 1207 | 1478 | 1749 | 2020 |
| TKIC1015 | 124 | 395 | 666 | 937 | 1208 | 1479 | 1750 | 2021 |
| TKIC1016 | 125 | 396 | 667 | 938 | 1209 | 1480 | 1751 | 2022 |
| TKIC1017 | 126 | 397 | 668 | 939 | 1210 | 1481 | 1752 | 2023 |
| TKIC1018 | 127 | 398 | 669 | 940 | 1211 | 1482 | 1753 | 2024 |
| TKIC1019 | 128 | 399 | 670 | 941 | 1212 | 1483 | 1754 | 2025 |
| TKIC1020 | 129 | 400 | 671 | 942 | 1213 | 1484 | 1755 | 2026 |
| TKIP1001 | 130 | 401 | 672 | 943 | 1214 | 1485 | 1756 | 2027 |
| TKIP1002 | 131 | 402 | 673 | 944 | 1215 | 1486 | 1757 | 2028 |
| TKIP1003 | 132 | 403 | 674 | 945 | 1216 | 1487 | 1758 | 2029 |
| TKIP1004 | 133 | 404 | 675 | 946 | 1217 | 1488 | 1759 | 2030 |
| TKIP1005 | 134 | 405 | 676 | 947 | 1218 | 1489 | 1760 | 2031 |
| TKIP1006 | 135 | 406 | 677 | 948 | 1219 | 1490 | 1761 | 2032 |
| TLGG1001 | 136 | 407 | 678 | 949 | 1220 | 1491 | 1762 | 2033 |
| TLIV1001 | 137 | 408 | 679 | 950 | 1221 | 1492 | 1763 | 2034 |
| TLIV1002 | 138 | 409 | 680 | 951 | 1222 | 1493 | 1764 | 2035 |
| TLIV1003 | 139 | 410 | 681 | 952 | 1223 | 1494 | 1765 | 2036 |
| TLIV1004 | 140 | 411 | 682 | 953 | 1224 | 1495 | 1766 | 2037 |
| TLUA1001 | 141 | 412 | 683 | 954 | 1225 | 1496 | 1767 | 2038 |
| TLUA1002 | 142 | 413 | 684 | 955 | 1226 | 1497 | 1768 | 2039 |

-continued

| | SEQ ID NO: | | | | | | |
|---|---|---|---|---|---|---|---|
| | Variable Region | | CDR1 | | CDR2 | | CDR3 | |
| Antibody name | Heavy chain ($V_H$) | Light chain ($V_L$) | Heavy chain (CDR-H1) | Light chain (CDR-L1) | Heavy chain CDR-H2 | Light chain (CDR-L2) | Heavy chain (CDR-H3) | Light chain (CDR-L3) |
| TLUA1003 | 143 | 414 | 685 | 956 | 1227 | 1498 | 1769 | 2040 |
| TLUA1004 | 144 | 415 | 686 | 957 | 1228 | 1499 | 1770 | 2041 |
| TLUA1005 | 145 | 416 | 687 | 958 | 1229 | 1500 | 1771 | 2042 |
| TLUA1006 | 146 | 417 | 688 | 959 | 1230 | 1501 | 1772 | 2043 |
| TLUA1007 | 147 | 418 | 689 | 960 | 1231 | 1502 | 1773 | 2044 |
| TLUA1008 | 148 | 419 | 690 | 961 | 1232 | 1503 | 1774 | 2045 |
| TLUA1009 | 149 | 420 | 691 | 962 | 1233 | 1504 | 1775 | 2046 |
| TLUA1010 | 150 | 421 | 692 | 963 | 1234 | 1505 | 1776 | 2047 |
| TLUA1011 | 151 | 422 | 693 | 964 | 1235 | 1506 | 1777 | 2048 |
| TLUA1012 | 152 | 423 | 694 | 965 | 1236 | 1507 | 1778 | 2049 |
| TLUA1013 | 153 | 424 | 695 | 966 | 1237 | 1508 | 1779 | 2050 |
| TLUA1014 | 154 | 425 | 696 | 967 | 1238 | 1509 | 1780 | 2051 |
| TLUA1015 | 155 | 426 | 697 | 968 | 1239 | 1510 | 1781 | 2052 |
| TLUA1016 | 156 | 427 | 698 | 969 | 1240 | 1511 | 1782 | 2053 |
| TLUA1017 | 157 | 428 | 699 | 970 | 1241 | 1512 | 1783 | 2054 |
| TLUA1018 | 158 | 429 | 700 | 971 | 1242 | 1513 | 1784 | 2055 |
| TLUS1001 | 159 | 430 | 701 | 972 | 1243 | 1514 | 1785 | 2056 |
| TLUS1002 | 160 | 431 | 702 | 973 | 1244 | 1515 | 1786 | 2057 |
| TLUS1003 | 161 | 432 | 703 | 974 | 1245 | 1516 | 1787 | 2058 |
| TLUS1004 | 162 | 433 | 704 | 975 | 1246 | 1517 | 1788 | 2059 |
| TLUS1005 | 163 | 434 | 705 | 976 | 1247 | 1518 | 1789 | 2060 |
| TLUS1006 | 164 | 435 | 706 | 977 | 1248 | 1519 | 1790 | 2061 |
| TLUS1007 | 165 | 436 | 707 | 978 | 1249 | 1520 | 1791 | 2062 |
| TLUS1008 | 166 | 437 | 708 | 979 | 1250 | 1521 | 1792 | 2063 |
| TLUS1009 | 167 | 438 | 709 | 980 | 1251 | 1522 | 1793 | 2064 |
| TLUS1010 | 168 | 439 | 710 | 981 | 1252 | 1523 | 1794 | 2065 |
| TLUS1011 | 169 | 440 | 711 | 982 | 1253 | 1524 | 1795 | 2066 |
| TMEL1015 | 170 | 441 | 712 | 983 | 1254 | 1525 | 1796 | 2067 |
| TMEL1016 | 171 | 442 | 713 | 984 | 1255 | 1526 | 1797 | 2068 |
| TMEL1017 | 172 | 443 | 714 | 985 | 1256 | 1527 | 1798 | 2069 |
| TMEL1018 | 173 | 444 | 715 | 986 | 1257 | 1528 | 1799 | 2070 |
| TMEL1019 | 174 | 445 | 716 | 987 | 1258 | 1529 | 1800 | 2071 |
| TMEL1020 | 175 | 446 | 717 | 988 | 1259 | 1530 | 1801 | 2072 |
| TMEL1021 | 176 | 447 | 718 | 989 | 1260 | 1531 | 1802 | 2073 |
| TMEL1022 | 177 | 448 | 719 | 990 | 1261 | 1532 | 1803 | 2074 |
| TMEL1023 | 178 | 449 | 720 | 991 | 1262 | 1533 | 1804 | 2075 |
| TMEL1024 | 179 | 450 | 721 | 992 | 1263 | 1534 | 1805 | 2076 |
| TMEL1025 | 180 | 451 | 722 | 993 | 1264 | 1535 | 1806 | 2077 |
| TMEL1026 | 181 | 452 | 723 | 994 | 1265 | 1536 | 1807 | 2078 |
| TMEL1027 | 182 | 453 | 724 | 995 | 1266 | 1537 | 1808 | 2079 |
| TMEL1028 | 183 | 454 | 725 | 996 | 1267 | 1538 | 1809 | 2080 |
| TMEL1029 | 184 | 455 | 726 | 997 | 1268 | 1539 | 1810 | 2081 |
| TMEL1030 | 185 | 456 | 727 | 998 | 1269 | 1540 | 1811 | 2082 |
| TMEL1031 | 186 | 457 | 728 | 999 | 1270 | 1541 | 1812 | 2083 |
| TMEL1032 | 187 | 458 | 729 | 1000 | 1271 | 1542 | 1813 | 2084 |
| TMEL1033 | 188 | 459 | 730 | 1001 | 1272 | 1543 | 1814 | 2085 |
| TMEL1034 | 189 | 460 | 731 | 1002 | 1273 | 1544 | 1815 | 2086 |
| TMEL1035 | 190 | 461 | 732 | 1003 | 1274 | 1545 | 1816 | 2087 |
| TMEL1036 | 191 | 462 | 733 | 1004 | 1275 | 1546 | 1817 | 2088 |
| TMEL1037 | 192 | 463 | 734 | 1005 | 1276 | 1547 | 1818 | 2089 |
| TMEL1038 | 193 | 464 | 735 | 1006 | 1277 | 1548 | 1819 | 2090 |
| TMEL1039 | 194 | 465 | 736 | 1007 | 1278 | 1549 | 1820 | 2091 |
| TMEL1040 | 195 | 466 | 737 | 1008 | 1279 | 1550 | 1821 | 2092 |
| TMEL1041 | 196 | 467 | 738 | 1009 | 1280 | 1551 | 1822 | 2093 |
| TMES1001 | 197 | 468 | 739 | 1010 | 1281 | 1552 | 1823 | 2094 |
| TMES1002 | 198 | 469 | 740 | 1011 | 1282 | 1553 | 1824 | 2095 |
| TMES1003 | 199 | 470 | 741 | 1012 | 1283 | 1554 | 1825 | 2096 |
| TMES1004 | 200 | 471 | 742 | 1013 | 1284 | 1555 | 1826 | 2097 |
| TOVA1001 | 201 | 472 | 743 | 1014 | 1285 | 1556 | 1827 | 2098 |
| TOVA1002 | 202 | 473 | 744 | 1015 | 1286 | 1557 | 1828 | 2099 |
| TOVA1003 | 203 | 474 | 745 | 1016 | 1287 | 1558 | 1829 | 2100 |
| TOVA1004 | 204 | 475 | 746 | 1017 | 1288 | 1559 | 1830 | 2101 |
| TOVA1005 | 205 | 476 | 747 | 1018 | 1289 | 1560 | 1831 | 2102 |
| TOVA1006 | 206 | 477 | 748 | 1019 | 1290 | 1561 | 1832 | 2103 |
| TOVA1007 | 207 | 478 | 749 | 1020 | 1291 | 1562 | 1833 | 2104 |
| TOVA1008 | 208 | 479 | 750 | 1021 | 1292 | 1563 | 1834 | 2105 |
| TPAN1001 | 209 | 480 | 751 | 1022 | 1293 | 1564 | 1835 | 2106 |
| TPAN1002 | 210 | 481 | 752 | 1023 | 1294 | 1565 | 1836 | 2107 |
| TPAN1003 | 211 | 482 | 753 | 1024 | 1295 | 1566 | 1837 | 2108 |
| TPAN1004 | 212 | 483 | 754 | 1025 | 1296 | 1567 | 1838 | 2109 |

-continued

| | SEQ ID NO: | | | | | | | |
|---|---|---|---|---|---|---|---|---|
| | Variable Region | | CDR1 | | CDR2 | | CDR3 | |
| Antibody name | Heavy chain ($V_H$) | Light chain ($V_L$) | Heavy chain (CDR-H1) | Light chain (CDR-L1) | Heavy chain CDR-H2 | Light chain (CDR-L2) | Heavy chain (CDR-H3) | Light chain (CDR-L3) |
| TPAN1005 | 213 | 484 | 755 | 1026 | 1297 | 1568 | 1839 | 2110 |
| TPAN1006 | 214 | 485 | 756 | 1027 | 1298 | 1569 | 1840 | 2111 |
| TPAN1007 | 215 | 486 | 757 | 1028 | 1299 | 1570 | 1841 | 2112 |
| TPHE1001 | 216 | 487 | 758 | 1029 | 1300 | 1571 | 1842 | 2113 |
| TPRO1001 | 217 | 488 | 759 | 1030 | 1301 | 1572 | 1843 | 2114 |
| TPRO1002 | 218 | 489 | 760 | 1031 | 1302 | 1573 | 1844 | 2115 |
| TPRO1003 | 219 | 490 | 761 | 1032 | 1303 | 1574 | 1845 | 2116 |
| TREC1001 | 220 | 491 | 762 | 1033 | 1304 | 1575 | 1846 | 2117 |
| TREC1002 | 221 | 492 | 763 | 1034 | 1305 | 1576 | 1847 | 2118 |
| TREC1003 | 222 | 493 | 764 | 1035 | 1306 | 1577 | 1848 | 2119 |
| TSAR1001 | 223 | 494 | 765 | 1036 | 1307 | 1578 | 1849 | 2120 |
| TSAR1002 | 224 | 495 | 766 | 1037 | 1308 | 1579 | 1850 | 2121 |
| TSAR1003 | 225 | 496 | 767 | 1038 | 1309 | 1580 | 1851 | 2122 |
| TSAR1004 | 226 | 497 | 768 | 1039 | 1310 | 1581 | 1852 | 2123 |
| TSAR1005 | 227 | 498 | 769 | 1040 | 1311 | 1582 | 1853 | 2124 |
| TSAR1006 | 228 | 499 | 770 | 1041 | 1312 | 1583 | 1854 | 2125 |
| TSAR1007 | 229 | 500 | 771 | 1042 | 1313 | 1584 | 1855 | 2126 |
| TSAR1008 | 230 | 501 | 772 | 1043 | 1314 | 1585 | 1856 | 2127 |
| TSTO1001 | 231 | 502 | 773 | 1044 | 1315 | 1586 | 1857 | 2128 |
| TSTO1002 | 232 | 503 | 774 | 1045 | 1316 | 1587 | 1858 | 2129 |
| TSTO1003 | 233 | 504 | 775 | 1046 | 1317 | 1588 | 1859 | 2130 |
| TSTO1004 | 234 | 505 | 776 | 1047 | 1318 | 1589 | 1860 | 2131 |
| TSTO1005 | 235 | 506 | 777 | 1048 | 1319 | 1590 | 1861 | 2132 |
| TSTO1006 | 236 | 507 | 778 | 1049 | 1320 | 1591 | 1862 | 2133 |
| TSTO1007 | 237 | 508 | 779 | 1050 | 1321 | 1592 | 1863 | 2134 |
| TSTO1008 | 238 | 509 | 780 | 1051 | 1322 | 1593 | 1864 | 2135 |
| TSTO1009 | 239 | 510 | 781 | 1052 | 1323 | 1594 | 1865 | 2136 |
| TSTO1010 | 240 | 511 | 782 | 1053 | 1324 | 1595 | 1866 | 2137 |
| TTES1001 | 241 | 512 | 783 | 1054 | 1325 | 1596 | 1867 | 2138 |
| TTES1002 | 242 | 513 | 784 | 1055 | 1326 | 1597 | 1868 | 2139 |
| TTES1003 | 243 | 514 | 785 | 1056 | 1327 | 1598 | 1869 | 2140 |
| TTES1004 | 244 | 515 | 786 | 1057 | 1328 | 1599 | 1870 | 2141 |
| TTES1005 | 245 | 516 | 787 | 1058 | 1329 | 1600 | 1871 | 2142 |
| TTES1006 | 246 | 517 | 788 | 1059 | 1330 | 1601 | 1872 | 2143 |
| TTES1007 | 247 | 518 | 789 | 1060 | 1331 | 1602 | 1873 | 2144 |
| TTES1008 | 248 | 519 | 790 | 1061 | 1332 | 1603 | 1874 | 2145 |
| TTES1009 | 249 | 520 | 791 | 1062 | 1333 | 1604 | 1875 | 2146 |
| TTES1010 | 250 | 521 | 792 | 1063 | 1334 | 1605 | 1876 | 2147 |
| TTES1011 | 251 | 522 | 793 | 1064 | 1335 | 1606 | 1877 | 2148 |
| TTES1012 | 252 | 523 | 794 | 1065 | 1336 | 1607 | 1878 | 2149 |
| TTHY1001 | 253 | 524 | 795 | 1066 | 1337 | 1608 | 1879 | 2150 |
| TTHY1002 | 254 | 525 | 796 | 1067 | 1338 | 1609 | 1880 | 2151 |
| TTHY1003 | 255 | 526 | 797 | 1068 | 1339 | 1610 | 1881 | 2152 |
| TTHY1004 | 256 | 527 | 798 | 1069 | 1340 | 1611 | 1882 | 2153 |
| TUCE1001 | 257 | 528 | 799 | 1070 | 1341 | 1612 | 1883 | 2154 |
| TUCE1002 | 258 | 529 | 800 | 1071 | 1342 | 1613 | 1884 | 2155 |
| TUCE1003 | 259 | 530 | 801 | 1072 | 1343 | 1614 | 1885 | 2156 |
| TUCE1004 | 260 | 531 | 802 | 1073 | 1344 | 1615 | 1886 | 2157 |
| TUCE1005 | 261 | 532 | 803 | 1074 | 1345 | 1616 | 1887 | 2158 |
| TUCE1006 | 262 | 533 | 804 | 1075 | 1346 | 1617 | 1888 | 2159 |
| TUCE1007 | 263 | 534 | 805 | 1076 | 1347 | 1618 | 1889 | 2160 |
| TUCE1008 | 264 | 535 | 806 | 1077 | 1348 | 1619 | 1890 | 2161 |
| TUCE1009 | 265 | 536 | 807 | 1078 | 1349 | 1620 | 1891 | 2162 |
| TUCE1010 | 266 | 537 | 808 | 1079 | 1350 | 1621 | 1892 | 2163 |
| TUCS1001 | 267 | 538 | 809 | 1080 | 1351 | 1622 | 1893 | 2164 |
| TUCS1002 | 268 | 539 | 810 | 1081 | 1352 | 1623 | 1894 | 2165 |
| TUCS1003 | 269 | 540 | 811 | 1082 | 1353 | 1624 | 1895 | 2166 |
| TUVM1001 | 270 | 541 | 812 | 1083 | 1354 | 1625 | 1896 | 2167 |
| TUVM1002 | 271 | 542 | 813 | 1084 | 1355 | 1626 | 1897 | 2168 |

Table 2 lists SEQ ID NOs of exemplary nucleic acid sequences of heavy chain, light chain, and complementarity-determining regions of the antibodies disclosed herein or antigen binding fragment thereof. Corresponding nucleic acid sequences are provided in the sequence listing submitted herewith

| | SEQ ID NO: | | | | | | | |
|---|---|---|---|---|---|---|---|---|
| | Variable Region | | CDR1 | | CDR2 | | CDR3 | |
| Antibody name | Heavy chain ($V_H$) | Light chain ($V_L$) | Heavy chain (CDR-H1) | Light chain (CDR-L1) | Heavy chain (CDR-H2) | Light chain (CDR-L2) | Heavy chain (CDR-H3) | Light chain (CDR-L3) |
| TBLA1001 | 2169 | 2440 | 2711 | 2982 | 3253 | 3524 | 3795 | 4066 |
| TBLA1002 | 2170 | 2441 | 2712 | 2983 | 3254 | 3525 | 3796 | 4067 |
| TBLA1003 | 2171 | 2442 | 2713 | 2984 | 3255 | 3526 | 3797 | 4068 |
| TBLA1004 | 2172 | 2443 | 2714 | 2985 | 3256 | 3527 | 3798 | 4069 |
| TBLA1005 | 2173 | 2444 | 2715 | 2986 | 3257 | 3528 | 3799 | 4070 |
| TBLA1006 | 2174 | 2445 | 2716 | 2987 | 3258 | 3529 | 3800 | 4071 |
| TBLA1007 | 2175 | 2446 | 2717 | 2988 | 3259 | 3530 | 3801 | 4072 |
| TBLA1008 | 2176 | 2447 | 2718 | 2989 | 3260 | 3531 | 3802 | 4073 |
| TBLA1009 | 2177 | 2448 | 2719 | 2990 | 3261 | 3532 | 3803 | 4074 |
| TBLA1010 | 2178 | 2449 | 2720 | 2991 | 3262 | 3533 | 3804 | 4075 |
| TBLA1011 | 2179 | 2450 | 2721 | 2992 | 3263 | 3534 | 3805 | 4076 |
| TBLA1012 | 2180 | 2451 | 2722 | 2993 | 3264 | 3535 | 3806 | 4077 |
| TBLA1013 | 2181 | 2452 | 2723 | 2994 | 3265 | 3536 | 3807 | 4078 |
| TBRE1001 | 2182 | 2453 | 2724 | 2995 | 3266 | 3537 | 3808 | 4079 |
| TBRE1002 | 2183 | 2454 | 2725 | 2996 | 3267 | 3538 | 3809 | 4080 |
| TBRE1003 | 2184 | 2455 | 2726 | 2997 | 3268 | 3539 | 3810 | 4081 |
| TBRE1004 | 2185 | 2456 | 2727 | 2998 | 3269 | 3540 | 3811 | 4082 |
| TBRE1005 | 2186 | 2457 | 2728 | 2999 | 3270 | 3541 | 3812 | 4083 |
| TBRE1006 | 2187 | 2458 | 2729 | 3000 | 3271 | 3542 | 3813 | 4084 |
| TBRE1007 | 2188 | 2459 | 2730 | 3001 | 3272 | 3543 | 3814 | 4085 |
| TBRE1008 | 2189 | 2460 | 2731 | 3002 | 3273 | 3544 | 3815 | 4086 |
| TBRE1009 | 2190 | 2461 | 2732 | 3003 | 3274 | 3545 | 3816 | 4087 |
| TBRE1010 | 2191 | 2462 | 2733 | 3004 | 3275 | 3546 | 3817 | 4088 |
| TBRE1011 | 2192 | 2463 | 2734 | 3005 | 3276 | 3547 | 3818 | 4089 |
| TBRE1012 | 2193 | 2464 | 2735 | 3006 | 3277 | 3548 | 3819 | 4090 |
| TBRE1013 | 2194 | 2465 | 2736 | 3007 | 3278 | 3549 | 3820 | 4091 |
| TBRE1014 | 2195 | 2466 | 2737 | 3008 | 3279 | 3550 | 3821 | 4092 |
| TBRE1015 | 2196 | 2467 | 2738 | 3009 | 3280 | 3551 | 3822 | 4093 |
| TBRE1016 | 2197 | 2468 | 2739 | 3010 | 3281 | 3552 | 3823 | 4094 |
| TBRE1017 | 2198 | 2469 | 2740 | 3011 | 3282 | 3553 | 3824 | 4095 |
| TBRE1018 | 2199 | 2470 | 2741 | 3012 | 3283 | 3554 | 3825 | 4096 |
| TBRE1019 | 2200 | 2471 | 2742 | 3013 | 3284 | 3555 | 3826 | 4097 |
| TBRE1020 | 2201 | 2472 | 2743 | 3014 | 3285 | 3556 | 3827 | 4098 |
| TBRE1021 | 2202 | 2473 | 2744 | 3015 | 3286 | 3557 | 3828 | 4099 |
| TBRE1022 | 2203 | 2474 | 2745 | 3016 | 3287 | 3558 | 3829 | 4100 |
| TBRE1023 | 2204 | 2475 | 2746 | 3017 | 3288 | 3559 | 3830 | 4101 |
| TBRE1024 | 2205 | 2476 | 2747 | 3018 | 3289 | 3560 | 3831 | 4102 |
| TBRE1025 | 2206 | 2477 | 2748 | 3019 | 3290 | 3561 | 3832 | 4103 |
| TBRE1026 | 2207 | 2478 | 2749 | 3020 | 3291 | 3562 | 3833 | 4104 |
| TBRE1027 | 2208 | 2479 | 2750 | 3021 | 3292 | 3563 | 3834 | 4105 |
| TBRE1028 | 2209 | 2480 | 2751 | 3022 | 3293 | 3564 | 3835 | 4106 |
| TBRE1029 | 2210 | 2481 | 2752 | 3023 | 3294 | 3565 | 3836 | 4107 |
| TBRE1030 | 2211 | 2482 | 2753 | 3024 | 3295 | 3566 | 3837 | 4108 |
| TBRE1031 | 2212 | 2483 | 2754 | 3025 | 3296 | 3567 | 3838 | 4109 |
| TBRE1032 | 2213 | 2484 | 2755 | 3026 | 3297 | 3568 | 3839 | 4110 |
| TBRE1033 | 2214 | 2485 | 2756 | 3027 | 3298 | 3569 | 3840 | 4111 |
| TBRE1034 | 2215 | 2486 | 2757 | 3028 | 3299 | 3570 | 3841 | 4112 |
| TBRE1035 | 2216 | 2487 | 2758 | 3029 | 3300 | 3571 | 3842 | 4113 |
| TBRE1036 | 2217 | 2488 | 2759 | 3030 | 3301 | 3572 | 3843 | 4114 |
| TBRE1037 | 2218 | 2489 | 2760 | 3031 | 3302 | 3573 | 3844 | 4115 |
| TBRE1038 | 2219 | 2490 | 2761 | 3032 | 3303 | 3574 | 3845 | 4116 |
| TBRE1039 | 2220 | 2491 | 2762 | 3033 | 3304 | 3575 | 3846 | 4117 |
| TBRE1040 | 2221 | 2492 | 2763 | 3034 | 3305 | 3576 | 3847 | 4118 |
| TBRE1041 | 2222 | 2493 | 2764 | 3035 | 3306 | 3577 | 3848 | 4119 |
| TBRE1042 | 2223 | 2494 | 2765 | 3036 | 3307 | 3578 | 3849 | 4120 |
| TBRE1043 | 2224 | 2495 | 2766 | 3037 | 3308 | 3579 | 3850 | 4121 |
| TBRE1044 | 2225 | 2496 | 2767 | 3038 | 3309 | 3580 | 3851 | 4122 |
| TBRE1045 | 2226 | 2497 | 2768 | 3039 | 3310 | 3581 | 3852 | 4123 |
| TBRE1046 | 2227 | 2498 | 2769 | 3040 | 3311 | 3582 | 3853 | 4124 |
| TBRE1047 | 2228 | 2499 | 2770 | 3041 | 3312 | 3583 | 3854 | 4125 |
| TBRE1048 | 2229 | 2500 | 2771 | 3042 | 3313 | 3584 | 3855 | 4126 |
| TBRE1049 | 2230 | 2501 | 2772 | 3043 | 3314 | 3585 | 3856 | 4127 |
| TBRE1050 | 2231 | 2502 | 2773 | 3044 | 3315 | 3586 | 3857 | 4128 |
| TBRE1051 | 2232 | 2503 | 2774 | 3045 | 3316 | 3587 | 3858 | 4129 |
| TBRE1052 | 2233 | 2504 | 2775 | 3046 | 3317 | 3588 | 3859 | 4130 |
| TBRE1053 | 2234 | 2505 | 2776 | 3047 | 3318 | 3589 | 3860 | 4131 |
| TBRE1054 | 2235 | 2506 | 2777 | 3048 | 3319 | 3590 | 3861 | 4132 |

-continued

| | SEQ ID NO: | | | | | | | |
|---|---|---|---|---|---|---|---|---|
| | Variable Region | | CDR1 | | CDR2 | | CDR3 | |
| Antibody name | Heavy chain ($V_H$) | Light chain ($V_L$) | Heavy chain (CDR-H1) | Light chain (CDR-L1) | Heavy chain (CDR-H2) | Light chain (CDR-L2) | Heavy chain (CDR-H3) | Light chain (CDR-L3) |
| TBRE1055 | 2236 | 2507 | 2778 | 3049 | 3320 | 3591 | 3862 | 4133 |
| TBRE1056 | 2237 | 2508 | 2779 | 3050 | 3321 | 3592 | 3863 | 4134 |
| TBRE1057 | 2238 | 2509 | 2780 | 3051 | 3322 | 3593 | 3864 | 4135 |
| TBRE1058 | 2239 | 2510 | 2781 | 3052 | 3323 | 3594 | 3865 | 4136 |
| TCER1001 | 2240 | 2511 | 2782 | 3053 | 3324 | 3595 | 3866 | 4137 |
| TCER1002 | 2241 | 2512 | 2783 | 3054 | 3325 | 3596 | 3867 | 4138 |
| TCER1003 | 2242 | 2513 | 2784 | 3055 | 3326 | 3597 | 3868 | 4139 |
| TCER1004 | 2243 | 2514 | 2785 | 3056 | 3327 | 3598 | 3869 | 4140 |
| TCER1005 | 2244 | 2515 | 2786 | 3057 | 3328 | 3599 | 3870 | 4141 |
| TCER1006 | 2245 | 2516 | 2787 | 3058 | 3329 | 3600 | 3871 | 4142 |
| TCER1007 | 2246 | 2517 | 2788 | 3059 | 3330 | 3601 | 3872 | 4143 |
| TCH01001 | 2247 | 2518 | 2789 | 3060 | 3331 | 3602 | 3873 | 4144 |
| TCOL1001 | 2248 | 2519 | 2790 | 3061 | 3332 | 3603 | 3874 | 4145 |
| TCOL1002 | 2249 | 2520 | 2791 | 3062 | 3333 | 3604 | 3875 | 4146 |
| TCOL1003 | 2250 | 2521 | 2792 | 3063 | 3334 | 3605 | 3876 | 4147 |
| TCOL1004 | 2251 | 2522 | 2793 | 3064 | 3335 | 3606 | 3877 | 4148 |
| TCOL1005 | 2252 | 2523 | 2794 | 3065 | 3336 | 3607 | 3878 | 4149 |
| TCOL1006 | 2253 | 2524 | 2795 | 3066 | 3337 | 3608 | 3879 | 4150 |
| TCOL1007 | 2254 | 2525 | 2796 | 3067 | 3338 | 3609 | 3880 | 4151 |
| TCOL1008 | 2255 | 2526 | 2797 | 3068 | 3339 | 3610 | 3881 | 4152 |
| TCOL1009 | 2256 | 2527 | 2798 | 3069 | 3340 | 3611 | 3882 | 4153 |
| TESO1001 | 2257 | 2528 | 2799 | 3070 | 3341 | 3612 | 3883 | 4154 |
| TESO1002 | 2258 | 2529 | 2800 | 3071 | 3342 | 3613 | 3884 | 4155 |
| TESO1003 | 2259 | 2530 | 2801 | 3072 | 3343 | 3614 | 3885 | 4156 |
| TESO1004 | 2260 | 2531 | 2802 | 3073 | 3344 | 3615 | 3886 | 4157 |
| TESO1005 | 2261 | 2532 | 2803 | 3074 | 3345 | 3616 | 3887 | 4158 |
| TESO1006 | 2262 | 2533 | 2804 | 3075 | 3346 | 3617 | 3888 | 4159 |
| TESO1007 | 2263 | 2534 | 2805 | 3076 | 3347 | 3618 | 3889 | 4160 |
| THNS1001 | 2264 | 2535 | 2806 | 3077 | 3348 | 3619 | 3890 | 4161 |
| THNS1002 | 2265 | 2536 | 2807 | 3078 | 3349 | 3620 | 3891 | 4162 |
| THNS1003 | 2266 | 2537 | 2808 | 3079 | 3350 | 3621 | 3892 | 4163 |
| THNS1004 | 2267 | 2538 | 2809 | 3080 | 3351 | 3622 | 3893 | 4164 |
| THNS1005 | 2268 | 2539 | 2810 | 3081 | 3352 | 3623 | 3894 | 4165 |
| THNS1006 | 2269 | 2540 | 2811 | 3082 | 3353 | 3624 | 3895 | 4166 |
| THNS1007 | 2270 | 2541 | 2812 | 3083 | 3354 | 3625 | 3896 | 4167 |
| THNS1008 | 2271 | 2542 | 2813 | 3084 | 3355 | 3626 | 3897 | 4168 |
| THNS1009 | 2272 | 2543 | 2814 | 3085 | 3356 | 3627 | 3898 | 4169 |
| THNS1010 | 2273 | 2544 | 2815 | 3086 | 3357 | 3628 | 3899 | 4170 |
| THNS1011 | 2274 | 2545 | 2816 | 3087 | 3358 | 3629 | 3900 | 4171 |
| THNS1012 | 2275 | 2546 | 2817 | 3088 | 3359 | 3630 | 3901 | 4172 |
| THNS1013 | 2276 | 2547 | 2818 | 3089 | 3360 | 3631 | 3902 | 4173 |
| THNS1014 | 2277 | 2548 | 2819 | 3090 | 3361 | 3632 | 3903 | 4174 |
| TKIC1001 | 2278 | 2549 | 2820 | 3091 | 3362 | 3633 | 3904 | 4175 |
| TKIC1002 | 2279 | 2550 | 2821 | 3092 | 3363 | 3634 | 3905 | 4176 |
| TKIC1003 | 2280 | 2551 | 2822 | 3093 | 3364 | 3635 | 3906 | 4177 |
| TKIC1004 | 2281 | 2552 | 2823 | 3094 | 3365 | 3636 | 3907 | 4178 |
| TKIC1005 | 2282 | 2553 | 2824 | 3095 | 3366 | 3637 | 3908 | 4179 |
| TKIC1006 | 2283 | 2554 | 2825 | 3096 | 3367 | 3638 | 3909 | 4180 |
| TKIC1007 | 2284 | 2555 | 2826 | 3097 | 3368 | 3639 | 3910 | 4181 |
| TKIC1008 | 2285 | 2556 | 2827 | 3098 | 3369 | 3640 | 3911 | 4182 |
| TKIC1009 | 2286 | 2557 | 2828 | 3099 | 3370 | 3641 | 3912 | 4183 |
| TKIC1010 | 2287 | 2558 | 2829 | 3100 | 3371 | 3642 | 3913 | 4184 |
| TKIC1011 | 2288 | 2559 | 2830 | 3101 | 3372 | 3643 | 3914 | 4185 |
| TKIC1012 | 2289 | 2560 | 2831 | 3102 | 3373 | 3644 | 3915 | 4186 |
| TKIC1013 | 2290 | 2561 | 2832 | 3103 | 3374 | 3645 | 3916 | 4187 |
| TKIC1014 | 2291 | 2562 | 2833 | 3104 | 3375 | 3646 | 3917 | 4188 |
| TKIC1015 | 2292 | 2563 | 2834 | 3105 | 3376 | 3647 | 3918 | 4189 |
| TKIC1016 | 2293 | 2564 | 2835 | 3106 | 3377 | 3648 | 3919 | 4190 |
| TKIC1017 | 2294 | 2565 | 2836 | 3107 | 3378 | 3649 | 3920 | 4191 |
| TKIC1018 | 2295 | 2566 | 2837 | 3108 | 3379 | 3650 | 3921 | 4192 |
| TKIC1019 | 2296 | 2567 | 2838 | 3109 | 3380 | 3651 | 3922 | 4193 |
| TKIC1020 | 2297 | 2568 | 2839 | 3110 | 3381 | 3652 | 3923 | 4194 |
| TKIP1001 | 2298 | 2569 | 2840 | 3111 | 3382 | 3653 | 3924 | 4195 |
| TKIP1002 | 2299 | 2570 | 2841 | 3112 | 3383 | 3654 | 3925 | 4196 |
| TKIP1003 | 2300 | 2571 | 2842 | 3113 | 3384 | 3655 | 3926 | 4197 |
| TKIP1004 | 2301 | 2572 | 2843 | 3114 | 3385 | 3656 | 3927 | 4198 |
| TKIP1005 | 2302 | 2573 | 2844 | 3115 | 3386 | 3657 | 3928 | 4199 |
| TKIP1006 | 2303 | 2574 | 2845 | 3116 | 3387 | 3658 | 3929 | 4200 |
| TLGG1001 | 2304 | 2575 | 2846 | 3117 | 3388 | 3659 | 3930 | 4201 |
| TLIV1001 | 2305 | 2576 | 2847 | 3118 | 3389 | 3660 | 3931 | 4202 |

-continued

| | SEQ ID NO: | | | | | | | |
|---|---|---|---|---|---|---|---|---|
| | Variable Region | | CDR1 | | CDR2 | | CDR3 | |
| Antibody name | Heavy chain ($V_H$) | Light chain ($V_L$) | Heavy chain (CDR-H1) | Light chain (CDR-L1) | Heavy chain (CDR-H2) | Light chain (CDR-L2) | Heavy chain (CDR-H3) | Light chain (CDR-L3) |
| TLIV1002 | 2306 | 2577 | 2848 | 3119 | 3390 | 3661 | 3932 | 4203 |
| TLIV1003 | 2307 | 2578 | 2849 | 3120 | 3391 | 3662 | 3933 | 4204 |
| TLIV1004 | 2308 | 2579 | 2850 | 3121 | 3392 | 3663 | 3934 | 4205 |
| TLUA1001 | 2309 | 2580 | 2851 | 3122 | 3393 | 3664 | 3935 | 4206 |
| TLUA1002 | 2310 | 2581 | 2852 | 3123 | 3394 | 3665 | 3936 | 4207 |
| TLUA1003 | 2311 | 2582 | 2853 | 3124 | 3395 | 3666 | 3937 | 4208 |
| TLUA1004 | 2312 | 2583 | 2854 | 3125 | 3396 | 3667 | 3938 | 4209 |
| TLUA1005 | 2313 | 2584 | 2855 | 3126 | 3397 | 3668 | 3939 | 4210 |
| TLUA1006 | 2314 | 2585 | 2856 | 3127 | 3398 | 3669 | 3940 | 4211 |
| TLUA1007 | 2315 | 2586 | 2857 | 3128 | 3399 | 3670 | 3941 | 4212 |
| TLUA1008 | 2316 | 2587 | 2858 | 3129 | 3400 | 3671 | 3942 | 4213 |
| TLUA1009 | 2317 | 2588 | 2859 | 3130 | 3401 | 3672 | 3943 | 4214 |
| TLUA1010 | 2318 | 2589 | 2860 | 3131 | 3402 | 3673 | 3944 | 4215 |
| TLUA1011 | 2319 | 2590 | 2861 | 3132 | 3403 | 3674 | 3945 | 4216 |
| TLUA1012 | 2320 | 2591 | 2862 | 3133 | 3404 | 3675 | 3946 | 4217 |
| TLUA1013 | 2321 | 2592 | 2863 | 3134 | 3405 | 3676 | 3947 | 4218 |
| TLUA1014 | 2322 | 2593 | 2864 | 3135 | 3406 | 3677 | 3948 | 4219 |
| TLUA1015 | 2323 | 2594 | 2865 | 3136 | 3407 | 3678 | 3949 | 4220 |
| TLUA1016 | 2324 | 2595 | 2866 | 3137 | 3408 | 3679 | 3950 | 4221 |
| TLUA1017 | 2325 | 2596 | 2867 | 3138 | 3409 | 3680 | 3951 | 4222 |
| TLUA1018 | 2326 | 2597 | 2868 | 3139 | 3410 | 3681 | 3952 | 4223 |
| TLUS1001 | 2327 | 2598 | 2869 | 3140 | 3411 | 3682 | 3953 | 4224 |
| TLUS1002 | 2328 | 2599 | 2870 | 3141 | 3412 | 3683 | 3954 | 4225 |
| TLUS1003 | 2329 | 2600 | 2871 | 3142 | 3413 | 3684 | 3955 | 4226 |
| TLUS1004 | 2330 | 2601 | 2872 | 3143 | 3414 | 3685 | 3956 | 4227 |
| TLUS1005 | 2331 | 2602 | 2873 | 3144 | 3415 | 3686 | 3957 | 4228 |
| TLUS1006 | 2332 | 2603 | 2874 | 3145 | 3416 | 3687 | 3958 | 4229 |
| TLUS1007 | 2333 | 2604 | 2875 | 3146 | 3417 | 3688 | 3959 | 4230 |
| TLUS1008 | 2334 | 2605 | 2876 | 3147 | 3418 | 3689 | 3960 | 4231 |
| TLUS1009 | 2335 | 2606 | 2877 | 3148 | 3419 | 3690 | 3961 | 4232 |
| TLUS1010 | 2336 | 2607 | 2878 | 3149 | 3420 | 3691 | 3962 | 4233 |
| TLUS1011 | 2337 | 2608 | 2879 | 3150 | 3421 | 3692 | 3963 | 4234 |
| TMEL1015 | 2338 | 2609 | 2880 | 3151 | 3422 | 3693 | 3964 | 4235 |
| TMEL1016 | 2339 | 2610 | 2881 | 3152 | 3423 | 3694 | 3965 | 4236 |
| TMEL1017 | 2340 | 2611 | 2882 | 3153 | 3424 | 3695 | 3966 | 4237 |
| TMEL1018 | 2341 | 2612 | 2883 | 3154 | 3425 | 3696 | 3967 | 4238 |
| TMEL1019 | 2342 | 2613 | 2884 | 3155 | 3426 | 3697 | 3968 | 4239 |
| TMEL1020 | 2343 | 2614 | 2885 | 3156 | 3427 | 3698 | 3969 | 4240 |
| TMEL1021 | 2344 | 2615 | 2886 | 3157 | 3428 | 3699 | 3970 | 4241 |
| TMEL1022 | 2345 | 2616 | 2887 | 3158 | 3429 | 3700 | 3971 | 4242 |
| TMEL1023 | 2346 | 2617 | 2888 | 3159 | 3430 | 3701 | 3972 | 4243 |
| TMEL1024 | 2347 | 2618 | 2889 | 3160 | 3431 | 3702 | 3973 | 4244 |
| TMEL1025 | 2348 | 2619 | 2890 | 3161 | 3432 | 3703 | 3974 | 4245 |
| TMEL1026 | 2349 | 2620 | 2891 | 3162 | 3433 | 3704 | 3975 | 4246 |
| TMEL1027 | 2350 | 2621 | 2892 | 3163 | 3434 | 3705 | 3976 | 4247 |
| TMEL1028 | 2351 | 2622 | 2893 | 3164 | 3435 | 3706 | 3977 | 4248 |
| TMEL1029 | 2352 | 2623 | 2894 | 3165 | 3436 | 3707 | 3978 | 4249 |
| TMEL1030 | 2353 | 2624 | 2895 | 3166 | 3437 | 3708 | 3979 | 4250 |
| TMEL1031 | 2354 | 2625 | 2896 | 3167 | 3438 | 3709 | 3980 | 4251 |
| TMEL1032 | 2355 | 2626 | 2897 | 3168 | 3439 | 3710 | 3981 | 4252 |
| TMEL1033 | 2356 | 2627 | 2898 | 3169 | 3440 | 3711 | 3982 | 4253 |
| TMEL1034 | 2357 | 2628 | 2899 | 3170 | 3441 | 3712 | 3983 | 4254 |
| TMEL1035 | 2358 | 2629 | 2900 | 3171 | 3442 | 3713 | 3984 | 4255 |
| TMEL1036 | 2359 | 2630 | 2901 | 3172 | 3443 | 3714 | 3985 | 4256 |
| TMEL1037 | 2360 | 2631 | 2902 | 3173 | 3444 | 3715 | 3986 | 4257 |
| TMEL1038 | 2361 | 2632 | 2903 | 3174 | 3445 | 3716 | 3987 | 4258 |
| TMEL1039 | 2362 | 2633 | 2904 | 3175 | 3446 | 3717 | 3988 | 4259 |
| TMEL1040 | 2363 | 2634 | 2905 | 3176 | 3447 | 3718 | 3989 | 4260 |
| TMEL1041 | 2364 | 2635 | 2906 | 3177 | 3448 | 3719 | 3990 | 4261 |
| TMES1001 | 2365 | 2636 | 2907 | 3178 | 3449 | 3720 | 3991 | 4262 |
| TMES1002 | 2366 | 2637 | 2908 | 3179 | 3450 | 3721 | 3992 | 4263 |
| TMES1003 | 2367 | 2638 | 2909 | 3180 | 3451 | 3722 | 3993 | 4264 |
| TMES1004 | 2368 | 2639 | 2910 | 3181 | 3452 | 3723 | 3994 | 4265 |
| TOVA1001 | 2369 | 2640 | 2911 | 3182 | 3453 | 3724 | 3995 | 4266 |
| TOVA1002 | 2370 | 2641 | 2912 | 3183 | 3454 | 3725 | 3996 | 4267 |
| TOVA1003 | 2371 | 2642 | 2913 | 3184 | 3455 | 3726 | 3997 | 4268 |
| TOVA1004 | 2372 | 2643 | 2914 | 3185 | 3456 | 3727 | 3998 | 4269 |
| TOVA1005 | 2373 | 2644 | 2915 | 3186 | 3457 | 3728 | 3999 | 4270 |
| TOVA1006 | 2374 | 2645 | 2916 | 3187 | 3458 | 3729 | 4000 | 4271 |
| TOVA1007 | 2375 | 2646 | 2917 | 3188 | 3459 | 3730 | 4001 | 4272 |

-continued

| | SEQ ID NO: | | | | | | | |
|---|---|---|---|---|---|---|---|---|
| | Variable Region | | CDR1 | | CDR2 | | CDR3 | |
| Antibody name | Heavy chain (V$_H$) | Light chain (V$_L$) | Heavy chain (CDR-H1) | Light chain (CDR-L1) | Heavy chain (CDR-H2) | Light chain (CDR-L2) | Heavy chain (CDR-H3) | Light chain (CDR-L3) |
| TOVA1008 | 2376 | 2647 | 2918 | 3189 | 3460 | 3731 | 4002 | 4273 |
| TPAN1001 | 2377 | 2648 | 2919 | 3190 | 3461 | 3732 | 4003 | 4274 |
| TPAN1002 | 2378 | 2649 | 2920 | 3191 | 3462 | 3733 | 4004 | 4275 |
| TPAN1003 | 2379 | 2650 | 2921 | 3192 | 3463 | 3734 | 4005 | 4276 |
| TPAN1004 | 2380 | 2651 | 2922 | 3193 | 3464 | 3735 | 4006 | 4277 |
| TPAN1005 | 2381 | 2652 | 2923 | 3194 | 3465 | 3736 | 4007 | 4278 |
| TPAN1006 | 2382 | 2653 | 2924 | 3195 | 3466 | 3737 | 4008 | 4279 |
| TPAN1007 | 2383 | 2654 | 2925 | 3196 | 3467 | 3738 | 4009 | 4280 |
| TPHE1001 | 2384 | 2655 | 2926 | 3197 | 3468 | 3739 | 4010 | 4281 |
| TPRO1001 | 2385 | 2656 | 2927 | 3198 | 3469 | 3740 | 4011 | 4282 |
| TPRO1002 | 2386 | 2657 | 2928 | 3199 | 3470 | 3741 | 4012 | 4283 |
| TPRO1003 | 2387 | 2658 | 2929 | 3200 | 3471 | 3742 | 4013 | 4284 |
| TREC1001 | 2388 | 2659 | 2930 | 3201 | 3472 | 3743 | 4014 | 4285 |
| TREC1002 | 2389 | 2660 | 2931 | 3202 | 3473 | 3744 | 4015 | 4286 |
| TREC1003 | 2390 | 2661 | 2932 | 3203 | 3474 | 3745 | 4016 | 4287 |
| TSAR1001 | 2391 | 2662 | 2933 | 3204 | 3475 | 3746 | 4017 | 4288 |
| TSAR1002 | 2392 | 2663 | 2934 | 3205 | 3476 | 3747 | 4018 | 4289 |
| TSAR1003 | 2393 | 2664 | 2935 | 3206 | 3477 | 3748 | 4019 | 4290 |
| TSAR1004 | 2394 | 2665 | 2936 | 3207 | 3478 | 3749 | 4020 | 4291 |
| TSAR1005 | 2395 | 2666 | 2937 | 3208 | 3479 | 3750 | 4021 | 4292 |
| TSAR1006 | 2396 | 2667 | 2938 | 3209 | 3480 | 3751 | 4022 | 4293 |
| TSAR1007 | 2397 | 2668 | 2939 | 3210 | 3481 | 3752 | 4023 | 4294 |
| TSAR1008 | 2398 | 2669 | 2940 | 3211 | 3482 | 3753 | 4024 | 4295 |
| TSTO1001 | 2399 | 2670 | 2941 | 3212 | 3483 | 3754 | 4025 | 4296 |
| TSTO1002 | 2400 | 2671 | 2942 | 3213 | 3484 | 3755 | 4026 | 4297 |
| TSTO1003 | 2401 | 2672 | 2943 | 3214 | 3485 | 3756 | 4027 | 4298 |
| TSTO1004 | 2402 | 2673 | 2944 | 3215 | 3486 | 3757 | 4028 | 4299 |
| TSTO1005 | 2403 | 2674 | 2945 | 3216 | 3487 | 3758 | 4029 | 4300 |
| TSTO1006 | 2404 | 2675 | 2946 | 3217 | 3488 | 3759 | 4030 | 4301 |
| TSTO1007 | 2405 | 2676 | 2947 | 3218 | 3489 | 3760 | 4031 | 4302 |
| TSTO1008 | 2406 | 2677 | 2948 | 3219 | 3490 | 3761 | 4032 | 4303 |
| TSTO1009 | 2407 | 2678 | 2949 | 3220 | 3491 | 3762 | 4033 | 4304 |
| TSTO1010 | 2408 | 2679 | 2950 | 3221 | 3492 | 3763 | 4034 | 4305 |
| TTES1001 | 2409 | 2680 | 2951 | 3222 | 3493 | 3764 | 4035 | 4306 |
| TTES1002 | 2410 | 2681 | 2952 | 3223 | 3494 | 3765 | 4036 | 4307 |
| TTES1003 | 2411 | 2682 | 2953 | 3224 | 3495 | 3766 | 4037 | 4308 |
| TTES1004 | 2412 | 2683 | 2954 | 3225 | 3496 | 3767 | 4038 | 4309 |
| TTES1005 | 2413 | 2684 | 2955 | 3226 | 3497 | 3768 | 4039 | 4310 |
| TTES1006 | 2414 | 2685 | 2956 | 3227 | 3498 | 3769 | 4040 | 4311 |
| TTES1007 | 2415 | 2686 | 2957 | 3228 | 3499 | 3770 | 4041 | 4312 |
| TTES1008 | 2416 | 2687 | 2958 | 3229 | 3500 | 3771 | 4042 | 4313 |
| TTES1009 | 2417 | 2688 | 2959 | 3230 | 3501 | 3772 | 4043 | 4314 |
| TTES1010 | 2418 | 2689 | 2960 | 3231 | 3502 | 3773 | 4044 | 4315 |
| TTES1011 | 2419 | 2690 | 2961 | 3232 | 3503 | 3774 | 4045 | 4316 |
| TTES1012 | 2420 | 2691 | 2962 | 3233 | 3504 | 3775 | 4046 | 4317 |
| TTHY1001 | 2421 | 2692 | 2963 | 3234 | 3505 | 3776 | 4047 | 4318 |
| TTHY1002 | 2422 | 2693 | 2964 | 3235 | 3506 | 3777 | 4048 | 4319 |
| TTHY1003 | 2423 | 2694 | 2965 | 3236 | 3507 | 3778 | 4049 | 4320 |
| TTHY1004 | 2424 | 2695 | 2966 | 3237 | 3508 | 3779 | 4050 | 4321 |
| TUCE1001 | 2425 | 2696 | 2967 | 3238 | 3509 | 3780 | 4051 | 4322 |
| TUCE1002 | 2426 | 2697 | 2968 | 3239 | 3510 | 3781 | 4052 | 4323 |
| TUCE1003 | 2427 | 2698 | 2969 | 3240 | 3511 | 3782 | 4053 | 4324 |
| TUCE1004 | 2428 | 2699 | 2970 | 3241 | 3512 | 3783 | 4054 | 4325 |
| TUCE1005 | 2429 | 2700 | 2971 | 3242 | 3513 | 3784 | 4055 | 4326 |
| TUCE1006 | 2430 | 2701 | 2972 | 3243 | 3514 | 3785 | 4056 | 4327 |
| TUCE1007 | 2431 | 2702 | 2973 | 3244 | 3515 | 3786 | 4057 | 4328 |
| TUCE1008 | 2432 | 2703 | 2974 | 3245 | 3516 | 3787 | 4058 | 4329 |
| TUCE1009 | 2433 | 2704 | 2975 | 3246 | 3517 | 3788 | 4059 | 4330 |
| TUCE1010 | 2434 | 2705 | 2976 | 3247 | 3518 | 3789 | 4060 | 4331 |
| TUCS1001 | 2435 | 2706 | 2977 | 3248 | 3519 | 3790 | 4061 | 4332 |
| TUCS1002 | 2436 | 2707 | 2978 | 3249 | 3520 | 3791 | 4062 | 4333 |
| TUCS1003 | 2437 | 2708 | 2979 | 3250 | 3521 | 3792 | 4063 | 4334 |
| TUVM1001 | 2438 | 2709 | 2980 | 3251 | 3522 | 3793 | 4064 | 4335 |
| TUVM1002 | 2439 | 2710 | 2981 | 3252 | 3523 | 3794 | 4065 | 4336 |

Table 3 lists Exemplary target antigen (cancer associated antigen) identified for the antibodies disclosed herein. Binding specificity of an antibody to a target antigen is also listed

| Antibody Name | Antigen Abbreviated Name | Specificity | Antigen Full Name |
|---|---|---|---|
| TBLA1001 | RSPO1 | Medium | R-spondin 1, transcript variant 2 |
| TBLA1003 | ZDHHC1 | Medium | zinc finger DHHC-type containing 1, transcript variant 1 |
| TBLA1004 | RXRA | Very High | retinoid X receptor alpha, transcript variant 1 |
| TBLA1004 | RXRG | Very High | retinoid X receptor gamma, transcript variant 1 |
| TBLA1005 | TMEM154 | Medium | transmembrane protein 154 |
| TBLA1006 | SNAPIN | High | SNAP associated protein, transcript variant 1 |
| TBLA1007 | PYGL | Medium | glycogen phosphorylase L, transcript variant 1 |
| TBLA1007 | RCN3 | Medium | Reticulocalbin 3 |
| TBLA1007 | SYT12 | Medium | synaptotagmin 12, transcript variant X4 |
| TBLA1008 | Nr2f6 | Medium | Nuclear receptor subfamily 2 group f member 6 |
| TBLA1008 | PPP1R13L | Medium | protein phosphatase 1 regulatory subunit 13 like, transcript variant 2 |
| TBLA1010 | OR6Q1 | Medium | olfactory receptor family 6 subfamily Q member 1 (gene/pseudogene) |
| TBLA1011 | CTAG1A | Medium | cancer/testis antigen 1A |
| TBLA1012 | CTAG1A | Very High | cancer/testis antigen 1A |
| TBLA1013 | HTR1E | Medium | 5-hydroxytryptamine receptor 1E |
| TBRE1002 | MFAP3 | Medium | microfibril associated protein 3, transcript variant 3 |
| TBRE1004 | HABP4 | Very High | hyaluronan binding protein 4 |
| TBRE1006 | BC025996.2_frag | Medium | glucuronidase, beta pseudogene |
| TBRE1007 | DUSP12 | Medium | dual specificity phosphatase 12 |
| TBRE1007 | ACTN1 | Medium | actinin alpha 1, transcript variant 2 |
| TBRE1009 | ZKSCAN4 | Medium | zinc finger with KRAB and SCAN domains 4, transcript variant X1 |
| TBRE1011 | PNMA5 | High | PNMA family member 5, transcript variant 2 |
| TBRE1012 | KLHL40 | Very High | kelch like family member 40 |
| TBRE1012 | MPP2 | Very High | membrane palmitoylated protein 2, transcript variant 3 |
| TBRE1013 | BTN1A1 | High | butyrophilin subfamily 1 member A1 |
| TBRE1014 | PEX11G | High | peroxisomal biogenesis factor 11 gamma, transcript variant 1 |
| TBRE1017 | ZNF8 | Medium | zinc finger protein 8 |
| TBRE1017 | SATB2 | Medium | SATB homeobox 2, transcript variant 2 |
| TBRE1017 | GDAP1 | Medium | ganglioside induced differentiation associated protein 1, transcript variant 2 |
| TBRE1023 | CTNNAL1 | High | catenin alpha like 1, transcript variant 1 |
| TBRE1024 | FANCG | Medium | FA complementation group G |
| TBRE1027 | DDX18 | Medium | DEAD-box helicase 18 |
| TBRE1027 | STX1A | Medium | syntaxin 1A, transcript variant 1 |
| TBRE1027 | GMNN | Medium | geminin DNA replication inhibitor, transcript variant 1 |
| TBRE1030 | UBQLN1 | Medium | ubiquilin 1, transcript variant 2 |
| TBRE1030 | CNDP2 | Medium | carnosine dipeptidase 2, transcript variant 1 |
| TBRE1032 | XIAP | Medium | X-linked inhibitor of apoptosis, transcript variant 2 |
| TBRE1032 | HABP4 | Medium | hyaluronan binding protein 4 |
| TBRE1034 | SDCCAG3 | Medium | endosome associated trafficking regulator 1, transcript variant 2 |
| TBRE1034 | CHMP4B | Medium | charged multivesicular body protein 4B |
| TBRE1035 | GYG2 | Medium | glycogenin 2, transcript variant 2 |
| TBRE1036 | EGFEM1P | Medium | Egf like and emi domain containing 1, pseudogene |
| TBRE1038 | ACTN4 | Very High | actinin alpha 4, transcript variant 1 |
| TBRE1039 | PNMA5 | Medium | PNMA family member 5, transcript variant 2 |
| TBRE1039 | PLCD1 | Medium | phospholipase C delta 1, transcript variant 2 |
| TBRE1039 | ZNF326 | Medium | zinc finger protein 326, transcript variant 1 |
| TBRE1045 | LN608403.1_frag | Medium | — |
| TBRE1045 | JPX_frag | Medium | JPX transcript, XIST activator |
| TBRE1045 | OBP2A | Medium | odorant binding protein 2A, transcript variant alpha |
| TBRE1049 | MYT1L | High | myelin transcription factor 1 like, transcript variant 2 |
| TBRE1049 | HSPE1 | High | heat shock protein family E (Hsp10) member 1 |
| TBRE1052 | KEAP1 | Very High | kelch like ECH associated protein 1, transcript variant 1 |
| TCER1001 | NAP1L1 | Very High | nucleosome assembly protein 1 like 1, transcript variant 1 |
| TCER1002 | NDE1 | High | nudE neurodevelopment protein 1, transcript variant 1 |
| TCER1003 | TRUB1 | High | TruB pseudouridine synthase family member 1 |
| TCER1003 | IMPDH2 | High | inosine monophosphate dehydrogenase 2 |
| TCER1003 | PLSCR4 | High | phospholipid scramblase 4, transcript variant X4 |
| TCER1004 | IVNS1ABP | Very High | influenza virus NS1A binding protein |
| TCER1005 | DVL3 | Medium | dishevelled segment polarity protein 3 |
| TCER1005 | ZNF260 | Medium | Zinc finger protein 260 |

-continued

| Antibody Name | Antigen Abbreviated Name | Specificity | Antigen Full Name |
|---|---|---|---|
| TCER1006 | SNX33 | Medium | sorting nexin 33, transcript variant 1 |
| TCER1007 | HN1L | Very High | Jupiter microtubule associated homolog 2 |
| TCER1007 | THEM6 | Very High | thioesterase superfamily member 6, transcript variant 1 |
| TCH01001 | KHDRBS2 | High | KH RNA binding domain containing, signal transduction associated 2, transcript variant 2 |
| TCOL1001 | C1QL3 | Medium | complement C1q like 3 |
| TCOL1002 | PPP1R27 | Medium | protein phosphatase 1 regulatory subunit 27 |
| TCOL1003 | DNASE1L2 | Medium | deoxyribonuclease 1 like 2, transcript variant 1 |
| TCOL1004 | ESYT2_frag | Medium | extended synaptotagmin 2 |
| TCOL1005 | CCL18 | Medium | C-C motif chemokine ligand 18 |
| TCOL1006 | HOMEZ | Medium | homeobox and leucine zipper encoding |
| TCOL1006 | BAIAP2 | Medium | BAR/IMD domain containing adaptor protein 2, transcript variant 3 |
| TCOL1007 | KEAP1 | Very High | kelch like ECH associated protein 1, transcript variant 1 |
| TCOL1008 | RUFY3 | High | RUN and FYVE domain containing 3, transcript variant 2 |
| TCOL1009 | LHX5 | Medium | LIM homeobox 5 |
| TCOL1009 | GRB2 | Medium | growth factor receptor bound protein 2, transcript variant 1 |
| TESO1001 | TH | High | Tyrosine hydroxylase |
| TESO1003 | LRRC28 | Medium | leucine rich repeat containing 28, transcript variant 1 |
| TESO1005 | SPATA33 | Medium | spermatogenesis associated 33, transcript variant 2 |
| TESO1006 | ATP2C1 | Medium | Atpase secretory pathway ca2+ transporting 1 |
| TESO1006 | TSHZ2 | Medium | teashirt zinc finger homeobox 2, transcript variant 1 |
| THNS1002 | C4BPB | Medium | Complement component 4 binding protein beta |
| THNS1003 | NCCRP1 | Very High | NCCRP1, F-box associated domain containing |
| THNS1003 | CCDC102A | Very High | coiled-coil domain containing 102A, transcript variant X1 |
| THNS1004 | RBM47 | High | RNA binding motif protein 47, transcript variant X10 |
| THNS1006 | RAD1 | Medium | RAD1 checkpoint DNA exonuclease, transcript variant 1 |
| THNS1006 | MTUS1 | Medium | Microtubule associated scaffold protein 1 |
| THINS1008 | KEAP1 | Very High | kelch like ECH associated protein 1, transcript variant 1 |
| THNS1009 | PNMA5 | Very High | PNMA family member 5, transcript variant 2 |
| THNS1013 | GPR83 | Medium | G protein-coupled receptor 83, transcript variant 1 |
| THNS1014 | CDS1 | Medium | CDP-diacylglycerol synthase 1 |
| THNS1014 | DNAAF3 | Medium | dynein axonemal assembly factor 3, transcript variant 3 |
| TKIC1001 | CPNE1 | Medium | copine 1, transcript variant 2 |
| TKIC1002 | ADCK5 | Medium | aarF domain containing kinase 5 |
| TKIC1004 | CRYAB | Medium | crystallin alpha B, transcript variant 2 |
| TKIC1005 | HCLS1 | Very High | hematopoietic cell-specific Lyn substrate 1, transcript variant 1 |
| TKIC1006 | AKR1B1 | Very High | aldo-keto reductase family 1 member B, transcript variant 1 |
| TKIC1007 | SURF6 | Medium | surfeit 6, transcript variant 1 |
| TKIC1007 | PCNA | Medium | proliferating cell nuclear antigen, transcript variant 1 |
| TKIC1012 | S100B | High | S100 calcium binding protein B |
| TKIC1013 | CHEK2 | Medium | checkpoint kinase 2, transcript variant 3 |
| TKIC1019 | ANKRD53 | Medium | ankyrin repeat domain 53, transcript variant 2 |
| TLUA1001 | KLRG2 | Medium | Killer cell lectin like receptor g2 |
| TLUA1001 | TRIM35 | Medium | tripartite motif containing 35, transcript variant 1 |
| TLUA1001 | FXR2 | Medium | FMR1 autosomal homolog 2 |
| TLUA1004 | ANXA1 | Very High | annexin A1 |
| TLUA1008 | ZNF287 | Medium | zinc finger protein 287, transcript variant 2 |
| TLUA1016 | FAM177A1 | Medium | family with sequence similarity 177 member A1, transcript variant 2 |
| TLUS1001 | QDPR | Medium | quinoid dihydropteridine reductase, transcript variant 1 |
| TLUS1003 | BC031259.1_frag | Medium | ELK2, member of ETS oncogene family, pseudogene 1 |
| TLUS1003 | METTL21C | Medium | methyltransferase like 21C |
| TLUS1006 | HMBS | High | hydroxymethylbilane synthase, transcript variant X3 |
| TLUS1006 | HOOK2 | High | hook microtubule tethering protein 2, transcript variant 2 |
| TMEL1016 | Q6ir13_frag | Very High | Magel2 |
| TMEL1016 | SRSF3 | Very High | serine and arginine rich splicing factor 3, transcript variant 1 |
| TMEL1017 | RANBP10 | Medium | RAN binding protein 10, transcript variant 1 |
| TMEL1017 | WNT9B | Medium | Wnt family member 9b |

| Antibody Name | Antigen Abbreviated Name | Specificity | Antigen Full Name |
| --- | --- | --- | --- |
| TMEL1018 | UBQLN2 | Very High | ubiquilin 2 |
| TMEL1018 | UBQLN1 | Very High | ubiquilin 1, transcript variant 2 |
| TMEL1018 | UBQLN3 | Very High | Ubiquilin 3 |
| TMEL1020 | AGR3 | Very High | anterior gradient 3, protein disulphide isomerase family member |
| TMEL1022 | SRSF3 | Medium | serine and arginine rich splicing factor 3, transcript variant 1 |
| TMEL1023 | BIRC7 | Very High | baculoviral IAP repeat containing 7, transcript variant 1 |
| TMEL1025 | SDCCAG3 | High | endosome associated trafficking regulator 1, transcript variant 2 |
| TMEL1027 | MTUS2 | High | microtubule associated scaffold protein 2, transcript variant 2 |
| TMEL1028 | ZNF296 | Medium | zinc finger protein 296 |
| TMEL1028 | PDE5A | Medium | phosphodiesterase 5A, transcript variant 1 |
| TMEL1028 | EP400NL | Medium | Ep400 pseudogene 1 |
| TMEL1030 | BCL2L1 | Medium | Bcl2 like 1 |
| TMEL1031 | ARGLU1 | Medium | arginine and glutamate rich 1 |
| TMEL1031 | SASS6 | Medium | SAS-6 centriolar assembly protein, transcript variant 2 |
| TMEL1032 | PSMD4 | Medium | proteasome 26S subunit, non-ATPase 4, transcript variant 2 |
| TMEL1032 | SLA | Medium | Src like adaptor, transcript variant 1 |
| TMEL1033 | NUDT21 | Medium | nudix hydrolase 21 |
| TMEL1033 | ZNF431 | Medium | zinc finger protein 431, transcript variant 2 |
| TMEL1033 | ZNF699 | Medium | Zinc finger protein 699 |
| TMEL1034 | QDPR | Medium | quinoid dihydropteridine reductase, transcript variant 1 |
| TMEL1035 | PAGE2 | Medium | PAGE family member 2 |
| TMEL1035 | KRTAP12-3 | Medium | keratin associated protein 12-3 |
| TMEL1037 | ENO2 | Medium | enolase 2 |
| TMEL1037 | C11orf68 | Medium | chromosome 11 open reading frame 68, transcript variant 1 |
| TMEL1038 | MARS | Medium | methionyl-tRNA synthetase 1 |
| TMEL1040 | SERPINB6 | High | serpin family B member 6, transcript variant 2 |
| TMEL1041 | ERP27 | Very High | endoplasmic reticulum protein 27, transcript variant 1 |
| TMEL1041 | DPY30 | Very High | Dpy-30 histone methyltransferase complex regulatory subunit |
| TMEL1041 | ROPN1L | Very High | rhophilin associated tail protein 1 like, transcript variant 2 |
| TMES1001 | SDCCAG3 | Medium | endosome associated trafficking regulator 1, transcript variant 2 |
| TMES1002 | HN1L | High | Jupiter microtubule associated homolog 2 |
| TMES1002 | BTBD8 | High | BTB domain containing 8 |
| TMES1003 | NCF4 | Medium | neutrophil cytosolic factor 4, transcript variant 2 |
| TMES1003 | TCP11L2 | Medium | t-complex 11 like 2, transcript variant X2 |
| TMES1003 | PLCB2 | Medium | phospholipase C beta 2, transcript variant 4 |
| TMES1004 | MAPRE2 | High | microtubule associated protein RP/EB family member 2, transcript variant 1 |
| TOVA1001 | DDX53 | Very High | DEAD-box helicase 53 |
| TOVA1002 | IL27RA | Medium | interleukin 27 receptor subunit alpha |
| TOVA1003 | DHPS | High | Deoxyhypusine synthase |
| TOVA1004 | HEATR3 | High | HEAT repeat containing 3, transcript variant 1 |
| TOVA1005 | DDX53 | High | DEAD-box helicase 53 |
| TOVA1005 | VEZT | High | Vezatin, adherens junctions transmembrane protein |
| TOVA1005 | WDR3 | High | Wd repeat domain 3 |
| TOVA1006 | DDX58 | Very High | DExD/H-box helicase 58 |
| TOVA1006 | DDX58 | Very High | DExD/H-box helicase 58 |
| TOVA1007 | NUDT22 | High | nudix hydrolase 22, transcript variant 2 |
| TOVA1008 | HN1L | Very High | Jupiter microtubule associated homolog 2 |
| TPAN1001 | GCA | Medium | grancalcin, transcript variant 4 |
| TPAN1002 | ERP27 | High | endoplasmic reticulum protein 27, transcript variant 1 |
| TPAN1003 | POLR3G | Medium | Rna polymerase iii subunit g |
| TPAN1004 | SNX1 | Medium | sorting nexin 1, transcript variant 1 |
| TPAN1005 | AB937783.1_frag | Medium | SAA2-SAA3 |
| TPAN1005 | PSMD3 | Medium | proteasome 26S subunit, non-ATPase 3 |
| TPAN1006 | CRKL | Medium | CRK like proto-oncogene, adaptor protein, transcript variant 1 |
| TPAN1007 | FBXO2 | Medium | F-box protein 2 |
| TPAN1007 | TUBG1 | Medium | tubulin gamma 1 |
| TPRO1001 | OXR1 | High | oxidation resistance 1, transcript variant 1 |
| TPRO1002 | ANKRD20A5P | Medium | Ankyrin repeat domain 20 family member a5, pseudogene |

-continued

| Antibody Name | Antigen Abbreviated Name | Specificity | Antigen Full Name |
|---|---|---|---|
| TPRO1002 | KIRREL | Medium | Kirre like nephrin family adhesion molecule 1 |
| TPRO1002 | GIGYF1 | Medium | GRB10 interacting GYF protein 1, transcript variant X10 |
| TPRO1003 | DEFA3 | Medium | defensin alpha 3 |
| TREC1001 | RSPH14 | Medium | radial spoke head 14 homolog |
| TREC1002 | CCL2 | Medium | C-C motif chemokine ligand 2 |
| TREC1003 | KLRC1 | Medium | killer cell lectin like receptor C1, transcript variant 3 |
| TREC1003 | KLHL12 | Medium | kelch like family member 12, transcript variant 2 |
| TSAR1001 | NRL | Medium | neural retina leucine zipper, transcript variant X4 |
| TSAR1002 | PLCD4 | Medium | phospholipase C delta 4 |
| TSAR1003 | CCDC74B | Medium | coiled-coil domain containing 74B, transcript variant 2 |
| TSAR1004 | DDX53 | High | DEAD-box helicase 53 |
| TSAR1005 | HSPBP1 | Very High | HSPA (Hsp70) binding protein 1, transcript variant 2 |
| TSAR1005 | HSPA2 | Very High | heat shock protein family A (Hsp70) member 2 |
| TSAR1005 | BAG2 | Very High | BCL2 associated athanogene 2 |
| TSAR1006 | CXCR4 | Medium | C-X-C motif chemokine receptor 4, transcript variant 2 |
| TSAR1006 | LINC00242 | Medium | Long intergenic non-protein coding rna 242 |
| TSAR1007 | STAT5A | Medium | signal transducer and activator of transcription 5A, transcript variant 2 |
| TSAR1007 | QDPR | Medium | quinoid dihydropteridine reductase, transcript variant 1 |
| TSTO1001 | CIB1 | Medium | calcium and integrin binding 1, transcript variant b |
| TSTO1001 | TSNARE1 | Medium | t-SNARE domain containing 1, transcript variant 1 |
| TSTO1002 | HAUS1 | Very High | HAUS augmin like complex subunit 1, transcript variant 1 |
| TSTO1002 | DYDC1 | Very High | DPY30 domain containing 1, transcript variant X4 |
| TSTO1003 | TGFB3 | Medium | Transforming growth factor beta 3 |
| TSTO1004 | CTRB2 | Medium | chymotrypsinogen B2 |
| TSTO1005 | NFKBIB | Very High | NFKB inhibitor beta, transcript variant 1 |
| TSTO1005 | CDK2AP2 | Very High | cyclin dependent kinase 2 associated protein 2, transcript variant 1 |
| TSTO1006 | LIPN | Medium | lipase family member N, transcript variant X1 |
| TSTO1007 | RGS14 | High | regulator of G protein signaling 14, transcript variant 1 |
| TSTO1007 | LRRC14 | High | leucine rich repeat containing 14, transcript variant 1 |
| TSTO1008 | TGFBI | Medium | transforming growth factor beta induced |
| TSTO1010 | BCL2 | High | BCL2 apoptosis regulator, transcript variant alpha |
| TTES1001 | DIXDC1 | Medium | DIX domain containing 1, transcript variant 2 |
| TTES1002 | CASP8 | Medium | Caspase 8 |
| TTES1002 | PGM2L1 | Medium | phosphoglucomutase 2 like 1 |
| TTES1003 | PDCD1 | Very High | programmed cell death 1 |
| TTES1004 | GRHPR | High | glyoxylate and hydroxypyruvate reductase |
| TTES1005 | CYB5R2 | Medium | Cytochrome b5 reductase 2 |
| TTES1006 | ACBD6 | Very High | acyl-CoA binding domain containing 6 |
| TTES1007 | PDCL | Medium | phosducin like |
| TTES1008 | DDX52 | Medium | Dexd-box helicase 52 |
| TTES1008 | GPR4 | Medium | G protein-coupled receptor 4 |
| TTES1009 | ADCK5 | Medium | aarF domain containing kinase 5 |
| TTES1010 | DIXDC1 | Medium | DIX domain containing 1, transcript variant 2 |
| TTES1011 | HN1L | High | Jupiter microtubule associated homolog 2 |
| TTES1012 | GAGE2A | Medium | G antigen 2A |
| TTHY1001 | DIXDC1 | Medium | DIX domain containing 1, transcript variant 2 |
| TTHY1001 | POLR2E | Medium | RNA polymerase II subunit E, transcript variant 1 |
| TTHY1002 | PCNA | Medium | proliferating cell nuclear antigen, transcript variant 1 |
| TTHY1003 | BCL7C | Medium | BAF chromatin remodeling complex subunit BCL7C, transcript variant 2 |
| TTHY1003 | IVNS1ABP | Medium | influenza virus NS1A binding protein |
| TTHY1004 | CTAG1A | Medium | cancer/testis antigen 1A |
| TUCE1004 | CTAG1A | Very High | cancer/testis antigen 1A |
| TUCE1005 | UTP6 | Medium | UTP6 small subunit processome component |
| TUCS1003 | CTAG1A | Very High | cancer/testis antigen 1A |
| TUVM1001 | RP2 | Medium | RP2 activator of ARL3 GTPase |

Table 4 lists SEQ ID NOs of exemplary amino acid sequences of target antigens for the antibodies of the disclosure and antigen binding fragment thereof

| Antigen Name | SEQ ID NO: | NCBI Accession NO: |
|---|---|---|
| RSPO1 | 4337 | NP_001229837 |
| ZDHHC1 | 4338 | NP_037436 |
| RXRA | 4339 | NP_002948 |
| RXRG | 4340 | NP_008848 |
| TMEM154 | 4341 | NP_689893 |
| SNAPIN | 4342 | NP_036569 |
| PYGL | 4343 | NP_002854 |
| RCN3 | 4344 | NP_065701 |
| SYT12 | 4345 | XP_011543649 |
| Nr2f6 | 4346 | NP_005225 |
| PPP1R13L | 4347 | NP_006654 |
| OR6Q1 | 4348 | NP_001005186 |
| CTAG1A | 4349 | NP_640343 |
| HTR1E | 4350 | NP_000856 |
| MFAP3 | 4351 | NP_001229265 |
| HABP4 | 4352 | NP_055097 |
| BC025996.2_frag | 4353 | NR_003675 |
| DUSP12 | 4354 | NP_009171 |
| ACTN1 | 4355 | NP_001093 |
| ZKSCAN4 | 4356 | XP_005249152 |
| PNMA5 | 4357 | NP_001096620 |
| KLHL40 | 4358 | NP_689606 |
| MPP2 | 4359 | NP_005365 |
| BTN1A1 | 4360 | NP_001723 |
| PEX11G | 4361 | NP_542393 |
| ZNF8 | 4362 | NP_066575 |
| SATB2 | 4363 | NP_056080 |
| GDAP1 | 4364 | NP_001035808 |
| CTNNAL1 | 4365 | NP_003789 |
| FANCG | 4366 | NP_004620 |
| DDX18 | 4367 | NP_006764 |
| STX1A | 4368 | NP_004594 |
| GMNN | 4369 | NP_056979 |
| UBQLN1 | 4370 | NP_444295 |
| CNDP2 | 4371 | NP_060705 |
| XIAP | 4372 | NP_001191330 |
| SDCCAG3 | 4373 | NP_006634 |
| CHMP4B | 4374 | NP_789782 |
| GYG2 | 4375 | NP_003909 |
| EGFEM1P | 4376 | NR_021485 |
| ACTN4 | 4377 | NP_004915 |
| PLCD1 | 4378 | NP_006216 |
| ZNF326 | 4379 | NP_892021 |
| LN608403.1_frag | 4380 | — |
| JPX_frag | 4381 | — |
| OBP2A | 4382 | NP_055397 |
| MYT1L | 4383 | NP_055840 |
| HSPE1 | 4384 | NP_002148 |
| KEAP1 | 4385 | NP_987096 |
| NAP1L1 | 4386 | NP_631946 |
| NDE1 | 4387 | NP_001137451 |
| TRUB1 | 4388 | NP_631908 |
| IMPDH2 | 4389 | NP_000875 |
| PLSCR4 | 4390 | XP_011511333 |
| IVNS1ABP | 4391 | NP_006460 |
| DVL3 | 4392 | NP_004414 |
| ZNF260 | 4393 | NP_001012774 |
| SNX33 | 4394 | NP_695003 |
| HN1L | 4395 | NP_653171 |
| THEM6 | 4396 | NP_057731 |
| KHDRBS2 | 4397 | NP_689901 |
| C1QL3 | 4398 | NP_001010908 |
| PPP1R27 | 4399 | NP_001007534 |
| DNASE1L2 | 4400 | NP_001365 |
| ESYT2_frag | 4401 | NP_001354702 |
| CCL18 | 4402 | NP_002979 |
| HOMEZ | 4403 | NP_065885 |
| BAIAP2 | 4404 | NP_006331 |
| RUFY3 | 4405 | NP_055776 |
| LHX5 | 4406 | NP_071758 |
| GRB2 | 4407 | NP_002077 |
| TH | 4408 | NP_000351 |
| LRRC28 | 4409 | NP_653199 |
| SPATA33 | 4410 | NP_694570 |
| ATP2C1 | 4411 | NP_001001485 |
| TSHZ2 | 4412 | NP_775756 |
| C4BPB | 4413 | NP_000707 |
| NCCRP1 | 4414 | NP_001001414 |
| CCDC102A | 4415 | XP_011521771 |
| RBM47 | 4416 | XP_005248166 |
| RAD1 | 4417 | NP_002844 |
| MTUS1 | 4418 | NP_001001924 |
| GPR83 | 4419 | NP_057624 |
| CDS1 | 4420 | NP_001254 |
| DNAAF3 | 4421 | NP_001243644 |
| CPNE1 | 4422 | NP_690903 |
| ADCK5 | 4423 | NP_777582 |
| CRYAB | 4424 | NP_001276736 |
| HCLS1 | 4425 | NP_005326 |
| AKR1B1 | 4426 | NP_001619 |
| SURF6 | 4427 | NP_006744 |
| PCNA | 4428 | NP_002583 |
| S100B | 4429 | NP_006263 |
| CHEK2 | 4430 | NP_001005735 |
| ANKRD53 | 4431 | NP_079209 |
| KLRG2 | 4432 | NP_940910 |
| TRIM35 | 4433 | NP_741983 |
| FXR2 | 4434 | NP_004851 |
| ANXA1 | 4435 | NP_000691 |
| ZNF287 | 4436 | NP_065704 |
| FAM177A1 | 4437 | NP_001072987 |
| QDPR | 4438 | NP_000311 |
| BC031259.1_frag | 4439 | — |
| METTL21C | 4440 | NP_001010977 |
| HMBS | 4441 | XP_005271589 |
| HOOK2 | 4442 | NP_001093646 |
| Q6ir13_frag | 4443 | — |
| SRSF3 | 4444 | NP_003008 |
| RANBP10 | 4445 | NP_065901 |
| WNT9B | 4446 | NM_001320458 |
| UBQLN2 | 4447 | NP_038472 |
| UBQLN3 | 4448 | NP_001334025 |
| AGR3 | 4449 | NP_789783 |
| BIRC7 | 4450 | NP_647478 |
| MTUS2 | 4451 | NP_056048 |
| ZNF296 | 4452 | NP_660331 |
| PDE5A | 4453 | NP_001074 |
| EP400NL | 4454 | NR_003290 |
| BCL2L1 | 4455 | NP_001182 |
| ARGLU1 | 4456 | NP_060481 |
| SASS6 | 4457 | NP_001291758 |
| PSMD4 | 4458 | NP_002801 |
| SLA | 4459 | NP_001039021 |
| NUDT21 | 4460 | NP_008937 |
| ZNF431 | 4461 | NP_597730 |
| ZNF699 | 4462 | NP_940937 |
| PAGE2 | 4463 | NP_997222 |
| KRTAP12-3 | 4464 | NP_941970 |
| ENO2 | 4465 | NP_001966 |
| C11orf68 | 4466 | NP_001129107 |
| MARS | 4467 | NP_004981 |
| SERPINB6 | 4468 | NP_001182220 |
| ERP27 | 4469 | NP_689534 |
| DPY30 | 4470 | NP_001308138 |
| ROPN1L | 4471 | NP_001188395 |
| BTBD8 | 4472 | NP_899065 |
| NCF4 | 4473 | NP_038202 |
| TCP11L2 | 4474 | XP_005268824 |
| PLCB2 | 4475 | NP_001271228 |
| MAPRE2 | 4476 | NP_055083 |
| DDX53 | 4477 | NP_874358 |
| IL27RA | 4478 | NP_004834 |
| DHPS | 4479 | NP_001193903 |
| HEATR3 | 4480 | NP_891552 |
| VEZT | 4481 | NP_001339017 |
| WDR3 | 4482 | NP_006775 |
| DDX58 | 4483 | NP_055129 |

-continued

| Antigen Name | SEQ ID NO: | NCBI Accession NO: |
|---|---|---|
| NUDT22 | 4484 | NP_001122084 |
| GCA | 4485 | NP_036330 |
| POLR3G | 4486 | NP_001357280 |
| SNX1 | 4487 | NP_003090 |
| AB937783.1_frag | 4488 | NP_001120852 |
| PSMD3 | 4489 | NP_002800 |
| CRKL | 4490 | NP_005198 |
| FBXO2 | 4491 | NP_036300 |
| TUBG1 | 4492 | NP_001061 |
| OXR1 | 4493 | NP_060472 |
| ANKRD20A5P | 4494 | NR_040113 |
| KIRREL | 4495 | NP_001164456 |
| GIGYF1 | 4496 | XP_005250589 |
| DEFA3 | 4497 | NP_005208 |
| RSPH14 | 4498 | NP_055248 |
| CCL2 | 4499 | NP_002973 |
| KLRC1 | 4500 | NP_998823 |
| KLHL12 | 4501 | NP_067646 |
| NRL | 4502 | XP_011535104 |
| PLCD4 | 4503 | NP_116115 |
| CCDC74B | 4504 | NP_001245236 |
| HSPBP1 | 4505 | NP_001123578 |
| HSPA2 | 4506 | NP_068814 |
| BAG2 | 4507 | NP_004273 |
| CXCR4 | 4508 | NP_003458 |
| LINC00242 | 4509 | NR_026781 |
| STAT5A | 4510 | NP_003143 |
| CIB1 | 4511 | NP_006375 |
| TSNARE1 | 4512 | NP_659440 |
| HAUS1 | 4513 | NP_612452 |
| DYDC1 | 4514 | XP_011537637 |
| TGFB3 | 4515 | NP_003230. |
| CTRB2 | 4516 | NP_001020371 |
| NFKBIB | 4517 | NP_002494 |
| CDK2AP2 | 4518 | NP_005842 |
| LIPN | 4519 | XP_011538385 |
| RGS14 | 4520 | NP_006471 |
| LRRC14 | 4521 | NP_001258965 |
| TGFBI | 4522 | NP_000349 |
| BCL2 | 4523 | NP_000624 |
| DIXDC1 | 4524 | NP_219493 |
| CASP8 | 4525 | NP_001073593 |
| PGM2L1 | 4526 | NP_775853 |
| PDCD1 | 4527 | NP_005009 |
| GRHPR | 4528 | NP_036335 |
| CYB5R2 | 4529 | NP_057313 |
| ACBD6 | 4530 | NP_115736 |
| PDCL | 4531 | NP_005379 |
| DDX52 | 4532 | NP_001278405 |
| GPR4 | 4533 | NP_005273 |
| GAGE2A | 4534 | NP_001120684 |
| POLR2E | 4535 | NP_002686 |
| BCL7C | 4536 | NP_004756 |
| UTP6 | 4537 | NP_060898 |
| RP2 | 4538 | NP_008846 |

SEQUENCE LISTING (6439 sequences)

SEQ ID NO: 1 - protein, 220 aa, Artificial Sequence
  Synthetic polypeptide representing artificial human antibody VH chain
CEMQLLQSGGGLVQPGGSLRLSCVASEVTFNTYGMSWVRQAPGKGLEWVSYMSGGGGSIFYADSVKGRFTISRDNSKNTLYLQMNSLRGEDTAVYFCARVTLGSYFYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 2 - protein, 220 aa, Artificial Sequence
  Synthetic polypeptide representing artificial human antibody VH chain
VVQLVESGGGLVQPGGSLRLSCAASGFTFSSYWMSWVRQAPGKGLEWVANIKQDGSEKYYVDSVKGRFTISRDNAKKSLYLQMNSLRAEDTAVYYCARDGGSGSYFDCFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKSE

SEQ ID NO: 3 - protein, 223 aa, Artificial Sequence
  Synthetic polypeptide representing artificial human antibody VH chain
EVQLVESGGGLIQPGRSLRLSCAASGFTFEDYAMHWVRQAPGKGLEWVSGISWNSGNIGYADSVKGRFTISRDNAKNSLYLQMHSLRPEDTALYYCAKDINFFGLGTGGGAMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRE

SEQ ID NO: 4 - protein, 119 aa, Artificial Sequence
  Synthetic polypeptide representing artificial human antibody VH chain
QITLKESGPTLVKPTQTLTLTCTFSGFSLSTSGVGVGWIRQPPGKALEWLALIYWDDDKRYSPSLKSRLTITKDTSKNQVVLTMTNMDPVDTATYYCAHRAIVGLFDYWGQGTLVTVSS

SEQ ID NO: 5 - protein, 223 aa, Artificial Sequence
  Synthetic polypeptide representing artificial human antibody VH chain
QVQLVQSGAEVKKPGASVKISCKTSGYTFTTYYMHWVRQAPGQGLEWMGIINTSGGSTSYAQKFQGRVTMTRDTSTNTVYMELSSLRYEDTAMYYCARGGDGGPQDAFDIWGQGTKVTVSSASPTSPKVFPLSLCSTQPDGNVVIACLVQGFFPQEPLSVTWSESGQGVTARNFPPSQDASGDLYTTSSQLTLPATQCLAGKSVTCHVKHYTNPSQDVTVPCP

SEQ ID NO: 6 - protein, 221 aa, Artificial Sequence
  Synthetic polypeptide representing artificial human antibody VH chain
VQLVDSGGGLVQPGRSLRLSCAASGFVFDDYAMHWVRQVPGKGLEWVSGISWNSVSIGYADSVKGRFTISRDNAKNSLYLQMNSLRPEDAALYYCVKSFSAEYYYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKSE

SEQ ID NO: 7 - protein, 122 aa, Artificial Sequence
  Synthetic polypeptide representing artificial human antibody VH chain
QVQLVQSGAEVKKPGASVKVSCKASGYTFTNYGFSWVRQAPGQGLEWMGRITTYNRDTIYAQKFQGRVTMTTDTSTSTAYMELRSLRSDDTAVYFCARVVPGDSVYGAFDIWGQGTMVTVSS

SEQ ID NO: 8 - protein, 222 aa, Artificial Sequence
  Synthetic polypeptide representing artificial human antibody VH chain
EVQLVESGGGVVQPGGSLRLSCTASGFTFDDYAMHWVRQAPGKGLEWVSLISGDGGGTYYADSVKGRFTISRDNSKNSLYLQMNSLRTEDTALYYCAKRTPFGEWAFDYWGQGTLVTVSSASPTSPKVFPLSLCSTQPDGNVVIACLVQGFFPQEPLSVTWSESGQGVTARNFPPSQDASGDLYTTSSQLTLPATQCLAGKSVTCHVKHYTNPSQDVTVPCP

SEQ ID NO: 9 - protein, 124 aa, Artificial Sequence
  Synthetic polypeptide representing artificial human antibody VH chain
EVQLVESGGGVVQPGGSLRLSCAASGFTFSYYGMYWVRQAPGKGLEWVTFIRYDGRNKYYADSVKGRFTISRDNSKNTLYLEMNTLRTEDTAMYFCAKDPGTFRDHLWSGVDYWGQGTLVTVSS

SEQ ID NO: 10 - protein, 221 aa, Artificial Sequence
  Synthetic polypeptide representing artificial human antibody VH chain
EVQLVESGGGLVQPGRSLRLSCAASGFPFGDYAMHWVRQAPGKGLEWVSGIGWDSGGIGYADSVKGRFTISRDIAKNSLYLEINSLRPDDTALYYCAKAAATLPYFRFAMDVWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKNV

SEQ ID NO: 11 - protein, 222 aa, Artificial Sequence
  Synthetic polypeptide representing artificial human antibody VH chain
PGLLVQSGGEVKKPGASVRVSCKASGYIDINNGISWVRQAPGHGLEWMGWISIYSGNTKYAQKFQGRVTMTTATSTSTVYMELRSLTSDDTAVYYCARVGVFKGLAPFGGFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRV

SEQ ID NO: 12 - protein, 118 aa, Artificial Sequence
  Synthetic polypeptide representing artificial human antibody VH chain
LLQLVESGGGVVQPGRSLRLSCAASGFTFTRHGFHWVRQAPGKGLEWVAVISSDGRKIHYTDSVKGRFVISRDDSDNTVYLHMNSLRLGDTALYYCARDSGGTPGPYWGQGTLVTVSS

SEQ ID NO: 13 - protein, 222 aa, Artificial Sequence
  Synthetic polypeptide representing artificial human antibody VH chain
CEVQLLESGGGLVQPGGSLTLSCVGSRFTFSSYAMNWVRQSPGRGLEWVASISATTGSTYYTDSVEGRFTISRDNSRDTLYLQMNSLRADDTALYYCVRSFVGAVPAYPNFDFWGPGTLVTVSSASTKGPSVFPLAPCSRSTSESTAALGCLVKDYFPEPVTVSWNSGALTSGVHTFPAVLQSSGLYSLSSVVTVTSSNFGTQTYTCNVDHKPSNTKVDKTV

SEQ ID NO: 14 - protein, 225 aa, Artificial Sequence
  Synthetic polypeptide representing artificial human antibody VH chain
QVQLQQSGPGLVKPSQTLSLTCAISGDGVSSNSASWNWVRQSPSRGLEWLGRTYYRSKWYNDYAVSVKSRMTIKSDTSKNQFSLQLNSVTPEDTAVYYCVRGVVGATLDNWGQGTLVTVSSGSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLP

SEQ ID NO: 15 - protein, 222 aa, Artificial Sequence
  Synthetic polypeptide representing artificial human antibody VH chain
QVQLVESGGGVVQPGGSLRLSCGASGFAFSSNGMHWVRQAPGKGLEWVAFIHYDGRNKHYTDSVKGRFAISVDDSKTTLYLQMSSLKTEDTAVYYCVKDSRVTGQSSGYIFDSWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTE

SEQ ID NO: 16 - protein, 216 aa, Artificial Sequence
  Synthetic polypeptide representing artificial human antibody VH chain
VVQLVESGGGLVKPGGSLRLSCAASGITFSSYDMNWVRQAPGKGLEWVSSISSSSSSIYFADSVKGRFTISRDNAKNSLYLHMNSLRAEDTAVYYCARPRLGWYFDLWGRGTLVTVASASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRV

SEQ ID NO: 17 - protein, 218 aa, Artificial Sequence
  Synthetic polypeptide representing artificial human antibody VH chain
QVQLVQSGGEVKKPGASVKVSCKASGYNFTNYGISWVRQAPGQGLEWMGWISAYNGNTNYAQKLQGRVTMTTDTPTSTAYMELRSLRSDDTAVYYCARETAGQLIPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKSE

SEQ ID NO: 18 - protein, 222 aa, Artificial Sequence
  Synthetic polypeptide representing artificial human antibody VH chain
VEQLVESGGGLVQPGGSLRLSCAASGFSFRSYEMNWVRQAPGKGLEWVSYIGIGGNTIYYADSVKGRFTISRDNAKNSLYLQMNSLRAEDTAVYYCARDYMGVDFYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRV

SEQ ID NO: 19 - protein, 219 aa, Artificial Sequence
  Synthetic polypeptide representing artificial human antibody VH chain
QVQLVQSGAEVKKPGASVKVSCKASGYIFTSYAIHWVRQAPGQRLEWMGWINAGNGNTKYSQKFQGRVTITRDTSANTAYMELSSLRSEDTAIYYCARDIAVAITNYFGSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 20 - protein, 216 aa, Artificial Sequence
  Synthetic polypeptide representing artificial human antibody VH chain
QVQLQESGPGLVRPSETLSLTCDVSGYLISSGYYWGWVRQPPGKGLEWIGSVYHSGNAYYNPSLKGRVTMSVDTSKNQFSLKLTSVAAEDTAVYYCAREHRSGYQRYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 21 - protein, 223 aa, Artificial Sequence
  Synthetic polypeptide representing artificial human antibody VH chain
QITLKESGPTLVKPTQTLTLTCTFSGFSLNTSGVGVGWIRQPPGKALEWLALIYWDDDERYRPSLKNRLTITRDTSKNQVVLTMTNMDPVDTATYYCAHFSTVINFGHWGQGTLVTVSSGSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLP

SEQ ID NO: 22 - protein, 115 aa, Artificial Sequence
  Synthetic polypeptide representing artificial human antibody VH chain
EVQLVESGGGLVKPGGSLRLSCVGSGFTFSNYSMNWVRQAPGRGLEWVSSISWGSSYINYADSVKGRFTISRDNAKNSLYLQMTSLTAEDTAVYYCACRRIYQGFDPWGQGTLVT

SEQ ID NO: 23 - protein, 215 aa, Artificial Sequence
  Synthetic polypeptide representing artificial human antibody VH chain
EVQLVESGGGLVKPGGSLRLSCAASGFTFSSYSMNWVRQAPGKGLEWVSSISSSSRYIYYADSVKGRFTSSRDNAKNSLYLQMNSLRAEDTAVYYCARDRATSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 24 - protein, 213 aa, Artificial Sequence
  Synthetic polypeptide representing artificial human antibody VH chain
PVLLQESGPGLVKPSETLSLTCTVSGDSMSFYYWTWIRQPPGKGLEWIGYIYYSGNRNYNPSLNSRVTISVDTSKNEVSLKLTSVTAADTAAYYCARGRGEMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRV

SEQ ID NO: 25 - protein, 220 aa, Artificial Sequence
  Synthetic polypeptide representing artificial human antibody VH chain
QVQLQESGPGLVKPTQTLSLTCTVSGGSISSGSYYWNWIRQPAGKGLEWIGNIYTSGNTDYNPSLKSRVTISLDTSKNQVSLNLTSVTAADTAVYYCATTPSSSWYWYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKSE

SEQ ID NO: 26 - protein, 221 aa, Artificial Sequence
  Synthetic polypeptide representing artificial human antibody VH chain
EVQLVESGGGLVKPGGSLRLSCAGSGFSFSSYSMNWVRQAPGKGLEWVSSISSKSSSKNYIDSVKNRFIISRDNAKNSLYLQMNSLRAEDTAVYYCARDLELIIAAGAPLDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRE

SEQ ID NO: 27 - protein, 222 aa, Artificial Sequence
  Synthetic polypeptide representing artificial human antibody VH chain
PLQLQESGPGLVKPSETLSLTCTVSGGSISRSPYFWGWIRQPPGRGLEWIASIYYRGTTSYNPSLKSRVTISVDTSKNQFSLKLRSVTAADTAVFYCARLVTSPEEGGPWFDPWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 28 - protein, 119 aa, Artificial Sequence
  Synthetic polypeptide representing artificial human antibody VH chain
QVQLVESGGGVVQPGRSLRLSCAASGFTFTSYGMHWVRQAPGKGLEWVALIWYDGSNKYYADSVKGRFTISRDNSKNTLYLQMNSLRAEDTAVYYCARDTEVGHHFDYWGQGTLITVSS

SEQ ID NO: 29 - protein, 219 aa, Artificial Sequence
  Synthetic polypeptide representing artificial human antibody VH chain
QVQLQESGPGLVKPSETLSLTCTVSSGSSGSYYLSWIRQPAGKGLEWIGRMYTSGSTHYNPSLKSRVTMSVDTSKNQFSLKLSSVTAADTAVYYCAKPWRSDGFDVWGQGTVVTVSSASPTSPKVFPLSLCSTQPDGNVVIACLVQGFFPQEPLSVTWSESGQGVTARNFPPSQDASGDLYTTSSQLTLPATQCLAGKSVTCHVKHYTNPSQDVTVPCP

SEQ ID NO: 30 - protein, 216 aa, Artificial Sequence
  Synthetic polypeptide representing artificial human antibody VH chain
QVQLVQSGAEVKKPGASVKVSCKASGYNFRDYYMHWVRQAPGQGLEWMGWINPNSGGTISAQNFQGRVTMTRDTSISTAYMEVNSLRSDDTAVYYCAVGMVTDGFEIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRV

SEQ ID NO: 31 - protein, 222 aa, Artificial Sequence
  Synthetic polypeptide representing artificial human antibody VH chain
QVQLQESGSGLVRPSQTLSLTCTVSGGSINSGDYHWSWIRQPPGKDLEYIGYIHHTGSAYYNPSLKSRVTISVDTSKNQHSLRLTSVTAADTAVYYCARLDLRTVRFDPWGQGTLVTVSSASPTSPKVFPLSLCSTQPDGNVVIACLVQGFFPQEPLSVTWSESGQGVTARNFPPSQDASGDLYTTSSQLTLPATQCLAGKSVTCHVKHYTNPSQDVTVPCP

SEQ ID NO: 32 - protein, 226 aa, Artificial Sequence
  Synthetic polypeptide representing artificial human antibody VH chain
PLQLQESGPGLAKPSETLSLTCTASGGSISSSGYYWGWIRQPPGKGLEWIGSIYYSGDTYYNPSLKSRVNIAVDTSQNQFSLKLNSVTAADTAVYYCARHSSGPPRLAFDIWGQGTMVTVSSGSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLP

SEQ ID NO: 33 - protein, 218 aa, Artificial Sequence
  Synthetic polypeptide representing artificial human antibody VH chain
QVQLVESGGGVVQPGRSLRLSCAASGFTFSSYGMHWVRQVPGKGLEGVAVISHDGSNKYYADSVKGRFTISRDNSKNTLYLQMNSLRVEDTAVYYCAKDFAMPTVTTDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKNE

SEQ ID NO: 34 - protein, 121 aa, Artificial Sequence
  Synthetic polypeptide representing artificial human antibody VH chain
QITLKESGPTLVKPTQTLTLTCTFSGFSLTTSGVGVGWIRQPPGKALEWLALIYWDDDKRYSPSLRSRLTITKDTSKNQVVLTMTNMDPVDTATYYCVHRPSLAYWYFDVWGRGTLLTVSS

SEQ ID NO: 35 - protein, 219 aa, Artificial Sequence
  Synthetic polypeptide representing artificial human antibody VH chain
VVQLVESGGGLVQPGGSLRLSCAASGFTFSTYELNWVRQAPGKGLEWISYINTTSDPIYYADSVKGRFTISRDNAKNSVFLQMNSLRAEDTAVYYCVREGDSRKYYSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRV

SEQ ID NO: 36 - protein, 218 aa, Artificial Sequence
  Synthetic polypeptide representing artificial human antibody VH chain
PVQLVQSGAEVKKPGSSVKVSCKASGGTFSSYAISWVRQAPGQGLEWMGGIIPIFGTANYAQKFQGRVTITADESTSTAYMELSSLRSEDTAVYYCARDPMWVSYAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKNE

SEQ ID NO: 37 - protein, 215 aa, Artificial Sequence
  Synthetic polypeptide representing artificial human antibody VH chain
PVQLQESGPGLVKPSETLSLTCTVSGGSISSDNYYWSWLRQHPGKGLEWIGYIYFSVTTYYNPSLKSRVTISLDTSKNQFSLKLSSVTAADTAVYYCASGYVSFDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRV

SEQ ID NO: 38 - protein, 220 aa, Artificial Sequence
  Synthetic polypeptide representing artificial human antibody VH chain
QVQLQESGPGLVKPSETLSLTCNVSGASISSYYWSWIRQPPGKGLEWIGYLSYSGNTNSKPSLKSRVTISVDTSKNQFSLKLSSVTAADTAVYYCAREGAYESSGPDPFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRV

SEQ ID NO: 39 - protein, 220 aa, Artificial Sequence
  Synthetic polypeptide representing artificial human antibody VH chain
QVQVVQSGAEVKKPGASVKISCKASGNTFTTYTIQWVRQVPGQRLEWMGWINAGNGDIKYSQKFQDRVTITRDTSANTAYMELSSLRYEDTAVYFCASLFLTYYGSGTYYRWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKSE

SEQ ID NO: 40 - protein, 216 aa, Artificial Sequence
  Synthetic polypeptide representing artificial human antibody VH chain
EVQLLESGGGLVQPGGSLRLSCAASGFTFSSYAMSWVRQAPGKGLEWVSTISGSGHSTYYADSVKGRFTISRDNSKNTLYLQMNSLRAEDTAVYYCAKSTLGGGFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 41 - protein, 223 aa, Artificial Sequence
  Synthetic polypeptide representing artificial human antibody VH chain
VVQLVESGGGVVRPGGSLRLSCAASGFTFDDYGMSWVRQAPGKGLEWVSGINWNGGSTGYADSVKGRFTISRDNAKNSLYLQMNSLRAEDTALYHCARVGSSSWYSSGRSPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRV

SEQ ID NO: 42 - protein, 221 aa, Artificial Sequence
  Synthetic polypeptide representing artificial human antibody VH chain
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKDQIVLEMATSPFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTV

SEQ ID NO: 43 - protein, 223 aa, Artificial Sequence
  Synthetic polypeptide representing artificial human antibody VH chain
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARDLSCSSTSCHDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKSE

SEQ ID NO: 44 - protein, 123 aa, Artificial Sequence
  Synthetic polypeptide representing artificial human antibody VH chain
QVQLVQSGAEVKKPGASVKVSCKASGYTFTGYYLHWVRQAPGQGLEWMGRINPNSGGTNYAQNFQGRVTMTRDTSISTAYMELSSLKSDDTAVFFCARGPNFHESIRDGFDIWGQGTMVTVSS

SEQ ID NO: 45 - protein, 118 aa, Artificial Sequence
  Synthetic polypeptide representing artificial human antibody VH chain
EVQLVESGGGLVQPGGSLRLSCAASGFTFSSYDFHWVRQPTGKGLEWVSAIGTAGDTLYLDSVKGRFTISRENAKNSLYLQMNSLRAGDTAVYYCARVNWNSDTFDSWGQGTLVTVSS

SEQ ID NO: 46 - protein, 229 aa, Artificial Sequence
  Synthetic polypeptide representing artificial human antibody VH chain
QVQLVESGGGVVQPGRSLRLSCAASGFTFRSYGMHWARQAPGRGLEWVAVISYDGSNSYYADSVKGRFTISRDNSKNTLYLEMNSLRADDTAVYYCARDPGRDPYLDLDYHYGMDVWGQGTTVTVSSASPTSPKVFPLSLCSTQPDGNVVIACLVQGFFPQEPLSVTWSESGQGVTARNFPPSQDASGDLYTTSSQLTLPATQCLAGKSVTCHVKHYTNPSQDVTVPCP

SEQ ID NO: 47 - protein, 221 aa, Artificial Sequence
  Synthetic polypeptide representing artificial human antibody VH chain
QVQLVESGGGLVEPGGSLRLSCAASGFTFSDYYMSWIRQAPGKRLEWISHMSSGGNRRHYADSVRGRFTISRDNAKNSLYLQMNSMRADDTAVYYCARDKRSGMTSDRRIDYWGQGTRVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRV

SEQ ID NO: 48 - protein, 217 aa, Artificial Sequence
  Synthetic polypeptide representing artificial human antibody VH chain
VVQLGESGGGLVKPGGSLRLSCAASGFTFSSYHMNWVRQSPEKGLEWVSYISSSGTYIDYADSVRGRFTISRDNAKNSLYLQMNILRPDDTAVYYCSGGYYSSSHMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRV

SEQ ID NO: 49 - protein, 218 aa, Artificial Sequence
  Synthetic polypeptide representing artificial human antibody VH chain
QVQLVESGGGVVQPGRSLRLSCAASGFTFSSYAMHWVRQAPGKGLEWVAVISYDGSNKYYADSLKGRFTISRDNSKDTLYLQVNSLRPEDTAVYYCARVNIAAAGTLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKNE

SEQ ID NO: 50 - protein, 226 aa, Artificial Sequence
  Synthetic polypeptide representing artificial human antibody VH chain
EVQLVESGGGLVEPGRSLRLSCAASGFTLEEFAMHWVRQVPGKGLEWVSAISWNSGSIAYADSVKGRFTISRDNAKNSLYLQMDSLRAEDTALYYCVKDMGPAGTASAYHYHNGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRE

SEQ ID NO: 51 - protein, 216 aa, Artificial Sequence
  Synthetic polypeptide representing artificial human antibody VH chain
QVQLQESGPGLVKPSETLSLTCTVSGGSISDYYWSWIRQPPGKELEWIGYIYYSGSTNYNPSLKSRVTISVDTSKNQFSLKLSSVTAADTAVYYCARLTTSTSALSYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKSE

SEQ ID NO: 52 - protein, 221 aa, Artificial Sequence
  Synthetic polypeptide representing artificial human antibody VH chain
PVQLVQSGAEVKKPGSSVKVSCKASGGTFSSYAISWVRQAPGQGLEWMGGIIPIFGTANYAQKFQGRVTITADESTSTAYMELSSLRSEDTAVYYCARENWNSAGTTEWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRV

SEQ ID NO: 53 - protein, 117 aa, Artificial Sequence
  Synthetic polypeptide representing artificial human antibody VH chain
QVQLVQSGAEVKKPGASVKVSCKASGYTFSSYGISWVRQAPGQGLEWMGWINGYNGNTNYAQKLQGRVTMTTDTSTSTAYMDLRSLRSDDTAVYYCARDTLQKGDYWGQGTLVTVSS

SEQ ID NO: 54 - protein, 224 aa, Artificial Sequence
  Synthetic polypeptide representing artificial human antibody VH chain
VVQLVESGGGLVQPGGSLRLSCAASGFTFRSYEMNWVRQAPGKGLEWVSYITSSGDTIYHADSVKGRFTISRDNTKNSLYLQMTGLRTEDTAVYYCARASRVLESKSWHGDAFDVWGRGTRVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 55 - protein, 218 aa, Artificial Sequence
  Synthetic polypeptide representing artificial human antibody VH chain
QVQLVQSGAEVKKPGSSVKVSCKASGGTFSSYAISWVRQAPGQGLEWMGGIIPIFGTTNYAQKFQGRVTITADESTSTAYMELSSLRSEDTAVYYCARGLGGSGYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKNE

SEQ ID NO: 56 - protein, 124 aa, Artificial Sequence
  Synthetic polypeptide representing artificial human antibody VH chain
EVQLVQSGAEVKKPGESLKISCRGSGDSFNKYFIGWVRQVPGKALEWMGIIYPGDSDTRYSPSFQGQVTISADKSINIAYLQWTSLKASDTAMYYCARQAFCGANCWSGAYDIWGQGTMVTVSS

SEQ ID NO: 57 - protein, 224 aa, Artificial Sequence
  Synthetic polypeptide representing artificial human antibody VH chain
QVQLVESGGGVVQPGRSLRLSCAASGFTFSTYGMNWVRQAPGKGLEWVAVTWYEGTNEEYADSVKGRFTISRDNSKNTVYLQMNSLRVDDTAVYYCVRRGATVFQGKIIKGYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRE

SEQ ID NO: 58 - protein, 215 aa, Artificial Sequence
  Synthetic polypeptide representing artificial human antibody VH chain
VVQLLESGGGLVQPGGSLRLSCTASGFAFSSYAMTWVRQAPGKGLEWVSVMSGSGAGTYYADAVKGRFTISRDNSKNTLYLQMESLRVEDTAVYYCAKVKGGSNDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKNE

SEQ ID NO: 59 - protein, 218 aa, Artificial Sequence
  Synthetic polypeptide representing artificial human antibody VH chain
QVQLVESGGGVVQPGRSLRLSCAASGFTFSNHAMHWVRQAPGKGLEWVAVISYDGGTKYYADSVKGRFTISRDKSKNTLYLQMNSLRPEDTALYYCARHLYGDFYYLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRG

SEQ ID NO: 60 - protein, 218 aa, Artificial Sequence
  Synthetic polypeptide representing artificial human antibody VH chain
QVQLVESGGGVVRPGRSLRLSCAASGFTFSSHGMHWVRQAPGKGLEWVAVIWYDGSTKYYTDSVKGRFTISRDNSKNTLFLQLNSLRAEDTAVYYCARDHRTGSYYPDYWGQGTLVTVSSTSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRV

SEQ ID NO: 61 - protein, 221 aa, Artificial Sequence
  Synthetic polypeptide representing artificial human antibody VH chain
QVQLQESGPGLVKPSETLSLTCTVSGGSVDNVDSYWSWIRQPPGKGLEWIAYIYFTGSTNYNPSLKSRVTISIDTSKNQFSLKVNAVTAADTAVYYCARGVRQQQVRKWFDPWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKNE

SEQ ID NO: 62 - protein, 223 aa, Artificial Sequence
  Synthetic polypeptide representing artificial human antibody VH chain
PVQLVQSGAEVKKPGESLKISCKGSGYSFTTYWIGWVRQMPGKGLEWMGIIYPGDSDTRYSPSFQGQVTISADKSISTAYLQWNSLKASDTAMYYCAMDNSGSGGVDYWGQGTLVTVSSGSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLP

SEQ ID NO: 63 - protein, 218 aa, Artificial Sequence
  Synthetic polypeptide representing artificial human antibody VH chain
QVQLQESGPGLVKPSQTLPLTCTVSGDSISSGSYYWSWIRQPAGKGLEWIGRIYTSGSTKYNPSLKSRATISIDTSKNQFSLKLSSVTAADTAVYYCARDSYHYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKSE

SEQ ID NO: 64 - protein, 224 aa, Artificial Sequence
  Synthetic polypeptide representing artificial human antibody VH chain
QVQLQQSGPGLVKPSQTLSLTCAISGDSVSSNSAAWHWIRQSPSRGLEWLGRTHYRSKWYNEYAVSVKSRITINPDISKNQFSLQLSSVTPEDTAVYYCARETVYISTYYYGLDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 65 - protein, 218 aa, Artificial Sequence
  Synthetic polypeptide representing artificial human antibody VH chain
PVQLIQSGAEVRKPGASVKVSCKVSGYTLSELSLHWVRQAPGKGLEWMGTFDPEDGETVYAQKFQGRVTVTEDTSTDTAYIDLSSLKSEDTAVYYCATDGPLHTSGLDYWGQGTLVTVSSASTKGPSVFPLAPCSRSTSESTAALGCLVKDYFPEPVTVSWNSGALTSGVHTFPAVLQSSGLYSLSSVVTVPSSSLGTQTYICNVNHKPSNTKVDKRV

SEQ ID NO: 66 - protein, 218 aa, Artificial Sequence
  Synthetic polypeptide representing artificial human antibody VH chain
VVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCACLGAEANDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRV

SEQ ID NO: 67 - protein, 212 aa, Artificial Sequence
  Synthetic polypeptide representing artificial human antibody VH chain
EVQLLESGGGLVQPGGSLRLSCAASGFTFSNYAMNWVRQAPGKGLDWVSAISGSGGSTYYADSVKGRFTISRDISKNTLYLQMNSLRAEDTAVYYCAKVPGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKNE

SEQ ID NO: 68 - protein, 220 aa, Artificial Sequence
  Synthetic polypeptide representing artificial human antibody VH chain
QVKLVQSGAEVKKPGSSVKVSCKTSGGPFSSYTITWVRQAPGQGPEWMGRITPIFNITNYAQNFQGRMTMTADKSTTTAYMELSGLKSEDTAVYYCARAGLSTSWPSWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 69 - protein, 220 aa, Artificial Sequence
  Synthetic polypeptide representing artificial human antibody VH chain
QVQLQESGPGLVKPSQTLSLTCTVSGGSVNTGTSYWTWVRQRPGKGLEWIGFIYYSGSTYYNPALESRLTISLDTSQNQFSLKLTSVTAADTAVYFCARNDISFKQSAIDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRV

SEQ ID NO: 70 - protein, 222 aa, Artificial Sequence
  Synthetic polypeptide representing artificial human antibody VH chain
QVHLAESGGGVVQTGGSLRLSCAVSGFHFGSHGMTWVRQAPGKGLEWLSFITYDGQIKYYGGSVKGRFNISRDNSKNTLHLHMNGLRVEDTAVYYCAKTKTMGVGGEYFGLDVWGLGTTVIVSSASTKGPSVFPLAPSSKSTSGGTAALGCLVKDYFPESVTVSWNSGALTSGVHTFPAVLQSSGLYSLSSVVTVPSSSLGTQTYICNVNHKPSNTKVDKKV

SEQ ID NO: 71 - protein, 222 aa, Artificial Sequence
  Synthetic polypeptide representing artificial human antibody VH chain
PLQLHESGPGLAKPSETLSLTCTLSGGSITTGSYYWAWIRQAPGKALEWIGTIYYSGTTYYNSSLNNRLTISVDTSKNQLSLKLVSVAAADTAIYYCARHKALWFGEAGAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 72 - protein, 223 aa, Artificial Sequence
  Synthetic polypeptide representing artificial human antibody VH chain
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDLLGFRDQRNYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRV

SEQ ID NO: 73 - protein, 119 aa, Artificial Sequence
  Synthetic polypeptide representing artificial human antibody VH chain
QVQLQESGPGLVKPSETLSLSCTVSGASMNNYYWSWIRQSAGKGLEWIGRIYSSGDTDYNPSLKTRVTMSIDTSKNQFSLNLDSVTAADTATYYCARSFYDTLFYFENWGQGTLVTVSS

SEQ ID NO: 74 - protein, 218 aa, Artificial Sequence
  Synthetic polypeptide representing artificial human antibody VH chain
QITLKESGPTLVKPTQTLTLTCTFSGFSLTTTDVGVGWIRQPPGKALEWLTIIYWDDDERYSPSLKSRLTITKDTSKNQVVLSMTNMDPVDTATYYCARVYSTKWDFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRV

SEQ ID NO: 75 - protein, 216 aa, Artificial Sequence
  Synthetic polypeptide representing artificial human antibody VH chain
VVQLVESGGGLVQPGGSLRLSCAASGFTFSSYSMNWVRQAPGKGLEWLSYVSSSGSTMYYADSVKGRFTISRDTAKNSLFLQMNSLRAEDTAVYYCAKGGPLRPFDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 76 - protein, 226 aa, Artificial Sequence
  Synthetic polypeptide representing artificial human antibody VH chain
AVQLVQSGAEVKKPGESLKISCRGSGYNFISHWISWVRQMPGKGLEWQWLGRIDPSDSYTNYSPSFRGHVTISVDKSVNTAYLQWNSLKASDTAMYYCARLSRDGYTIEHFDYWGQGTLVTVSSASPTSPKVFPLSLDSTPQDGNVVVACLVQGFFPQEPLSVTWSESGQNVTARNFPPSQDASGDLYTTSSQLTLPATQCPDGKSVTCHVKHYTNPSQDVTVPCP

SEQ ID NO: 77 - protein, 224 aa, Artificial Sequence
  Synthetic polypeptide representing artificial human antibody VH chain
EVQLVQSGAEVKKPGESLKISCKGSGYSFTSFWIGWVRQMPGKGLEWMGIIFPADSDTRYSPSFQGQVIISVDKSISTAYLQWSSLKASDTAMYYCARRGVSGGSAWTYYNFFDPWGQGTLVTVASASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 78 - protein, 222 aa, Artificial Sequence
  Synthetic polypeptide representing artificial human antibody VH chain
PVQLQESGPGLVKPSETLSLTCTVSGGSIDSYYWSWLRQPPGRGLEWIGYIFYSGITNYSPSLKSRVTISVDTSKNQFSLKLNSVTAADTAVYYCARELPVIGRRTFDIWGQGTMVTVSSASPTSPKVFPLSLCSTQPDGNVVIACLVQGFFPQEPLSVTWSESGQGVTARNFPPSQDASGDLYTTSSQLTLPATQCLAGKSVTCHVKHYTNPSQDVTVPCP

SEQ ID NO: 79 - protein, 227 aa, Artificial Sequence
  Synthetic polypeptide representing artificial human antibody VH chain
PVHLVQSGAEVKKPGSSVKVSCKLSGGIFSYFAIIWVRQAPGQGLEWMGTIIPIFGTSNYAEKFQDRVAIVADEATSTVYMEVNSLRSEDTAIYFCARDSEVEKSDGYMASTAEYFQLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 80 - protein, 221 aa, Artificial Sequence
  Synthetic polypeptide representing artificial human antibody VH chain
SAMHLVESGGAVVQPGESLRLSCSAFEFSFQYFSMFWVRQAPTKGLELVAQITWDGSIINYADSVKGRFTISRDNSKNSLYLQMTSLRSDDTAVYYCVKAGVPWEVQRWFDPWGQGTPVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTV

SEQ ID NO: 81 - protein, 222 aa, Artificial Sequence
  Synthetic polypeptide representing artificial human antibody VH chain
QVHLVQSGAEVKRPGASVKVSCKGSGYTLNNDVAFSWVRQAPGQGPEWLGWINAYQGVTNISPNFRARVTMTTDTSTNTIYMDLQNLRSDDTAIYYCARDRQGLGRMDVWGQGTTVIVSSASPTSPKVFPLSLCSTQPDGNVVIACLVQGFFPQEPLSVTWSESGQGVTARNFPPSQDASGDLYTTSSQLTLPATQCLAGKSVTCHVKHYTNPSQDVTVPCP

SEQ ID NO: 82 - protein, 217 aa, Artificial Sequence
  Synthetic polypeptide representing artificial human antibody VH chain
VVQLVESGGGLVQPGGSLRLSCAASGFRFNYYWMSWVRQAPGKGLEWVANIKEDGSEKYYVDSVKGRFTISRDNAKNSLYLEMNSLRVEDTAVYYCARELGANYYFAYWGQGALVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRV

SEQ ID NO: 83 - protein, 221 aa, Artificial Sequence
  Synthetic polypeptide representing artificial human antibody VH chain
QVQLQESGPGLVKPSQTLSLTCIVSGGSISGDKNFWSWVRQHPEKGLEWLGYISYNGNTYYNPSLISRIIISLDTPKNLFSLRLSSVTVADTAIYYCAREVDIRGDSDAFDIWGRGTVVTVSSASTKGPSVFPLAPCSRSTSESTAALGCLVKDYFPEPVTVSWNSGALTSGVHTFPAVLQSSGLYSLSSVVTVTSSNFGTQTYTCNVDHKPSNTKVDKTV

SEQ ID NO: 84 - protein, 218 aa, Artificial Sequence
  Synthetic polypeptide representing artificial human antibody VH chain
QVRLVESGGGLVQPGGFLRLSCAASGFTFSDYEMNWVRQAPGKGLEWISHIGSSGTYADSVKGRFTISRDNAKNSLYLQMSSLRAEDAGVYYCATTRNSAFLNWGQGTLVTVSSGSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLP

SEQ ID NO: 85 - protein, 219 aa, Artificial Sequence
  Synthetic polypeptide representing artificial human antibody VH chain
EVQLVESGGGLVQPGGSLRLSCAASGFPPRSFAMSWVRQAPGKGLEWVSSISGLGNSIYYAESVKGRFITSRDNSKSTVFLLMNSLRAEDTAVYYCAKSAFGGVPDGFDIWGQGTMVTVSSASTKGPSVFPLAPCSRSTSESTAALGCLVKDYFPEPVTVSWNSGALTSGVHTFPAVLQSSGLYSLSSVVTVPSSSLGTQTYICNVDHKPSNTKVDKTV

SEQ ID NO: 86 - protein, 212 aa, Artificial Sequence
  Synthetic polypeptide representing artificial human antibody VH chain
PVQLVESGGGVVQPGRSLRLSCAASGFTFSNYGMHWVRQAPGKGLEWVAVISDDGNDKDNADSVKGRFTISRDNSKNTLYLRMNSLRREDTAVYYCARDGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKNV

SEQ ID NO: 87 - protein, 120 aa, Artificial Sequence
  Synthetic polypeptide representing artificial human antibody VH chain
EVQLVESGGVVVQPGGSLRLSCAASGFTFDDYTMHWVRQAPGKGLEWVSLISWDGGSTYYADSVKGRFTISRDNSKNSLYLQMNSLRTEDTALYYCAKAGYSFTTAPDYWGQGTLVTVSS

SEQ ID NO: 88 - protein, 219 aa, Artificial Sequence
  Synthetic polypeptide representing artificial human antibody VH chain
PVQLVQSGAEVKKPGASVKVSCKASGDTFPNYVISWVRQAPGQGLEWVGCINTNNGKTNYVQKLQGRVILTTDTSTNTANMELRSLRFDDTAVYYCARERGQVRSYGMDVWGQGTAVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRV

SEQ ID NO: 89 - protein, 228 aa, Artificial Sequence
  Synthetic polypeptide representing artificial human antibody VH chain
EVQLVESGGGLVQPGRSLRLSCAASGFTFDDYAMHWVRQPPGRGLEWVSGIDWSGKTTEYAQSVKGRFTISRDNAKNSLYLQMNSLRVEDTALYFCVKIGGDGTAYAWTFRHFDSWGQGTRVTVSSASPTSPKVFPLSLCSTQPDGNVVIACLVQGFFPQEPLSVTWSESGQGVTARNFPPSQDASGDLYTTSSQLTLPATQCLAGKSVTCHVKHYTNPSQDVTVPCP

SEQ ID NO: 90 - protein, 218 aa, Artificial Sequence
  Synthetic polypeptide representing artificial human antibody VH chain
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARGLGGDWNYLAYWGQGTLVTVSSASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRV

SEQ ID NO: 91 - protein, 226 aa, Artificial Sequence
  Synthetic polypeptide representing artificial human antibody VH chain
QVQLVESGGGVVQPGRSLRLSCAASGFTFSNYDMHWVRQAPGKGLEWVTVVSYDGTNKYYAESVQGRFTISRDNSKNTLYLQMNSLRTEDTAVYYCAKEGGWGNTVTTSYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRV

SEQ ID NO: 92 - protein, 219 aa, Artificial Sequence
  Synthetic polypeptide representing artificial human antibody VH chain
EVQLVESGGGLVRPGGSLRLSCVGSGFTFSPYSINWVRQAPGKGLEWVSSITSTSSYLDYADSVKGRFTISRDNAKNSVYLQMNSLRVEDTAVYYCTRDGGYFATGEFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRA

SEQ ID NO: 93 - protein, 222 aa, Artificial Sequence
  Synthetic polypeptide representing artificial human antibody VH chain
PVQLQESGPGLVKPSQTLSLTCTVSGGSITSGSYFWSWIRQPAGEGLEWIGRIYTSGSTNYNPSLKSRVTISADTSKNHFSLELSSVTAADTAMYFCARERFGQGALDYWGQGTLVTVSSASPTSPKVFPLSLDSTPQDGNVVVACLVQGFFPQEPLSVTWSESGQNVTARNFPPSQDASGDLYTTSSQLTLPATQCPDGKSVTCHVKHYTNSSQDVTVPCP

SEQ ID NO: 94 - protein, 221 aa, Artificial Sequence
  Synthetic polypeptide representing artificial human antibody VH chain
QLHLQESGPGLVKPSETLSLTCTVSGGSVSSSSYYWGWVRQPPGKGLEWIGHVYYSGRTYYNPSLKSRATISLDTSKNQFSLKLSSLTATDTAVYYCATIVAAYSYGFEFDPWGQGILVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRA

SEQ ID NO: 95 - protein, 226 aa, Artificial Sequence; identical to SEQ ID NO: 91
  Synthetic polypeptide representing artificial human antibody VH chain

SEQ ID NO: 96 - protein, 121 aa, Artificial Sequence
  Synthetic polypeptide representing artificial human antibody VH chain
VQLVQSGAEVRKPGESLTISCKTSGYAFIGNWIGWVRQRPGKGLEWIGMIYPVDSDTRYSPSFQGQVTISVDKSIRTAYLQWNSLRASDTATYYCARQGFEALVIRGFDYWGQGTVVTVSS

SEQ ID NO: 97 - protein, 222 aa, Artificial Sequence
  Synthetic polypeptide representing artificial human antibody VH chain
EGQLLESGGGLVQPGGSLRLSCEASGFTFSFSSYAMSWVRQAPGRGLEWVSVTGGSGYTKYYADSVKGRFTVSRDNSKNTLYLQMNSLRAEDTALYYCARRSTSSPSFSTLDVWGRGATVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKSE

SEQ ID NO: 98 - protein, 215 aa, Artificial Sequence
  Synthetic polypeptide representing artificial human antibody VH chain
VVQLVESGGGLVQPGGSLRLSCAASGFTFNNYEMNWVRQAPGKGLEWVSYISSSGSTIYYADSVKGRFTISRDNAKNSLYLQMNSLRAEDTAVYYCARQMVTTRGYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKNV

SEQ ID NO: 99 - protein, 221 aa, Artificial Sequence
  Synthetic polypeptide representing artificial human antibody VH chain
EVQLVESGGGLVQPGGSLRLSCAASGFTFSSNWMSWVRQAPGKGLEWVANIKEDGSEKYYVDSVKGRFTIFRDNAKNSLYLQMNSLRAEDTAVYYCARVPSRYGRSRGAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRV

SEQ ID NO: 100 - protein, 218 aa, Artificial Sequence
  Synthetic polypeptide representing artificial human antibody VH chain
QVQLQESGPGLVKPSQTLSLTCTVSGGSISSGGYYWSWIRQHPGKGLEWIGYIYYSGSTYYNPSLKSLVTISVDTSKNQFSLKLSSVTAADTAVYYCARNLYRLGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 101 - protein, 218 aa, Artificial Sequence
  Synthetic polypeptide representing artificial human antibody VH chain
QVQLVESGGGVVQPGRSLRLSCAASGFTFSSYGMHWVRQAPGKGLEWVAIISYDGSNKYYADSVKGRFTISRDKSKNTLYLQMNSLRAEDTAVYYCAKSKGNYRDAMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRV

SEQ ID NO: 102 - protein, 219 aa, Artificial Sequence
  Synthetic polypeptide representing artificial human antibody VH chain
QVLLVESGGGLVKPGGSLRLSCAASGFTFSDYYMSWIRQAPGKGLEWVSYIGSSTTAIYYADSVKGRFTISRDNARNSLYLQMNSLRAEDTAVYYCATSYTVTTFYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRV

SEQ ID NO: 103 - protein, 218 aa, Artificial Sequence
  Synthetic polypeptide representing artificial human antibody VH chain
QVQLQESGPGLVKPSQTLSLTCAVSGGSISSGGYPWSWIRQPPGKGLEWIGYISYSGSTDYNPSLKSRVTISLDTSSNQFSLNLSSLTAADTAVYYCARGAAFYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRV

SEQ ID NO: 104 - protein, 219 aa, Artificial Sequence
  Synthetic polypeptide representing artificial human antibody VH chain
QVQLQESGPGLVKPSETLSLTCTVSGGSISIYYWSWIRQPPGKGLEWIGYIYYSGSTNYNPSLKSRVTISVDTSKNQFSLKLRSVTAADTAVYYCARDTYGDPRGDYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 105 - protein, 123 aa, Artificial Sequence
  Synthetic polypeptide representing artificial human antibody VH chain
QVQLQESGPGLVKPSETLSLTCTVANSSISSYYWSWVRQPPGKALEWIGYISYSGSTNYNPSLKSRVTMSLDTPKSQFSLNLSSVTGADTAIYYCARLWGSGDWWPSLYFDSWGQGTLVTVSS

SEQ ID NO: 106 - protein, 218 aa, Artificial Sequence
  Synthetic polypeptide representing artificial human antibody VH chain
VVQLVESGGGLVQPGGSLRLSCAASGFTFNSYWMSWVRQAPGKGLEWVANIKQDGSEKYYVDSVKGRFTISRDNAKNSLYLQMNSLRAEDTAVYYCARIRRIAATSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKNV

SEQ ID NO: 107 - protein, 225 aa, Artificial Sequence
  Synthetic polypeptide representing artificial human antibody VH chain
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKIARRPPSFYDYMDVWGKGTTVTVSSASPTSPKVFPLSLCSTQPDGNVVIACLVQGFFPQEPLSVTWSESGQGVTARNFPPSQDASGDLYTTSSQLTLPATQCLAGKSVTCHVKHYTNPSQDVTVPCP

SEQ ID NO: 108 - protein, 225 aa, Artificial Sequence
  Synthetic polypeptide representing artificial human antibody VH chain
EVQLVQSGAEVKKPGESLKISCQGSGYRFNAYWIGWVRQIPGKGLEWMGIIYPGDSDTKYSPSFQGQVTISADKSISTAYLQWNGLEASDTAVYYCARSTSSSTSDFHYMDVWGKGTTVTISSASPTSPKVFPLSLCSTQPDGNVVIACLVQGFFPQEPLSVTWSESGQGVTARNFPPSQDASGDLYTTSSQLTLPATQCLAGKSVTCHVKHYTNPSQDVTVPCP

SEQ ID NO: 109 - protein, 218 aa, Artificial Sequence
  Synthetic polypeptide representing artificial human antibody VH chain
HVQLLQSGPGLVKPSQTLSLTCAISGDSVSSTSGAWNWIRQSPSRGLEWLGRTYYRSQWMNDYAESVRSRITINPDTSKNQFSLQLKSVTPEDTAVYYCTRGWAFTSSDWGQGTQVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTV

SEQ ID NO: 110 - protein, 222 aa, Artificial Sequence
  Synthetic polypeptide representing artificial human antibody VH chain
HVHLQQSGPGLVTPSQTLSLTCAISGDSVSSNSAAWNWIRQSPSRGLEWLGRTYYRSKWYNDYAVSVKSRITFKADTSKNQFSLQLDSVTPDDTAVYYCAGGWALGYWGQGTLVTVSSGSASAPTLFPLVSCENSPSDTSSVAVGCLAQDFLPDSITFSWKYKNNSDISSTRGFPSVLRGGKYAATSQVLLPSKEVMQGTDEHVVCKVQHPNGNKEKNVPLP

SEQ ID NO: 111 - protein, 116 aa, Artificial Sequence
  Synthetic polypeptide representing artificial human antibody VH chain
PVQLQESGPGLVKPSETLSLTCTVSGGSISSYYWSWIRQPPGKGLEWIGYLFYSGSTNYNPSLKSRVTISVDTSKNQFSLKLGSVTAADTAVYYCARHRIFGLDVWGQGTTVTVSS

SEQ ID NO: 112 - protein, 230 aa, Artificial Sequence
  Synthetic polypeptide representing artificial human antibody VH chain
CAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRGPTDTWSGEVGYYFDYWGQGTLVTVSSASPTSPKVFPLSLCSTQPDGNVVIACLVQGFFPQEPLSVTWSESGQGVTARNFPPSQDASGDLYTTSSQLTLPATQCLAGKSVTCHVKHYTNPSQDVTVPCP

SEQ ID NO: 113 - protein, 223 aa, Artificial Sequence
  Synthetic polypeptide representing artificial human antibody VH chain
QCQVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDGKTLGYGGNSVDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 114 - protein, 224 aa, Artificial Sequence
  Synthetic polypeptide representing artificial human antibody VH chain
EVQLVESGGGLVKPGGSLRLSCAVSGFTFRSYSMNWVRQAPGKGLEWVSSISSSSRYVDYADSVKGRFTISRDNAKNLLYLQMNFLRVEDTAVYYCARTETKWEDRGLWDYWGQGTLVTVSSASPTSPKVFPLSLCSTQPDGNVVIACLVQGFFPQEPLSVTWSESGQGVTARNFPPSQDASGDLYTTSSQLTLPATQCLAGKSVTCHVKHYTNPSQDVTVPCP

SEQ ID NO: 115 - protein, 215 aa, Artificial Sequence
  Synthetic polypeptide representing artificial human antibody VH chain
QVQLVQSGAEVKKPGSSVKVSCKTSGGTFSSYTISWVRQAPGQGPEWMGRIIPILNITNYAQKFQGRVTITADKSTSTTYMEMGSLRSEDTAVYFCARSFYGSGLQWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRV

SEQ ID NO: 116 - protein, 218 aa, Artificial Sequence
  Synthetic polypeptide representing artificial human antibody VH chain
GVDLVESGGGLVKPGGSLRLSCAASGFSFSRYNINWVRQAPGKGLEWVSSISSTSNYIYYADSVKGRFTISRDNAKNSLYLQMNSLRAEDTAVYYCARAMGGYTYYLDDWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 117 - protein, 222 aa, Artificial Sequence
  Synthetic polypeptide representing artificial human antibody VH chain
QVQLVESGGGVVQPGRSLRLSCAASGFTFTNYAIHWVRQAPDKGLEWVSVISYDGSDEYYADSVKGRFTISRDNSKNTVYLQMSSLRAEDTAVYRCARAGKDGYNFFYYGMDVWGQGTTVSVSSPSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKL

SEQ ID NO: 118 - protein, 220 aa, Artificial Sequence
  Synthetic polypeptide representing artificial human antibody VH chain
QVQLVESGGGVVQPGRSLRLSCAASGFSFSSFGMHWVRQAPGKGLEWVAVIWHDGSHKSHADSVKGRFTISRDNSKNTVYLQMNSLGAEDTAVYYCARGIMTTAISYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRV

SEQ ID NO: 119 - protein, 125 aa, Artificial Sequence
  Synthetic polypeptide representing artificial human antibody VH chain
EVQLLQSGGGLVQPGGSLRLSCAASGFTFSSYAVTWVRQAPGKGLEWVSTISGDGRSTYFADSVKGRFAIYRDNSKNTLSLLLNSLRAEDTAVYYCAKGERDLTDYGDPEYFQHWGQGTLVTVSS

SEQ ID NO: 120 - protein, 125 aa, Artificial Sequence
  Synthetic polypeptide representing artificial human antibody VH chain
QVQVVESGGGVVQPGRSLRLSCVASGFTFSSHGMHWVRQAPGKGLEWVAVISDDGKNKYYGDSVQGRFVISRDNSKNTIYLQMYDLRAEDTAVYYCAKDLRYCSARSSCFGIDFWGQGTLVTVSS

SEQ ID NO: 121 - protein, 214 aa, Artificial Sequence
  Synthetic polypeptide representing artificial human antibody VH chain
VVQLVESGGGLVQPGGSLRLSCAASGFSFSTYWMSWVRQAPGKGLEWVANIKQDGSEKHYVDSVKGRFTISRDNAKNSLYLQMNSLRAEDTAMYYCARRAYSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKSE

SEQ ID NO: 122 - protein, 223 aa, Artificial Sequence
  Synthetic polypeptide representing artificial human antibody VH chain
EVQLVESGGGLVQPGGSLRLSCAASGFTFNNYWMHWVRQAPGKGLVWVSRISSDGSTTASADSVKGRFTISRDNAKNTLFLQMNSLRAEDTAVYYCAREGAPDDYGDSGTAFDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 123 - protein, 219 aa, Artificial Sequence
  Synthetic polypeptide representing artificial human antibody VH chain
EVHLVQSGGGLVKPGGSLRLSCAASGFTFSHGWMSWVRQAPGKGLEWVARIRSKTDGGTTDYAAPVNGRFTISRDISIETLYLQMDSLKTEDTAVYYCTTDHPYGDYSDNWGQGVLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKSE

SEQ ID NO: 124 - protein, 218 aa, Artificial Sequence
  Synthetic polypeptide representing artificial human antibody VH chain
QVQLQESGPGLVKPSETLSLTCTVSGGSIRNDYWSWIRQSPGKGLEWIGYISDIGDTNYNPSFKSRISISLDTSKNQFSLKLNSVTAADTAVYYCAKELLGGFDYWGQGTLVAVSTASPTSPKVFPLSLCSTQPDGNVVIACLVQGFFPQEPLSVTWSESGQGVTARNFPPSQDASGDLYTTSSQLTLPATQCLAGKSVTCHVKHYTNPSQDVTVPCP

SEQ ID NO: 125 - protein, 218 aa, Artificial Sequence
  Synthetic polypeptide representing artificial human antibody VH chain
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARVFGSAAGAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKSE

SEQ ID NO: 126 - protein, 218 aa, Artificial Sequence
  Synthetic polypeptide representing artificial human antibody VH chain
PLQLHESGPGLVKPSETLSLTCSVSGGSISSSNYFWGWIRQSPGMGLEWIGSIYFSGKTHYNPSLKSRVTISVDTSKNHFSLKLSSVTAADTAVFFCARHDWRLYAFDYWGLGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKSE

SEQ ID NO: 127 - protein, 220 aa, Artificial Sequence
  Synthetic polypeptide representing artificial human antibody VH chain
VVQLVESGGGLVQPGGSLRLSCAGSGFTFSDYWMHWVRQAPGKGLVWVSTINRDGSYTNHADSVKGRFTISRDNARSTLFLQMSSLRVEDTAVYYCAGGETSPDYWGQGTLVTVSSGSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLP

SEQ ID NO: 128 - protein, 221 aa, Artificial Sequence
  Synthetic polypeptide representing artificial human antibody VH chain
QLQLQESGPGLVKPSETLSLTCTVSDVSIISSFYYWGWIRQPPGKGLEWIGSVYYSGSTSYNPSLKSRVTISADTSKAHFSLNLRSVTAADTAVYYCVSRGPLGGAAAGPDYWGQGALVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRV

SEQ ID NO: 129 - protein, 216 aa, Artificial Sequence
  Synthetic polypeptide representing artificial human antibody VH chain
QVRLQESGPGLVKPSQTLSLTCTVSGASVSSGSYYWAWVRQSAAKGLEWIGRVSPSGTNNYNTALKSRVTISLDTARNQFSLTVTSVTAEDTAIYYCARDVRGWFVPWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKSE

SEQ ID NO: 130 - protein, 224 aa, Artificial Sequence
  Synthetic polypeptide representing artificial human antibody VH chain
PVQLVQSGAVVKKPGSSVKVSCKASGGTFSGYGINWVRQAPGQGLEWMGRIIPIVGEANYAQKFQGRVTINADKSTSTATLEVRSLRSEDTAVYYCVRDRNIVSVPGAIPYGMDVWGQGTTVTVSSASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRV

SEQ ID NO: 131 - protein, 116 aa, Artificial Sequence
  Synthetic polypeptide representing artificial human antibody VH chain
VVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCARGSDTLDYWGQGTLVTVSS

SEQ ID NO: 132 - protein, 218 aa, Artificial Sequence
  Synthetic polypeptide representing artificial human antibody VH chain
QVQLQESGPGLLKPSQTLSLSCTVSGGSISSGDYYWSWIRQPPGKGLEWIGYIYYNGSTYYSSSLRSRLTISVDTSKNQFSLKLSSVTAADTAAYYCARVGLTFALFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRV

SEQ ID NO: 133 - protein, 222 aa, Artificial Sequence
  Synthetic polypeptide representing artificial human antibody VH chain
VVQLLESGGGLVQPGGSLRLSCAASGFTFSSYAINWVRQAPGKGLEWVSAISGSGGSTYYADSVKGRFTISRDNSKNTLYLQMNSLRAEDTAVYYCANSAGIQLWSSDNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKSE

SEQ ID NO: 134 - protein, 219 aa, Artificial Sequence
  Synthetic polypeptide representing artificial human antibody VH chain
EVQLLESGGGLVQPGGSLRLSCAASGFTFSSYAMSWVRQAPGKGLEWVSAISASGRTTYYADSFKGRFTISRDNSKNTLYLQMSRLRGDDAAVYYCAKEGIELMILWGQGTLVTVSSTSPTSPKVFPLSLCSTQPDGNVVIACLVQGFFPQEPLSVTWSESGQGVTARNFPPSQDASGDLYTTSSQLTLPATQCLAGKSVTCHVKHYTNPSQDVTVPCP

SEQ ID NO: 135 - protein, 223 aa, Artificial Sequence
  Synthetic polypeptide representing artificial human antibody VH chain
VVQLVESGGALVQPGGSLRLSCAASGFTLSSYAMYWVRQAPGKGLEYVSAITANGGSTYYANSVKGRFTVSRDNSKKTVYLQLGSLRAEDTAVYYCARGITLTRGVSFDYWGQGTLVTVSPASPTSPKVFPLSLCSTQPDGNVVIACLVQGFFPQEPLSVTWSESGQGVTARNFPPSQDASGDLYTTSSQLTLPATQCLAGKSVTCHVKHYTNPSQDVTVPCP

SEQ ID NO: 136 - protein, 117 aa, Artificial Sequence
  Synthetic polypeptide representing artificial human antibody VH chain
PLQLQESGSGLVKPSQTLSLTCAVSGGSISSGGYSWSWIRQPPGKGLEWLGYIYHRGTSYYNPSLKSRVTISLDMSKNQLSLKLTSVTAADTAVYYCARDGGAFDIWGQGTLVTVSS

SEQ ID NO: 137 - protein, 221 aa, Artificial Sequence
  Synthetic polypeptide representing artificial human antibody VH chain
QVHLVESGGGVVQPGRSLRLSCAASGFTFSNSAMHWVRQAPGKGLDWVSVISFDGSNQYYADSVKGRFTISRDNSKNTLFLQMNSLRAEDTAVYYCARDRLFTAINSGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKSE

SEQ ID NO: 138 - protein, 118 aa, Artificial Sequence
  Synthetic polypeptide representing artificial human antibody VH chain
QVQLVQPGGEVKKPGASVKISCKASGYTFTSHYMHWVRQAPGQGLEWMGMIDPSGGSRTYAQKFQGRVTMTRDTSTSTVYMELSSLRSDDTAVYYCAREGSYYGIGYWGQGTLVTVSS

SEQ ID NO: 139 - protein, 121 aa, Artificial Sequence
  Synthetic polypeptide representing artificial human antibody VH chain
EVQLVESGGVVVQPGGSLRLSCAASGFTFSAYWMHWVRQAPGKGLVWVSRINTDGSSTSYADSVKGRFTISRDNAKNSLYLQMNSLRAEDTAVYYCARDTDSGWLDSFDYWGQGTLVTVSS

SEQ ID NO: 140 - protein, 128 aa, Artificial Sequence
  Synthetic polypeptide representing artificial human antibody VH chain
QGQLVQSGAEVKKAGASVKVSCKVSGYSLTEISMHWVRQAPGKGLEWVGGFDPEGGETIYAQKFQGRVSMTWDTSIDLAYMELRSLSSDDTALYYCATDQGCDDGSCYVGHYYGMDVWGQGTKVTVSS

SEQ ID NO: 141 - protein, 216 aa, Artificial Sequence
  Synthetic polypeptide representing artificial human antibody VH chain
PLQLQESGPGLVKPSETLSLTCSVSGGSIRSSAPFWGWIRQPPGKGLEWIGNIYYNGDTSYSPSLENRVTLFVDTSKNQFSLNLTSVTAADTAVYYCGRIMTPSIDLWGQGKLVTVSSASPTSPKVFPLAPSSKSTSGGTAALGCLVKDYFPEPVTVSWNSGALTSGVHTFPAVLQSSGLYSLSSVVTVPSSSLGTQTYICNVNHKPSNTKVDKNE

SEQ ID NO: 142 - protein, 218 aa, Artificial Sequence
  Synthetic polypeptide representing artificial human antibody VH chain
QVQLVQSGAEVKKPGASVKVSCKASGYIFTTYVISWVRQAPGQGLEWMGWISAYTGNTNYPQKFQGRVTMTTDTATSTAYMELKSLRSDDTAVYYCAREGRGGGDFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKNV

SEQ ID NO: 143 - protein, 219 aa, Artificial Sequence
  Synthetic polypeptide representing artificial human antibody VH chain
VQLVESGGGLVQPGRSLRLSCAASGFTFDDYAMHWVRQAPGKGLEWVSGIIWNSGTTGYADSVKGRFTISRDNAKKSLYLQMNSLRTEDTALYYCAKDGDSLGDFSTFDIWGHGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKNV

SEQ ID NO: 144 - protein, 217 aa, Artificial Sequence
  Synthetic polypeptide representing artificial human antibody VH chain
EVQLVESGGGLVQTGGSLRLSCSASGFTFNNYWMHWVRQAPGKGLLWLSRINTDGSRGHYDDSVQGRFTISRDNAKQTVYLQMDGLRAEDTAVYFCARDGYDFRAFDHWGQGVLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 145 - protein, 224 aa, Artificial Sequence
  Synthetic polypeptide representing artificial human antibody VH chain
QVQLLESGPGVVKPSETLSLTCSVSGDSVSSFYWTWIRQPPGKGPEWIGNIYHSGSTNFNPSLKSRVTISLDMSKNQFSLHLKSVTAADTAVYYCARARGGGFCSNMDCPAMFDYWGRGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKSE

SEQ ID NO: 146 - protein, 121 aa, Artificial Sequence
  Synthetic polypeptide representing artificial human antibody VH chain
EVQLVESGGGSVKPGGSLRLSCVAGGYNFNDDRMSSMNWVRQAPGKGLEWVGRIKSKSDGGSTNYAAPVQGRFTISRDDSKNTLYLQMNSLKIEDTAVYYCTTIHDYGDHWGQGTLVTVSS

SEQ ID NO: 147 - protein, 214 aa, Artificial Sequence
  Synthetic polypeptide representing artificial human antibody VH chain
EVQLVESGGALVQPGGSLRISCAASGFTVSTNYMSWVRQAPGKELEWISVIYSGGTTYYAAPVKGRFTISRDDSKNTLYLQMNSLRVEDTAVYHCARGLLRSLDVWGQGTTVTVSSASTKGPSVFPLAPCSRSTSESTAALGCLVKDYFPEPVTVSWNSGALTSGVHTFPAVLQSSGLYSLSSVVTVTSSNFGTQTYTCNVDHKPSNTKVDKTV

SEQ ID NO: 148 - protein, 225 aa, Artificial Sequence
  Synthetic polypeptide representing artificial human antibody VH chain
EVHLVESGGGFVQPGGSLRLSCAASGFTFSDHYMDWVRQAPGKGLEWVGRIKNRANSYNTEYAASVRGRFTISRDDSNNSLFLQMNSLTAEDTAVYYCARVKLGASSRVFDVWGQGTMVTVSSASPTSPKVFPLSLCSTQPDGNVVIACLVQGFFPQEPLSVTWSESGQGVTARNFPPSQDASGDLYTTSSQLTLPATQCLAGKSVTCHVKHYTNPSQDVTVPCP

SEQ ID NO: 149 - protein, 120 aa, Artificial Sequence
  Synthetic polypeptide representing artificial human antibody VH chain
QVQLVESGGGVVQPGRSLRLSCAASGFTFRDYGMHWVRQAPGQGLQWVAVISFDGSDKFYADSVKGRFSISRDNSRDTVYLQMNRLRPEDTAVYYCATTVTPKVTSFASWGQGSLVTVSA

SEQ ID NO: 150 - protein, 221 aa, Artificial Sequence
  Synthetic polypeptide representing artificial human antibody VH chain
CEVQLVESGGGLVKPGGSLRLSCAASGFDIRSYTIHWVRQAPGKGLEWVSSITAGGSFINYADSVKGRFTISRDNAQNSLFLQVDRLRAEDTALYFCAREQSPLYFGPSLDVWGQGTSVIVSLASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKSE

SEQ ID NO: 151 - protein, 217 aa, Artificial Sequence
  Synthetic polypeptide representing artificial human antibody VH chain
QVQLVQSGAEVKNPGASVKVSCKASGYTFTDYYIHWVRQAPGQGLEWMGWINPNSGGTNHAQKFQGRVTMTRDMSINTAYMEVSGLRSDDTAIYYCAREPYSSYAMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 152 - protein, 218 aa, Artificial Sequence
  Synthetic polypeptide representing artificial human antibody VH chain
CEVQLLESGGGLVQPGGSLRLSCAASGFTFSNYAMSWVRQAPGKGLKWVSSISYSGGSTYYADSVKGRVTISRDNSKNTLYLQMNSLRAEDTAVYYCAKDGSEMLLCDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKIV

SEQ ID NO: 153 - protein, 217 aa, Artificial Sequence
  Synthetic polypeptide representing artificial human antibody VH chain
CDVHLVQSGGGLVKPGGSLRLSCAASGFNFNSYTMTWVRQAPGKGLQWVSSISSSGGDINYADSLKGRFSISRDNAKNSVFLQLNSLRAEDTAVYYCARDTRWRGLDSWGQGILVTVSSASTKGPSVFPLAPCSRSTSESTAALGCLVKDYFPEPVTVSWNSGALTSGVHTFPAVLQSSGLYSLSSVVTVTSSNFGTQTYTCNVDHKPSNTKVDKTV

SEQ ID NO: 154 - protein, 222 aa, Artificial Sequence
  Synthetic polypeptide representing artificial human antibody VH chain
GVQLVESGGDLVQPGRSLRLSCAASGFTFDDYAMHWVRQSPGKGLEWVSSISWNSGDIAYGDSVKGRFTVSRDNAKNSLHLQLNSLRVEDSALYYCAKDLLAVPGLLDDWGQGTLVTVSTASPTSPKVFPLSLCSTQPDGNVVIACLVQGFFPQEPLSVTWSESGQGVTARNFPPSQDASGDLYTTSSQLTLPATQCLAGKSVTCHVKHYTNPSQDVTVPCP

SEQ ID NO: 155 - protein, 213 aa, Artificial Sequence
  Synthetic polypeptide representing artificial human antibody VH chain
QVLLVQSGAEVKKPGSSVKVSCKASGGTFSSYGISWVRQAPGQGLEWMGGMANYAQKFQGRVTISGDESTSTAYMELSNLTSEDTAVYYCASRGGSSRRYGMGVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRV

SEQ ID NO: 156 - protein, 222 aa, Artificial Sequence
  Synthetic polypeptide representing artificial human antibody VH chain
CEVQLLESGGALVQPGGSLRLSCAVSGLTFNRFAMTWVRQAPGKGLEWVSHIGGSGGYTYYADSVKGRFTISRDNSKNTLYLQMNSLRAEDTAVYHCVKLKGIGAMWTYAMDVWGQGTTVTVSSASTKGPSVFPLAPCSRSTSESTAALGCLVKDYFPEPVTVSWNSGALTSGVHTFPAVLQSSGLYSLSSVVTVTSSNFGTQTYTCNVDHKPSNTKVDKTV

SEQ ID NO: 157 - protein, 227 aa, Artificial Sequence
  Synthetic polypeptide representing artificial human antibody VH chain
QLQLQESGPGLVKPSDTLSLTCTVSGYSISTAYYWGWIRQPPGKGLEWIGSIFHSGSAYYNPSLDGRVSLSVDTSKNQFSLRLKSVTAADTAVYYCARDQGYGDYDYPRDWIEPWGQGTLVTVSSASPTSPKVFPLSLDSTPQDGNVVVACLVQGFFPQEPLSVTWSESGQNVTARNFPPSQDASGDLYTTSSQLTLPATQCPDGKSVTCHVKHYTNPSQDVTVPCP

SEQ ID NO: 158 - protein, 123 aa, Artificial Sequence
  Synthetic polypeptide representing artificial human antibody VH chain
QVQLVQSGAEVKKPGSSVKVSCKASGGNVRSYSISWVRQAPGQGLEWMGGMITTFGKADYALKFRDRVTITADRSTNTVYMELSSLTSQDTAVYYCASVRDLVSGTTYYYHYWGQGTLISVSS

SEQ ID NO: 159 - protein, 214 aa, Artificial Sequence
  Synthetic polypeptide representing artificial human antibody VH chain
QVQLQESGPGLVKPSETLSLTCTVSGDSISSNYWSWIRQPPGKGLEWIGYIYYSGSTNYNPSLKSRVTISVDTSKNQFSVKLSSVTAADTAVYYCARYGDYSFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKSE

SEQ ID NO: 160 - protein, 218 aa, Artificial Sequence
  Synthetic polypeptide representing artificial human antibody VH chain
QVQLVQSGAEVKKPGASVKVSCKAFGYRFSNFGISWVRQAPGQGLEWMGWISAYNGNTNYAQKLQGRVTMTTDTSTSTAYMELRSLRSDDTAVYYCARVVDTVLADFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKSE

SEQ ID NO: 161 - protein, 219 aa, Artificial Sequence
  Synthetic polypeptide representing artificial human antibody VH chain
QVHLVQSGSEFKKPGASVKISCKTSGYTFTNYAMNWVRQAPGQGLEWVGWINTVTGIPGYAQGFTGRFIISLDTSGRTSYLQINSLQAEDTAVYYCARSGGFGWSRDLDYWGQGTLVTVSSASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRV

SEQ ID NO: 162 - protein, 223 aa, Artificial Sequence
  Synthetic polypeptide representing artificial human antibody VH chain
PQLQLQESGPGLVKPSETLSLTCSVSGDSISSSSYFWGWIRQPPGKGLEWIGSVYYSGSTYYKPSLKSRLTISVDTSKKQFSLNLSSMTAADTAVYYCARHGFWSGPIPDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKNE

SEQ ID NO: 163 - protein, 217 aa, Artificial Sequence
  Synthetic polypeptide representing artificial human antibody VH chain
QVQLVESGGGVVHPGRSLRLSCAASGFTFSNYGMHWLRQAPGKGLEWVAIIAYDGSQKKYADSVKGRFTISRDNSKDTMYLQMNNLRTEDTAVYYCAHEDYGSGNGNYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKSE

SEQ ID NO: 164 - protein, 220 aa, Artificial Sequence
  Synthetic polypeptide representing artificial human antibody VH chain
PVHLVQSGAEVRKPGSSVKVSCMASGGSFNTYAVNWVRQAPGQGLEWMGGIIPVFGTTNYAPRFQGRVTITADESTSTVYMELTSLTSEDTAVYYCARDRDSGYERNCLDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRV

SEQ ID NO: 165 - protein, 231 aa, Artificial Sequence
  Synthetic polypeptide representing artificial human antibody VH chain
QVQLMQSGAEVKQPGASVKVSCKASGDTFTSFAIHWVRQVSGQGLEWMGWINAGNGDTKYSQKIQGRITITRDTSARTAYMELSSLRSEDTAVYYCARGAPYGSRIYYDYDSYHGMDVWGQGTTVTVSSASPTSPKVFPLSLCSTQPDGNVVIACLVQGFFPQEPLSVTWSESGQGVTARNFPPSQDASGDLYTTSSQLTLPATQCLAGKSVTCHVKHYTNPSQDVTVPCP

SEQ ID NO: 166 - protein, 222 aa, Artificial Sequence
  Synthetic polypeptide representing artificial human antibody VH chain
QVHLQESGPGLVKPSQTLSLTCTVSGDSISNGDYCWNWIRQRPGKGLEWIGYIYHSGSTYENPSLRSRVTMSVDTSKNQFSMELTSVTAADTAVYYCARGKFDWFPRVSSFDYWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKSE

SEQ ID NO: 167 - protein, 222 aa, Artificial Sequence
  Synthetic polypeptide representing artificial human antibody VH chain
VVQLVESGGDWVQPGGSLRLSCAASGFTFRSYWMSWVRQAPGKGLEWVASVEGYRSEEYYVDSVKGRFTISRDNAKNSVYLQMNSLRAEDTAVYYCAAAYYIDTSGFDYWGQGTQVTVSSASPTSPKVFPLSLCSTQPDGNVVIACLVQGFFPQEPLSVTWSESGQGVTARNFPPSQDASGDLYTTSSQLTLPATQCLAGKSVTCHVKHYTNPSQDVTVPCP

SEQ ID NO: 168 - protein, 224 aa, Artificial Sequence
  Synthetic polypeptide representing artificial human antibody VH chain
CEVQLLESGGKLVQPGGSLRLSCAASGFTYDSYVMNWVRQAPGKGLEWVSGISASGGGTYYADSVKGRFTISRDNSKNTLYLEMNSLRADDTAVYYCAKGRTYSNNWLFHWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKNE

SEQ ID NO: 169 - protein, 219 aa, Artificial Sequence
  Synthetic polypeptide representing artificial human antibody VH chain
PVQLQESGPGLVKPSETLSLTCTVSSGSVSSGSHYWSWIRQPPGKGLEWIGYIYYSGTSNYNPSLKGRVAISVDTSKNQFSLKLSSVTAADTAIYYCARVFSTIFHGVDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 170 - protein, 224 aa, Artificial Sequence
  Synthetic polypeptide representing artificial human antibody VH chain
QVQLVQSGAEVKKPGASVKVSCRASGYSFTGYYIHWVRQAPGQGLEWMGWINPKTGDTHYAQNFQGWVTMTRDTSISTAYMELTILRSDDTAVYYCARHLSSGEYHYGLDVWGQGTTVTASSASPTSPKVFPLSLCSTQPDGNVVIACLVQGFFPQEPLSVTWSESGQGVTARNFPPSQDASGDLYTTSSQLTLPATQCLAGKSVTCHVKHYTNPSQDVTVPCP

SEQ ID NO: 171 - protein, 217 aa, Artificial Sequence
  Synthetic polypeptide representing artificial human antibody VH chain
VQLVESGGGVVQPGRSLRLSCAAPGFTFSNYGMHWVRQAPGKGLEWVAVISYDGSNKYYADSVKGRFTISRDNSKNTLYLQMNSLRAEDTAVYYCAKGKGIVGATFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKNV

SEQ ID NO: 172 - protein, 224 aa, Artificial Sequence
  Synthetic polypeptide representing artificial human antibody VH chain
CEVQLVESGGGLVKPGGSLRLSCAASGFTFSNYNMNWVRQAPGKGLEWVSSISSSSSYIYYADSVKGRFTISRDNAKNSLYLQMNSLRAEDTAVYYCARDALDFDWLLSAGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 173 - protein, 217 aa, Artificial Sequence
  Synthetic polypeptide representing artificial human antibody VH chain
PLQLQESGPGLVKPSETLSLTCTVSGGSISSSSYYWGWIRQPPGKGLEWIGSIYYSGSTYYNPSLKSRVTISVDTSKNQFSLKLSSVTAADTAVYSCARLLVGGAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKSE

SEQ ID NO: 174 - protein, 226 aa, Artificial Sequence
  Synthetic polypeptide representing artificial human antibody VH chain
CEVQLVESGGGLVKPGGSLRLSCAASGFTFSNAWMNWVRQAPGKGLEWVGRIKSKTDGGTTDYAAPVKGRFTISRDDSKNTLYLQMNSLKTEDTAVYYCTPGSCSGGSCYSGDAFDIWGQGTMVTVSSASTKGPSVFPLAPSSKSTSGGTAALGCLVKDYFPEPVTVSWNSGALTSGVHTFPAVLQSSGLYSLSSMVTVPSSSLGTQTYICNVNHKPSNTKVDKSE

SEQ ID NO: 175 - protein, 220 aa, Artificial Sequence
  Synthetic polypeptide representing artificial human antibody VH chain
QVHLVQSGAEVKKPGASVKVSCKASGYTFTNYFIHWVRQAPGQGPEWMGVINPSFGSTTYAQKLQGRVTMTRETSTSTVYMELSSLRSEDTAVYYCARESLDSASYSTIAHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKSE

SEQ ID NO: 176 - protein, 220 aa, Artificial Sequence
  Synthetic polypeptide representing artificial human antibody VH chain
QVQLVQSGAEVKKPGSSVKVSCKAPGGTFNNYGISWVRQAPGQGLEWMGGIMPMFGRTSETQKFQGRVTISADESTSTVYMEMSSLRFDDTAVYYCARDRGGNSWLDVFDMWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTV

SEQ ID NO: 177 - protein, 224 aa, Artificial Sequence
  Synthetic polypeptide representing artificial human antibody VH chain
EVQLLESGGGLVHPGGSLRLSCVASGFTFSSYEMTWVRQAPGKGLEWISYISSTGTTTYHADSVRGRFTISRDNAKSSLFLQMNSLRVEDTALYYCARSPAAFGSESYFDSWGQGVLVTVSSASPTSPKVFPLSLCSTQPDGNVVIACLVQGFFPQEPLSVTWSESGQGVTARNFPPSQDASGDLYTTSSQLTLPATQCLAGKSVTCHVKHYTNPSQDVTVPCP

SEQ ID NO: 178 - protein, 222 aa, Artificial Sequence
  Synthetic polypeptide representing artificial human antibody VH chain
QVQLVESGGGVVQPGRSLRLSCAASGFTFTTYAVHWVRQAPGKGLEWVAVISNDGSNKNYADSVRGRFIISRDNSKNTLYLQMNSLRAEDTAVYYCAKDLLEDPYFGDLLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKNV

SEQ ID NO: 179 - protein, 223 aa, Artificial Sequence
  Synthetic polypeptide representing artificial human antibody VH chain
EVQLVQSGAEVKKSGESLKISCKGSGYTFTSYWIAWVRQMPGKGLEWMGIIYPGDSDTRYSPSFQGQVTISADKSISTAYLQWSSLKASDTAMYYCVRTPAVGTDPDYWGQGTLVTVSSGSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLP

SEQ ID NO: 180 - protein, 217 aa, Artificial Sequence
  Synthetic polypeptide representing artificial human antibody VH chain
EVQLMESGGGLVQPGGSLRLSCAASGLTFSIYSMNWVRQAPGKGLEWVSYISRGSSVIYHADSVKGRFTISRDDGKNLLYLQMNSLRDDDTAMYYCSSGGSTSMVGRYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRV

SEQ ID NO: 181 - protein, 220 aa, Artificial Sequence
  Synthetic polypeptide representing artificial human antibody VH chain
QVTLKESGPVLVKPTETLTLTCTVSGFSLSNARMGVSWIRQPPGKALEWLGHIFSNDEKSYSTSLKSRLTISKDTSKSQVVLTLTNMDPVDTATYYCARMTPFKFGLCPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 182 - protein, 219 aa, Artificial Sequence
  Synthetic polypeptide representing artificial human antibody VH chain
QVQLVQSGAEVKKPGASVKVSCKASGYTFTVYYMHWVRQAPGQGLEWMGRINPNSGGTNYAQKFQGRVTMTRDTSISTAYMELSRLTSDDTAVYYCARVVVVGTDYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKSE

SEQ ID NO: 183 - protein, 219 aa, Artificial Sequence
  Synthetic polypeptide representing artificial human antibody VH chain
QVQLVQSGAEVKKPGASVKVSCKASGYTFTSYGISWVRQAPGQGLEWMGWISAYNGNTNYAQKLQGRVTMTTDTSTSTAYMELRSLTSDDTAVYYCARDQGLERANWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 184 - protein, 217 aa, Artificial Sequence
  Synthetic polypeptide representing artificial human antibody VH chain
QVHLQESGPGLVKPSRTLSLTCAISGDSVSSTSAAWNWIRQSPSGGLEWLGRTFYRTKWYSESTGSLKSRIIVNPDTSKNQFSLQLNSVTPEDTAVYYCARGVRHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 185 - protein, 217 aa, Artificial Sequence
  Synthetic polypeptide representing artificial human antibody VH chain
QVQLQESGPGLVKPSGTLSLTCAVSGGSISSSNCWSWVRQPPGKGLEWLGEICHSGSTSYNPSLKSRVTISVDKSKNQFSLKLRSVTAADTAVYYCARESPLTVVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 186 - protein, 215 aa, Artificial Sequence
  Synthetic polypeptide representing artificial human antibody VH chain
EVQLVESGGGLVQPGGSLRLSCAASGFTVSSNYMSWVRQAPGKGLEWVSVIYSGGSTYYADSVKGRFTISRDNSKNTLSLQMNSLRAEDTAVYYCARESSAAGYDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKSV

SEQ ID NO: 187 - protein, 221 aa, Artificial Sequence
  Synthetic polypeptide representing artificial human antibody VH chain
QVQLVQSGAEVRKPGASVKVSCKASGYTFTTYYIHWVRQAPGQGLEWMGLINPNGGTTNYAQKFQGRLSMTTDTSTNTVYMELSSLRSEDTAVYYCARKLMSGIVSRGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKSV

SEQ ID NO: 188 - protein, 220 aa, Artificial Sequence
  Synthetic polypeptide representing artificial human antibody VH chain
PVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCARDRGDYVTHWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKSE

SEQ ID NO: 189 - protein, 219 aa, Artificial Sequence
  Synthetic polypeptide representing artificial human antibody VH chain
QLQLQESGPGLVKPWETLSLSCTVSGGSISSSFFYWGWIRQPPGKGLQWIGNIHYTGSTYYNPSLKSRITMSVDTSKNQFSLKLSSVTAADTAVYYCARHRVGDSPGLHYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKSE

SEQ ID NO: 190 - protein, 217 aa, Artificial Sequence
  Synthetic polypeptide representing artificial human antibody VH chain
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCASPIAVAAPFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKSE

SEQ ID NO: 191 - protein, 229 aa, Artificial Sequence
  Synthetic polypeptide representing artificial human antibody VH chain
CEVQLLESGGGLVQPGGSLRLSCAASGFTFSTYVMSWVRQAPGKGLEWVSLISGSGGSTHYADSVRGRFTISRDNSKNTLYLQMNSLRAEDTAVYYCVKDYLAVGGTYYDYFDYWGQGTLVTVSSGSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLP

SEQ ID NO: 192 - protein, 217 aa, Artificial Sequence
  Synthetic polypeptide representing artificial human antibody VH chain
PLQLQESGPGLVKPSETLSLTCTVSGGSISSSSYYWGWIRQSPGKGLEWMGSIYYSGSTYYNPSLKSRVTISVDTSKNQFSLNLSSVTAADTAVYYCARHDYRNYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKSE

SEQ ID NO: 193 - protein, 220 aa, Artificial Sequence
  Synthetic polypeptide representing artificial human antibody VH chain
QVQLVQSGAEVKKPGASVKVSCQASGYTFTGYYIHWVRQAPGQGLEWMGWINPNSGGTNYAQKFQGRVTMTRDTSISTAHMELGRLRSDDTAVYYCATPPSRYGGNYYADYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 194 - protein, 216 aa, Artificial Sequence
  Synthetic polypeptide representing artificial human antibody VH chain
PVQLVQSGAEVKKPGDSLSISCEVSGYSFTSYWIGWVRQMPGKGLEWMAIINPADSDTRYSPSFRGQVTISVDKSINTAYLQWTSLQASDTAMYYCARQGPTVAIDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKSE

SEQ ID NO: 195 - protein, 116 aa, Artificial Sequence
  Synthetic polypeptide representing artificial human antibody VH chain
EVQLVQSGAEVKKPGESLKISCKGSGYSFTTYWIAWVRQMPGKGLEWMGIIYPADSDTRYSPSFQGQVTMSADQSINTAYLQWSSLKASDTAMYYCARRGREFDYWGQGTLLTVSS

SEQ ID NO: 196 - protein, 223 aa, Artificial Sequence
  Synthetic polypeptide representing artificial human antibody VH chain
CEVQLLESGGGLVQPGGSLRLSCAASGFTFRIYAMSWVRQAPGKGLEWVSAISYSGNTTYYADSVKGRFTISRDNSKNTLYLQINNLRAEDTAIYYCAIQEKRELQLRRELDNYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 197 - protein, 117 aa, Artificial Sequence
  Synthetic polypeptide representing artificial human antibody VH chain
QVQLVQSGAEVKKPGASVKVSCKASGYTFTSYYMYWVRQAPGQGLEWMGIINPGGGSTSYAQKFQGRVTMTRDTSTSTVYMELSSLRSEDTAVYYCARVFRYGMDVWGQGTTVTVSS

SEQ ID NO: 198 - protein, 117 aa, Artificial Sequence
  Synthetic polypeptide representing artificial human antibody VH chain
QVQVVESGGGLVKPGGSLRLSCAVSGLDFRDYYVNWIRQAPGKGLEWLSYITSPGGHTSYSDSVKGRFTISRDNAKNSVYLQMDSLTVEDTAVYFCAIKEGYGLSDWGQGTLVTVSS

SEQ ID NO: 199 - protein, 223 aa, Artificial Sequence
  Synthetic polypeptide representing artificial human antibody VH chain
VVQLLESGGGLVQPGGSLRLSCAASGFTFISYAMSWVRQAPGKGLEWVSDISGSGGSTYYADSVKGRLTISRDNSNNTLYLQMNSLRAEDTAVYYCAKEDGYTQNFDYWGQGTLVTVSSGSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLP

SEQ ID NO: 200 - protein, 121 aa, Artificial Sequence
  Synthetic polypeptide representing artificial human antibody VH chain
QVQLVQSGAEVKKPGASVKISCKASGYTFTSHAIHWVRQAPGQTFEWLGWINPVNGVTKYSQTFQDRVTIVRDKSATTTYMDLSGLTFEDTAMYYCARVLDFYGSSVLDYWGQGTLVTVSS

SEQ ID NO: 201 - protein, 115 aa, Artificial Sequence
  Synthetic polypeptide representing artificial human antibody VH chain
HVQLVQSGSELKKPGASVKLSCKASGYTFTNYAMNWVRQAPGQGLEWMGWINTNTGNPTYAQGFTGRFVFSLDTSVSTAYLQISSLKAEDTALYYCARDRPGDYWGQGTLVTVSS

SEQ ID NO: 202 - protein, 216 aa, Artificial Sequence
  Synthetic polypeptide representing artificial human antibody VH chain
QVQLVESGGGVVQPGRSLRLSCAASGFTFSNFAMHWVRQAPGKGLEWVVVISSDGSNKNYADSVKGRFTISRDNSKNTLYLQMNSLRAEDTAVYYCARDLGVGSTTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRV

SEQ ID NO: 203 - protein, 219 aa, Artificial Sequence
  Synthetic polypeptide representing artificial human antibody VH chain
GEQLLESGGGLVQPGGSLRLSCAASGFTFSHYAMTWVRQAPGKGLEWVSGVSGSGFTTYYADSVKGRFTISRDNAQNTLYLHMNSLRAEDTAIYYCVKDLEVSIGHNFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRV

SEQ ID NO: 204 - protein, 225 aa, Artificial Sequence
  Synthetic polypeptide representing artificial human antibody VH chain
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDRGVVVVAATPYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 205 - protein, 223 aa, Artificial Sequence
  Synthetic polypeptide representing artificial human antibody VH chain
QITLKESGPTLVKPTQTLTLTCTFSGFSLSTNGVGVGWIRQPPGKALEWLALINWDDDKRYSPSLKSRLTITKDTSKNQVVLTMTNLDPVDTATYYCVHARDDYGDSAWSTGPVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRV

SEQ ID NO: 206 - protein, 223 aa, Artificial Sequence
  Synthetic polypeptide representing artificial human antibody VH chain
LITLKESGPTLVKPTQTLTLTCTVSGLSLSTSGVAVGWIRQPPGKALEWLALIYWDDDTRYSPSLKSRLSITKDTSKNQVVLTMRNVDPVDTATYYCGHRRLLRGVTTTVYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRV

SEQ ID NO: 207 - protein, 223 aa, Artificial Sequence
  Synthetic polypeptide representing artificial human antibody VH chain
PVQLQESGPGLVNPSQTLSLTCTVSGGSISSGGYCWSWVRQHPGKGLEWIGCIYYIGTTYYMRSLKSRLIISIDTSKNQFSLKLTSVTAADSAVYYCARGGELLGGFGYSGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRV

SEQ ID NO: 208 - protein, 224 aa, Artificial Sequence
  Synthetic polypeptide representing artificial human antibody VH chain
ELQLVESGGGLVQPGGSLRLSCAASGFTFSSYWMSWVRQAPGKGLEWVANINQDGGEKYYVDSVKGRFTISRDNAKNSLYLQMNSLRAEDTAVYYCAHYYYDSSGYYQNAEYFQYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 209 - protein, 226 aa, Artificial Sequence
  Synthetic polypeptide representing artificial human antibody VH chain
QVQLVQSGAEVKKPGSSVKVSCKASRGTFSNHAVSWVRQAPGQGLEWVGGIIPVFGPPNYAQKFRGRVTITADRSTNTAYMELNSLRSEDTAVYYCARTQWGTDVEATNPYYYFMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRV

SEQ ID NO: 210 - protein, 217 aa, Artificial Sequence
  Synthetic polypeptide representing artificial human antibody VH chain
QVQLVQSGTEMKRPGSSVKVSCKASGGTFNFYAINWVRQAPGQGLEWMGGIVPIFDTTTYAQRFQGRVTITADESTTTVHMELSSLRFDDTAVYYCARDQSGADRFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKSE

SEQ ID NO: 211 - protein, 218 aa, Artificial Sequence
  Synthetic polypeptide representing artificial human antibody VH chain
QVQLVQSGAEVKKPGASVKISCQAFGYNFIDNAIHWVRQAPGQRPEWMGWINAGNGNTRYSQNFQGRVTITKVTSASTAYMEMSRLKSEDTAVYFCARSSKWTDWHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKSE

SEQ ID NO: 212 - protein, 219 aa, Artificial Sequence
  Synthetic polypeptide representing artificial human antibody VH chain
QIQLVQSGAEVKKPGASVKVSCKTSGYTFTHYGVAWVRQAPGQGPEWMGWISPYNGNIEYGQKFQGRVTMTTDTSTNTAYMELRSLRYDDTAVYYCARDLDEINSSWLDPWGQGTLIIVSPASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKSE

SEQ ID NO: 213 - protein, 226 aa, Artificial Sequence
  Synthetic polypeptide representing artificial human antibody VH chain
VVQLLESGGGVVQPGGSLRLSCAASGFTFSNYAMNWVRQAPGKGLEWVTGISGPGESSYYADSVKGRFTVSRDNYRNTLYLQMNDLGAEDTATYFCAKRPTAGNSYGGYYFDHWGQGTLVTVSSASPTSPKVFPLSLCSTQPDGNVVIACLVQGFFPQEPLSVTWSESGQGVTARNFPPSQDASGDLYTTSSQLTLPATQCLAGKSVTCHVKHYTNPSQDVTVPCP

SEQ ID NO: 214 - protein, 224 aa, Artificial Sequence
  Synthetic polypeptide representing artificial human antibody VH chain
QVQLVQSGAEVKKPGASVKLSCKPSGYTFSSYYIHWLRQAPGQGLEWMGIINPSGGYTSSAQKFQGRVTMTRDTSTSTIYMELSSLRAEDTAVYYCARRGEVGTMVRVFRKPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 215 - protein, 223 aa, Artificial Sequence
  Synthetic polypeptide representing artificial human antibody VH chain
PVQLVQSGAEVKKPGESLKISCQGSGYNFSRYWIGWVRQMPGKGLEWMGVVFPGDSDIRYSLSFQGHITIYADNSISTAYLQWSSLKASDTAIYYCATTSTMPMPTRGRDWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRV

SEQ ID NO: 216 - protein, 216 aa, Artificial Sequence
  Synthetic polypeptide representing artificial human antibody VH chain
QVQLVESGGGVVQPGTSLTLSCEASGFTFNRYGMHWVRQAPGKGLEWVAVIWYDGTNKYYADSVRGRFTISRDNSKNTLYLQMNTLRGDDTAVYFCAGAHGDYGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRE

SEQ ID NO: 217 - protein, 220 aa, Artificial Sequence
  Synthetic polypeptide representing artificial human antibody VH chain
EVQLVQSGAEVKKPGESLRISCKGSGYSFTSFWISWVRQMPGKGLEWMGRIDPSDSYTNYSPSFQGHVTISADKSISTAFLQWSSLKASDTAMYYCARHQQKYSPISPLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRV

SEQ ID NO: 218 - protein, 120 aa, Artificial Sequence
  Synthetic polypeptide representing artificial human antibody VH chain
EVQLVESGGGVIKPGGSLKLSCEGSGFTLDDYVMHWVRQAPGKGLEWISSISGDGTRTYYADSVKGRFTISRNNGKNSLYLQMDSLRREDTALYYCAKDARLAYYGMDVWGQGTTVTVSS

SEQ ID NO: 219 - protein, 121 aa, Artificial Sequence
  Synthetic polypeptide representing artificial human antibody VH chain
QLQLQESGPGLVKPSETLSLTCTVSGDSISSSGFFWAWIRQAPGKGLDWIGSTYHRTTTTYYNPSLKSRVTISVDTSKNQFSLTLNSLTAADTAVYYCARHSSGYSELAYWGQGTLVIVST

SEQ ID NO: 220 - protein, 223 aa, Artificial Sequence
  Synthetic polypeptide representing artificial human antibody VH chain
QEQLVQSGAEVKKPGSSVKVSCKVSGGPFKTYPINWVRQAPGQGLEWMGGITPNSGTPNYAQKFQGRVTITADESTTTVYMQLSSLRSEDTAVYYCARVHNWDFYYGMDVWGLGTTVTVSSASPTSPKVFPLSLCSTQPDGNVVIACLVQGFFPQEPLSVTWSESGQGVTARNFPPSQDASGDLYTTSSQLTLPATQCLAGKSVTCHVKHYTNPSQDVTVPCP

SEQ ID NO: 221 - protein, 226 aa, Artificial Sequence
  Synthetic polypeptide representing artificial human antibody VH chain
EVQVVESGGGLVQPGRSLRLSCTPSGFTFGDNAMGWFRQAPGKGLEWVGFIRSKAYGGTRDYAASVKGRFTISRDDSKSIAYLQMNSLKTEDTAVYYCTRERPPNCGSSCPETWGQGTLVTVSSASPTSPKVFPLSLCSTQPDGNVVIACLVQGFFPQEPLSVTWSESGQGVTARNFPPSQDASGDLYTTSSQLTLPATQCLAGKSVTCHVKHYTNPSQDVTVPCP

SEQ ID NO: 222 - protein, 119 aa, Artificial Sequence
  Synthetic polypeptide representing artificial human antibody VH chain
QVQLVQSGSEVKKPGASVRLACKTSGYTFSNYGVSWVRQGPGRGLEWLGWISGYNGRTHSADKFRDRVTLTTDTSTTTVYVDLKNLTSDDTAVYYCARVGTSHWYSDSWGQGTLVTVSS

SEQ ID NO: 223 - protein, 117 aa, Artificial Sequence
  Synthetic polypeptide representing artificial human antibody VH chain
EVQLVESGGGMVQPGESLRLSCAASGFDFTSYWMAWVRQAPGKGLEWVANMNADGSEKHYVDSVKGRFSISRDNAKKLLFLQMNSLTVDDTGVYYCARDEGRREGAWGQGTQVIVSA

SEQ ID NO: 224 - protein, 219 aa, Artificial Sequence
  Synthetic polypeptide representing artificial human antibody VH chain
CEVQLVESGGGLVQPGGSLRLSCAASGFTFSSYSMNWVRQAPGKGLEWVSYISSSSSTIYYADSVKGRFTISRDNAKNSLYLQMNSLRAEDTAVYYCARDIALGRGGMDVWGQGTTVTVSSGSASGPSVFPLAPSSKSTSGGTAALGCLVKDYFPEPVTVSWNSGALTSGVHTFPAVLQSSGLYSLSSVVTVPSSSLGTQTYICNVNHKPSNTKVDKNV

SEQ ID NO: 225 - protein, 120 aa, Artificial Sequence
  Synthetic polypeptide representing artificial human antibody VH chain
QLQLQESGPGLVKPSETLSLTCTVSGVSIGTSSYYWGWIRQPPAKGLEWIGSIYYSGSTYYNPSLKNRVTISVDTSKNHFSLKLSSVTAADTAVYYCARHRTGQYYYNSWGQGTLVTVSS

SEQ ID NO: 226 - protein, 117 aa, Artificial Sequence
  Synthetic polypeptide representing artificial human antibody VH chain
QVQLQESGPGLVKPSETLSLTCSVSGDSFSDYYWSWTRQSPGKGLEWLGYMFYGGSTNYNPSLKSRLTMSVDTSKKHVYLKLSSVTAADTAVYYCAASGYGDHVAYWGQGTLVTVSS

SEQ ID NO: 227 - protein, 221 aa, Artificial Sequence
  Synthetic polypeptide representing artificial human antibody VH chain
QVQLVESGGGVVQPGRSLRLSCVASGFTFSNYAMHWVRQAPGKGLEWVAVIWYDGSNEYYRDSVEGRFTISRDSSKNTLYLLVNSLRAEDTAVYYCARGNGPKSGKYSDFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKSE

SEQ ID NO: 228 - protein, 117 aa, Artificial Sequence
  Synthetic polypeptide representing artificial human antibody VH chain
QVQLVQSGTEVKKPGASVKVSCKASGYRFTSNGISWVRQAPGQGLQWMGWISTDSGNTNYAQSFQGRVTLTRDTSTNTAYLELRRLRSEDTAVYYCARDKSWYFDYWGQGTLVSVSS

SEQ ID NO: 229 - protein, 221 aa, Artificial Sequence
  Synthetic polypeptide representing artificial human antibody VH chain
CEVQLVESGGGVVRPGGSLRLSCAASGFTFDDYGMSWVRQAPGKGLEWVSGIHWNGGSTGYADSVKGRFTISRDNAKNSLYLQMNSLRAEDTALYHCARSTASSGYYDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKSE

SEQ ID NO: 230 - protein, 227 aa, Artificial Sequence
  Synthetic polypeptide representing artificial human antibody VH chain
QVQLVESGGGVVQPGRSLRLSCAASGFSFSAYGMHWVRQAPGKGLEWVAIMWYDGNNKYYADSVKGRFTISRDNSKNTLYLQMNSLRAEDTAVYYCARDRREYSSSSRPSYHYYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKSE

SEQ ID NO: 231 - protein, 218 aa, Artificial Sequence
  Synthetic polypeptide representing artificial human antibody VH chain
VVQLLESGGGLVHPGGSLRISCAASEFTFSAYAMTWVRQAPGKGLEWVSAISGSGGRTYYADSLKGRFTISRDNSKHTLYLLMNSLRVEDTAVYYCASRYRSPSGAFDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRV

SEQ ID NO: 232 - protein, 215 aa, Artificial Sequence
  Synthetic polypeptide representing artificial human antibody VH chain
EVQLVESGGGLVKPGGSLRLSCAASGFTFSNAWMNWVRQTPGKGLEWVGRIKTKTDGGTTDYAEPVKGRFTISRDDSKNTLYLQMNSLKTEDTAVYYCTRGAVADYWGQGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRV

SEQ ID NO: 233 - protein, 219 aa, Artificial Sequence
  Synthetic polypeptide representing artificial human antibody VH chain
QVQLKQSGGGVVQPGRSLTLSCVASGLTFSDYGMHWVRQAPGKGLEWVAVIWHDGSKTNYADSVKGRIIISRDNSKSTVYLQMNRLRGEDTAVYYCATSHGGLVPGGENYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRV

SEQ ID NO: 234 - protein, 123 aa, Artificial Sequence
  Synthetic polypeptide representing artificial human antibody VH chain
QVQLVQSGSELKKPGASVKVSCTSSGYVFTSFGVSWVRQVPGQGPEWMGWISPYTRQTKYAQSLQGRITLTADTSTNTTYMELRSLRSDDTAMYYCVREEFGVVRGPNPFDVWGQGTMVTVSS

SEQ ID NO: 235 - protein, 224 aa, Artificial Sequence
  Synthetic polypeptide representing artificial human antibody VH chain
EVQLVESGGGVVQPGGSLRLSCAASGFTFEDFGMHWVRQAPGKGLEWVAFTRFDGSEKYYVDSVKGRFTVSRDNSKNTLFLHMNSLRPEDTAVYYCAKTRSYSSADTTRPNAPGYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRV

SEQ ID NO: 236 - protein, 220 aa, Artificial Sequence
  Synthetic polypeptide representing artificial human antibody VH chain
QVQLVESGGGVVQPGRSLRLSCAASGFTLSTYGMHWVRQAPGKGLEWVAVISHDGSNNYYADYVKGRFTISRDNSKNTLYLQMNSLRIEDTAVYYCAKDGQTGTTTPYFDYWGQGTLVTVSSASTKGPSVFPLAPCSRSTSESTAALGCLVKDYFPEPVTVSWNSGALTSGVHTFPAVLQSSGLYSLSSVVTVTSSNFGTQTYTCNVDHKPSNTKVDKTV

SEQ ID NO: 237 - protein, 219 aa, Artificial Sequence
  Synthetic polypeptide representing artificial human antibody VH chain
PVQLVQSGAQVKKPGASVRLSCKSSGYTFSNYAIHWLRQAPGQRLEWVGWIHVGNDHTRYSQSFQGRVTISADTSANTAYMEVRGLRSEDTSLFYCARAGAEGVDYWGQGTQVTVSSASPTSPKVFPLSLCSTQPDGNVVIACLVQGFFPQEPLSVTWSESGQGVTARNFPPSQDASGDLYTTSSQLTLPATQCLAGKSVTCHVKHYTNPSQDVTVPCP

SEQ ID NO: 238 - protein, 219 aa, Artificial Sequence
  Synthetic polypeptide representing artificial human antibody VH chain
AVQLVQSGAEVKKPGESLRISCKGSGYSFSTYWIIWVRQMPGKGLEWIGRFDPSDSYNVNSPSFQGHVTISADTSINTAYLQWSSLKASDSAMYYCARRSDKAVPGTFDQWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTV

SEQ ID NO: 239 - protein, 221 aa, Artificial Sequence
  Synthetic polypeptide representing artificial human antibody VH chain
QITLKESGPTLLKPTQTLTLTCNFSGFSLTTYGVGVAWIRQPPGKALEWLALIYWDDDKRYSPSLKSRLTVTKDTSKNQVVLTMTNMDPVDTATYYCAHRGGKNPRYWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 240 - protein, 218 aa, Artificial Sequence
  Synthetic polypeptide representing artificial human antibody VH chain
EVQLVESGGGLVKPRGSLRLSCAASGFTFSAYGMNWVRQAPGKGLEWVSSISGDSRDIYYGASMKGRFTISRDNAKSSLYLQMNSLRAEDTAVYYCARGEGGELWAFDYWGLGVLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKA

SEQ ID NO: 241 - protein, 219 aa, Artificial Sequence
  Synthetic polypeptide representing artificial human antibody VH chain
PVQLVQSGAEVKKPGSSVQVSCKGSGGTFSEYGISWLRQAPGQGLEWIGGIIPVLGIPNYAQKFRGRVTITADESTGSAYMEVSSLRSEDTAVYYCAREGLRLARGWFHPWGQGTLVTVTSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKSE

SEQ ID NO: 242 - protein, 120 aa, Artificial Sequence
  Synthetic polypeptide representing artificial human antibody VH chain
QVQLQESGPGLVKPSETLSLICTVSGASVNSGTHFWSWIRQPPGKGLEWIGYVYYSGNTNYNPSLKSRVAISVDTSKNQFSLKLTSVTSADTAVYYCARDFDDGYDIRYWGQGTRVSVSS

SEQ ID NO: 243 - protein, 218 aa, Artificial Sequence
  Synthetic polypeptide representing artificial human antibody VH chain
VVQLVESGGGLVQPGGSLRLSCSASGFTFSSYAMHWVRQAPGKGLEYVSAISSNGGSTYYADSVKGRFTISRDNSKNTLYLQMSSLRAEDTAVYYCVKSPVAANDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKSV

SEQ ID NO: 244 - protein, 219 aa, Artificial Sequence
  Synthetic polypeptide representing artificial human antibody VH chain
CEVQLVESGGGLVQPGGSLRLSCVASGFTFSSYSMNWVRQAPGKGLKWVSYISSSRSTIYNADSVKGRFTISRDNAKKSLYLQMNSLRAEDTAVYYCARVSVAAPTCLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 245 - protein, 221 aa, Artificial Sequence
  Synthetic polypeptide representing artificial human antibody VH chain
QLQLQESGPGLVKPSETLSLTCTVAGDSISRSNYYWAWIRQPPGKGLEWIGSIIHTGTTYHNPSLRSRGTILVDTSKNQFSLKLSSVTAADTGLYYCARHSGHDQLPLDFDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKSE

SEQ ID NO: 246 - protein, 116 aa, Artificial Sequence
  Synthetic polypeptide representing artificial human antibody VH chain
EVQLVESGGGLVQPGGSLRLSCAASGFTFSKFWMHWVRQAPGKGLVWLSRINTDGTVTTYADSVKGRFTISRDNAKSTLYLQMNSLRVEDTAVYYCAGGGSQVDFWGQGTLVTVSS

SEQ ID NO: 247 - protein, 223 aa, Artificial Sequence
  Synthetic polypeptide representing artificial human antibody VH chain
QITLKESGPTLVKPTQTLTLTCTFSGFSLTTTGVGVGWIRQPPGKALEWLALIYWDDDKRYSPSLKSRLIITKDTSKNQVVLTMTNMDPVDTATYYCAHRFGRGVSYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 248 - protein, 217 aa, Artificial Sequence
  Synthetic polypeptide representing artificial human antibody VH chain
QVQLVESGGGVVQPGRSLRLSCAASGFIFSSYGMHWVRQAPGKGLEWVAVISYDGSNKYYADSVKGRFTISRDKSKNTLHLQMNSLRAEDTAVYYCAKDSGSNDDMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKSE

SEQ ID NO: 249 - protein, 219 aa, Artificial Sequence
  Synthetic polypeptide representing artificial human antibody VH chain
CEVQLVESGGGLVQPGGSLRLSCAASGFTFSSYEMNWVRQAPGKGLEWVSYISSSGSTIYYADSVKGRFTISRDNAKNSLYLQMNSLRAEDTAVYYCARRGFYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKSE

SEQ ID NO: 250 - protein, 216 aa, Artificial Sequence
  Synthetic polypeptide representing artificial human antibody VH chain
CEVQLVESGGGLVQPGGSLRLSCAASGFTFSSYSMNWVRQAPGKGLEWVSYISSSSSTIYYADSVKGRFTISRDNAKNSLYLQMNSLRAEDTAVYYCASLLGGDPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 251 - protein, 226 aa, Artificial Sequence
  Synthetic polypeptide representing artificial human antibody VH chain
PVTLRESGPALVKPTQTLTLTCTFSGFSLSTSGMCVSWIRQPPGKALEWLARIDWDDDKYYSTSLKTRLTISKDTSKNQVVLTMTNMDPVDTATYYCARMQIVATTQTYYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKSE

SEQ ID NO: 252 - protein, 218 aa, Artificial Sequence
  Synthetic polypeptide representing artificial human antibody VH chain
EVQLVESGGGLVQPGGSLRLSCAASGFTFSSYWMTWVRQAPGKGLEWVANIKQDGSEKYYVDSVKGRFTISRDNSKNSLYLQMNSLRAEDTAVYYCARAGYDLFGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKL

SEQ ID NO: 253 - protein, 125 aa, Artificial Sequence
  Synthetic polypeptide representing artificial human antibody VH chain
EVQLLESGGGLVQPGGSLRLSCVASGFTFASYGMAWVRQAPGQGLTWICFVGSGDTTHYAESVKGRFTCSRDNSNNTLYLHMSGLRGADTAKYYCAKPNSPFTGSGSFHNYFDYWGQGALVIVSS

SEQ ID NO: 254 - protein, 113 aa, Artificial Sequence
  Synthetic polypeptide representing artificial human antibody VH chain
EVQVVESGGGLGQPGGSLRLSCAASGFTFSSYSMNWVRQAPGKGLEWVSYISSSSSTKYYADSVKGRFTISRDNAKKSLYLQMNSLRDEDTAVYYCASPVRPWGQGTLVTVSS

SEQ ID NO: 255 - protein, 226 aa, Artificial Sequence
  Synthetic polypeptide representing artificial human antibody VH chain
QVQLVQSGAEMKKPGTSVKVSCRTSGYIFTGSFMHWVRQAPAQGLEWMGWINPKTGATYYTEKFKGRVTLTRDTSINTAYMEMTSLRSDDTAVYYCARGFCDLPACYPVPQYNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRV

SEQ ID NO: 256 - protein, 219 aa, Artificial Sequence
  Synthetic polypeptide representing artificial human antibody VH chain
PVQLQESGPGLVKPSQTLSLTCTVSGGSISSGTYYWSWIRQPAGKGLEWIGRIYASGSTNYNPSLKSRVTISVDTSKNQFSLKLTSVTAADTAVYYCARYSGSYPLGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 257 - protein, 216 aa, Artificial Sequence
  Synthetic polypeptide representing artificial human antibody VH chain
GAEVQLVQSGAEVKKPGQSLKISCKGSGYSFTNYWIGWVRQMPGKGLEWMGIIYPGDSDTRYSPSFQGQVTISADKSISTAYLQWSSLKASDTAMYYCARHEGAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 258 - protein, 121 aa, Artificial Sequence
  Synthetic polypeptide representing artificial human antibody VH chain
VVQLVESGGGLVKPGGSLRLSCAASGFTFSNAWMSWVRQAPGKGLEWVGRIKSKTDGGTTDYTAPVKGRFTISRDDSKNTLYLQMNSLKTEDTAVYYCTTDLAVTTRFDYWGQGTLVTVSS

SEQ ID NO: 259 - protein, 216 aa, Artificial Sequence
  Synthetic polypeptide representing artificial human antibody VH chain
QVQLVESGGGVVQPGRSLRLSCAASGFPFSTYALHWVRQAPGKGLEWVAVISKDGNSKSSAESVKGRFTISRDKSRNTLYLQMNSLRPEDTAVYYCARSTRTDALDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRV

SEQ ID NO: 260 - protein, 220 aa, Artificial Sequence
  Synthetic polypeptide representing artificial human antibody VH chain
EVQLVESGGGLVQPGGSLKLSCAASGFSFSGSSVHWVRQASGKGLEWVGRIRSKTKNYATAYAASVKGRFTISRDDSKNTAFLQMRSLKAEDTAVYYCAKNDEMDFKGYDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 261 - protein, 213 aa, Artificial Sequence
  Synthetic polypeptide representing artificial human antibody VH chain
QVQLQESGPGLVKPSETLSLTCTVSGGSISSYYWSWIRQPAGKGLEWIGRIYTSGSTNYNPSLKSRVTMSVDTSKNQFSLKMSSVTAADTAVYYCARGELLFDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKNV

SEQ ID NO: 262 - protein, 217 aa, Artificial Sequence
  Synthetic polypeptide representing artificial human antibody VH chain
EVQLVESGGGLVQPGRSLRLSCVASGFTFGDYAVNWFRQAPGKGLEWVGFISTKGYDETAEYAASVKGRFTMSRDDSKNIAYLLMDSLKAEDTAMYYCARESTVVLDFWGQGTLVAVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 263 - protein, 217 aa, Artificial Sequence
  Synthetic polypeptide representing artificial human antibody VH chain
QVQLVDSGGGVVQPGGSLRLSCAASGFTLSNYGMNWVRQAPGKGLEWVAFIPYDGSNKYYADSVKGRFTISRDISKNTLYLQMNSLRTEDTAVYYCAKRSTAVGDFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 264 - protein, 225 aa, Artificial Sequence
  Synthetic polypeptide representing artificial human antibody VH chain
EVQLVESGGGLVQPGGSLRLSCAASGFSITTHSMNWVRQAPGKGLQWVAYISTSTSTIYYADSVEGRFTISRDKAKNALYLQMDSLRAQDTAVYYCARGPSNWNGGPEHMDVWGKGTTVTVSSASPTSPKVFPLSLDSTPQDGNVVVACLVQGFFPQEPLSVTWSESGQNVTARNFPPSQDASGDLYTTSSQLTLPATQCPDGKSVTCHVKHYTNPSQDVTVPCP

SEQ ID NO: 265 - protein, 211 aa, Artificial Sequence
  Synthetic polypeptide representing artificial human antibody VH chain
VVQLVESGGGLVQPGGSLRLSCAASGFTFSSYEMNWVRQAPGKGLEWVSYISSSGSTIYYADSVKGRFTISRDNAKNSLYLQMNSLRAEDTAVYYCARDFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKNV

SEQ ID NO: 266 - protein, 219 aa, Artificial Sequence
  Synthetic polypeptide representing artificial human antibody VH chain
VVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCARDPYGSGTVWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKNV

SEQ ID NO: 267 - protein, 224 aa, Artificial Sequence
  Synthetic polypeptide representing artificial human antibody VH chain
EAQLVESGGGLIQPGGSLRLSCAASGFSVSSKYMSWVRQAPGKGLEWVSVMYSGGATYYADSVKGRFVISRDSSKNTVFLQMNSLRAEDTAVYYCAKTEYTFLSGSDYYQYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRV

SEQ ID NO: 268 - protein, 221 aa, Artificial Sequence
  Synthetic polypeptide representing artificial human antibody VH chain
PVQLVQSGAEVKKPGESLKISCKGSGYSFTNYWIGWVRQMPGKGLEWMGIIYPGDSDTRYSPSFQGQVTISADKSISTAYLQWSSLKASDTAMYYCARRGLLRGSNEGRFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 269 - protein, 222 aa, Artificial Sequence
  Synthetic polypeptide representing artificial human antibody VH chain
VVQLVESGGDLVQPGGSLKLSCAASGFTFSGSAMHWVRQASGKGLEWVGRIRSKPNSYATAYAVSVKGRFTISRDDSKNTAYLQMNSLKTEDTAVYYCTRRGSAWTDPYYTDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRE

SEQ ID NO: 270 - protein, 222 aa, Artificial Sequence
  Synthetic polypeptide representing artificial human antibody VH chain
SVQLVESGGGVVQPGRSLRLSCAASGFTFSDYGMHWVRQAPGKGLEWVAVIWYDGSNEYYADSVKGRFTISRDNSKNTVYLQMNSLGAEDTAVYYCARDDVPRGYDYWGQGTLVTVSSGSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLP

SEQ ID NO: 271 - protein, 218 aa, Artificial Sequence
  Synthetic polypeptide representing artificial human antibody VH chain
SVQLVESGGGVVQPGRSLRLSCAASGYTFNNYGMHWVRQAPGKGLEWVAIIWYDGSNKYYADSVKGRFTISRDNSKNTLYLQMNSLRAEDTAVYYCAREYIVPFYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 272 - protein, 214 aa, Artificial Sequence
  Synthetic polypeptide representing artificial human antibody VL chain
DIQMTQSPSSLSASVGDRVSITCRASQGVSSYLAWYQKKPGRAPKLLIYSASSLQSGVPSRFSGSGSGTDFTLTITGLQPEDFATYFCQQTNTFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKLYACEVTHQGLSSPVTKSFNRGEC

SEQ ID NO: 273 - protein, 214 aa, Artificial Sequence
  Synthetic polypeptide representing artificial human antibody VL chain
DIQMTQSPSSLSASVGDRVTITCRASQSIGSYLNWYQQKPGKAPKLLIYAASSLQSGVPSRFSGSGSGTDFTLTISSLQPEDFATYYCQQSYSTPPRFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 274 - protein, 214 aa, Artificial Sequence
  Synthetic polypeptide representing artificial human antibody VL chain
DIQMTQSPSYVSASVGDRVTITCRASQGIDVWLAWYQQKPGKAPKLLIYTASSLQSGVPSRFSGSGGGTEFTLTISSLQPEDFATYYCQQSNSFPGTFGPGTKVDVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 275 - protein, 110 aa, Artificial Sequence
  Synthetic polypeptide representing artificial human antibody VL chain
PSVLTQPPSASGTPGQRVTISCSGSSSNIGSNYVYWYQQLPGTAPKFLIYRNNQRPSGVPDRFSGSKSGTSASLAISGLRSEDEADYYCAAWEDSLSGPVFGGGTKLTVL

SEQ ID NO: 276 - protein, 212 aa, Artificial Sequence
  Synthetic polypeptide representing artificial human antibody VL chain
SSELTQDPAVSVALGQTVRITCQGDSLRNYYASWFQQKPGQAPVLVIFGKNYRPSGIPDRFSGSNSGNTASLTITGAQAEDEADYYCNSRDRSGYVFGSGTKVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 277 - protein, 214 aa, Artificial Sequence
  Synthetic polypeptide representing artificial human antibody VL chain
LYVLTQPPSVSVAPGTTAWISCGGNNIGIKSVHWYQQKPGQAPLLVISYDSDRPSVIPERFSVSNSGNTVTLTISRVEAGDEADYYCQVWDNGHSHWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 278 - protein, 106 aa, Artificial Sequence
  Synthetic polypeptide representing artificial human antibody VL chain
DIQMTQSPSSLSASVGDRVTITCRASQSISSYLNWYQQKPGRAPRLLIYAASRLQIGVPSRFSGSGSGTDFTLTISSLQPEDFATYYCQQSYRMPCSFGQGTKLEI

SEQ ID NO: 279 - protein, 216 aa, Artificial Sequence
  Synthetic polypeptide representing artificial human antibody VL chain
EIVLTQSPGTLSLSPGERATLSCRASQSVSSSYLAWYQQKPGQAPRLLIYDASSRATGIPDRFSGSGSGTDFTLTISRLEPEDFAVYYCQQYGSSPPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKLYACEVTHQGLSSPVTKSFNRGEC

SEQ ID NO: 280 - protein, 110 aa, Artificial Sequence
  Synthetic polypeptide representing artificial human antibody VL chain
HFMLTQPHSVSESPGKTVTISCTRSSGNIASYYVQWYQQRPGSAPTTVIYEDDQRPSGVPDRFSASIDSSSNSASLTISGLKTEDEADYYCQSYDTTNVIFGGGTKLTVL

SEQ ID NO: 281 - protein, 215 aa, Artificial Sequence
  Synthetic polypeptide representing artificial human antibody VL chain
EIVLTQSPGTLSLSPGERATLSCRASQSVSSSYLAWYQQKPGQAPRLLIFGASTRASGIPDRFSGRGSGTEFTLTISRLEPEDFAVYYCQQYDSSPFTFGPGTKVEIKRTVAAPSVFIFPPSDEQLKSGTASVVCLLNNFYPREAKVQWKVDNALQSGNSQESVTEQDSKDSTYSLSSTLTLSKADYEKHKLYACEVTHQGLSSPVTKSFNRGEC

SEQ ID NO: 282 - protein, 215 aa, Artificial Sequence
  Synthetic polypeptide representing artificial human antibody VL chain
PSVLTQPPSVSAAPGQNVTISCSGSSSNIENNDVSWYQQLPGTAPKVIIYENNQRPSGIPDRFSGSKSGTSATLGITGLQTGDEADYYCGTWDDNLSAVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 283 - protein, 112 aa, Artificial Sequence
  Synthetic polypeptide representing artificial human antibody VL chain
DVVMTQSPLSLPVTLGQPASISCRSSQSLVHSDGNTYLNWFQQRPGQSPRRLIYMVSNRDSGVPDRFSGSGSGTDFTLKISRVEAEDVGVYYCLQGTHWPPTIGQGTKVEIE

SEQ ID NO: 284 - protein, 216 aa, Artificial Sequence
  Synthetic polypeptide representing artificial human antibody VL chain
PSGLTQPPSASGTPGQRVTMSCSGSSSNIGRNYVYWYQQLPGAAPKLLIYRDNQRPSGVPDRFSGSKSGTSASLAISGLRSEDEADYYCAAWDDNVSGPGFGAGTRLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 285 - protein, 216 aa, Artificial Sequence
  Synthetic polypeptide representing artificial human antibody VL chain
PAVLTQSPSASGTPGQRVTISCFGSISNIGSNPVNWYQQVPGAAPKLLIYSSSQRPSGVPDRFSGSKSGTSASLAISGLQSEDEADYYCATWDDSLNGPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 286 - protein, 213 aa, Artificial Sequence
  Synthetic polypeptide representing artificial human antibody VL chain
ETVMTQSPATLSVSPGDRATLSCRASQNVNFNLAWYQQKPGQAPRLLIYDASTRATGIPARFSGSASGTEFTLTINSLQSEDFAVYYCQQYNNWWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEW

SEQ ID NO: 287 - protein, 215 aa, Artificial Sequence
  Synthetic polypeptide representing artificial human antibody VL chain
EIVLTQSPGTLSLSPGERATLSCRASQSVSSSSLAWYQQKPGQAPRLLIYGASSRATGIPDRFSGSGSGTDFTLTISRLEPEDFAVYYCQQYGSFRYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEW

SEQ ID NO: 288 - protein, 213 aa, Artificial Sequence
  Synthetic polypeptide representing artificial human antibody VL chain
PYELTQPPSVSVSPGQTARITCSGDALPKQYAYWYQQKPGQAPVLVIYKDSERPSGIPERFSGSSSGTTVTLTISGVQAEDEADYYCQSADSSDTYVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 289 - protein, 214 aa, Artificial Sequence
  Synthetic polypeptide representing artificial human antibody VL chain
EIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEW

SEQ ID NO: 290 - protein, 215 aa, Artificial Sequence
  Synthetic polypeptide representing artificial human antibody VL chain
EIVLTQSPATLSLSPGERATLSCRASQSVGSYLAWYQQKPGQAPRLLIYDASNRATGIPARFSGSGSGTDFTLTISSLEPEDFAVYYCQQGSNWLALTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 291 - protein, 213 aa, Artificial Sequence
  Synthetic polypeptide representing artificial human antibody VL chain
IQMTQSPSSLSASVGDRVTITCRASQAIANSLAWYQQRPGKAPKLLIYAASSLESGVPSRFSGSGSGTDYTLTISSLQPEDFATYYCQQYYINPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 292 - protein, 220 aa, Artificial Sequence
  Synthetic polypeptide representing artificial human antibody VL chain
GIVMTQSPDSLAVSLGERATINCKSSQSVLYSSNNENYLAWYQQKPGQPPKLLIYWASTRESGVPDRFSGSGSGTDFTLTISSLQAEDVAVYYCQQYYSTPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEW

SEQ ID NO: 293 - protein, 106 aa, Artificial Sequence
  Synthetic polypeptide representing artificial human antibody VL chain
DIQMTQSPSSLSASVGDRVTISCRASHNINTYLNWYQHKPGKAPKIVIYGASSLQSGVPSRFSGSGSGTDFSLTISSLQREDFATYFCQQSFNTVLTFGGGTRVDI

SEQ ID NO: 294 - protein, 217 aa, Artificial Sequence
  Synthetic polypeptide representing artificial human antibody VL chain
QSALTQPASVSGSPGQSITISCTGTSSDVGGYNYVSWYQQHPGKAPKLMIYEVSNRPSGVSNRFSGSKSGNTASLTISGLQAEDEADYHCSSYTITSTLWVFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 295 - protein, 216 aa, Artificial Sequence
  Synthetic polypeptide representing artificial human antibody VL chain
QSVLTQPPSASGTPGQGVTISCSGTSANIGKNYVSWYQHLPGTAPRLLIYRIDQRPSGVPDRFSGSKSGTSASLAISGLRPEDEADYYCAAWDDSLSGPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 296 - protein, 214 aa, Artificial Sequence
  Synthetic polypeptide representing artificial human antibody VL chain
DLQMTQSPSSLSASIGDRVTITCRASQSISTYFNWYQQKPGKAPKLLIYAASSLQSGVPSRFSGSGSGTDFTLTITSLQPEDFATYYCQQTYSNPWTFGQGTKVDFKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEW

SEQ ID NO: 297 - protein, 214 aa, Artificial Sequence
  Synthetic polypeptide representing artificial human antibody VL chain
DIQMTQSPSSLSASVGDRVTITCRASQSIKNYVNWYQQKPGEAPNLLIFAASNLQSGVPSRFTGSGSGTDFSLTISSLQPEDFAAYYCQQTYSHPRTFGQGTRVEIKRTVAAPSVFIFPPSDEQLKSGTASVVCLLNNFYPREAKVQWKVDNALQSGNSQESVTEQDSKDSTYSLSSTLTLSKADYEKHKLYACEVTHQGLSSPVTKSFNRGEC

SEQ ID NO: 298 - protein, 217 aa, Artificial Sequence
  Synthetic polypeptide representing artificial human antibody VL chain
QSVLTQPPSVSGAPGQRVTISCTGSSSNIGAGYDVHWYQHLPGTAPKLLIYGDSHRPSGVPDGFSGSKSGTSASLAITGLQAEDEADYYCQSYDSSLSGYVFGTGTKVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 299 - protein, 108 aa, Artificial Sequence
  Synthetic polypeptide representing artificial human antibody VL chain
SYVLTQPPSVSVAPGQTARIACGGNNIGSKTVHWYQQKPGQAPMVVVYDDSDRPSGIPERFSGSNSGNTATLTISRVEAGDEADYYCQVWDSSSDHYVLGTGTKVTVL

SEQ ID NO: 300 - protein, 214 aa, Artificial Sequence
  Synthetic polypeptide representing artificial human antibody VL chain
DIQMTQSPSSVSASVGDRVTITCRASQDISNWLAWYLQKPGKAPKLLIYAASSLQSGVPSRFSGSGSGTDFTLTISSLQPEDFATYYCQQTSSFPRTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 301 - protein, 213 aa, Artificial Sequence
  Synthetic polypeptide representing artificial human antibody VL chain
PYELTQPPSVSVSPGQTARITCSGDALPNENAFWYQQKPGQAPVLVIYEDIKRPSGIPERFSGSSSGTTVTLTISGVQAEDEADYYCQSVDITSTWVFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 302 - protein, 217 aa, Artificial Sequence
  Synthetic polypeptide representing artificial human antibody VL chain
QSALTQPPSVSGSPGQSVTISCTGTTSDIGSYDRVSWYQKPPGTAPKLIIYEVSHRPSGVPDRFSGSKSGNTASLTISGLQAEDEADYYCSSYISSLTYVLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 303 - protein, 216 aa, Artificial Sequence
  Synthetic polypeptide representing artificial human antibody VL chain
PSVLTQPPSVSAAPGQKVTISCSGSSSNIGNNYVSWYQQLPGTAPKLLIYDNNKRPSGIRDRFSGSKSGTSATLGITGLQTGDEADYYCGTWDSSLSVGVFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 304 - protein, 219 aa, Artificial Sequence
  Synthetic polypeptide representing artificial human antibody VL chain
GVVMTQSPLSLPVTLGQPASISCRSSQSLVYSDGNTYLNWFQQRPGQSPRRLIYKVSNRDSGVPDRFSGSGSGTDFTLKISRVEAEDVGVYYCMQGTHWPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEW

SEQ ID NO: 305 - protein, 108 aa, Artificial Sequence
  Synthetic polypeptide representing artificial human antibody VL chain
EIVLTQSPGTLSLSPGERATLSCRASQSIRSSYLAWYQQKPGQAPRLLIYGASSRATGIPDRFSGSGSGTDFTLTISRLEPEDFAVYYCQQYDSSSWTFGQGTKVEIK

SEQ ID NO: 306 - protein, 217 aa, Artificial Sequence
  Synthetic polypeptide representing artificial human antibody VL chain
PSVLTQPPSVSGAPGQRVTISCSGSTSNIGAGYDVHWYQQFPGTAPKLLIYGNIFRPSGVPDRFSGSKSGTSASLAITGLQAEDEAAYYCQSYDSSLRGVVFGGGTYLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 307 - protein, 214 aa, Artificial Sequence
  Synthetic polypeptide representing artificial human antibody VL chain
DIQMTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEW

SEQ ID NO: 308 - protein, 220 aa, Artificial Sequence
  Synthetic polypeptide representing artificial human antibody VL chain
GIVMTQSPDSLAVSLGERATINCKSSQNVLYSSNNKNYLGWYQQKPGQPPKLLIYWASTRESGVPDRFSGSGSGTDFTLTINSLQAEDVAVYYCQQYYSTPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEW

SEQ ID NO: 309 - protein, 219 aa, Artificial Sequence
  Synthetic polypeptide representing artificial human antibody VL chain
PSVLTQPPSVSGAPGQKVTISCTGSSSNIGAGYDVHWYQQLPGTAPKLLIYRNNNRPSGVPDRFSGSKSGTSASLAITGLQTEDEADYYCQSYDSGLSGSKVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 310 - protein, 216 aa, Artificial Sequence
  Synthetic polypeptide representing artificial human antibody VL chain
HFMLTQPHSVSESPGKTVTISCTRSSGSIASSYVQWYQQRPGSSPTTMIYEDKKRPSGVPDRFSGSIDSSSNSASLTISGLKTEDEADYYCQSYDLSTWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 311 - protein, 214 aa, Artificial Sequence
  Synthetic polypeptide representing artificial human antibody VL chain
DIQMTQSPFSLSASVGDRVTITCRASQSISSYLNWYQQKPGKAPKLLIYAASSLQSGVPSRFSGSGSGTDFTLTISSLQPEDFATYYCHQSYSTSLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 312 - protein, 214 aa, Artificial Sequence
  Synthetic polypeptide representing artificial human antibody VL chain
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHWVFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 313 - protein, 216 aa, Artificial Sequence
  Synthetic polypeptide representing artificial human antibody VL chain
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTQVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 314 - protein, 214 aa, Artificial Sequence
  Synthetic polypeptide representing artificial human antibody VL chain
DIQMTQSPSSLSASVGDRVTITCRASQSISSYLNWYQQKPGKAPKLLIYAASSLQSGVPSRFSGSGSGTDFTLTISSLQPEDFATYYCQQSYSTPKTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEW

SEQ ID NO: 315 - protein, 108 aa, Artificial Sequence
  Synthetic polypeptide representing artificial human antibody VL chain
AIQLTQSPSSLSASVGDRVILTCRASQGINSALAWYQQKPGKPPKLLIYAASSLESGVPSRFSGSGSGTDFTLTISNLQPEDFATYFCQQFNTYPLYTFGQGTKLDIT

SEQ ID NO: 316 - protein, 109 aa, Artificial Sequence
  Synthetic polypeptide representing artificial human antibody VL chain
VSSELTQDPAVSVALGQTVRITCQGDSLRRYYASWYQQKAGQAPILVIYGENNRPSGIPDRFSGSGSGNTASLTITGAQAEDEADYYCDSRDSSGNLVVFGGGTKLTVL

SEQ ID NO: 317 - protein, 214 aa, Artificial Sequence
  Synthetic polypeptide representing artificial human antibody VL chain
DIQMTQSPSSVPASVGDRVTITCRASQGIRNWLAWYRQRPGKAPELLIYAASNLQFGVPSRFSGSGSGTDFALTISSVQPEDFATYYCQQTNSFPRTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEW

SEQ ID NO: 318 - protein, 215 aa, Artificial Sequence
  Synthetic polypeptide representing artificial human antibody VL chain
DIQMTQSPSSLSASVGDRITITCRASQSVGTYLSWFQQKPGKAPKLLIYAASSLQSGVPSRFSGSGSGTDFTLTISSLQPEDFATYFCQQSYSVPPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEW

SEQ ID NO: 319 - protein, 216 aa, Artificial Sequence
  Synthetic polypeptide representing artificial human antibody VL chain
EVVLTQSPGTLSLSPGERATLSCRASQSVSSNYLAWYQQKLGQAPRLLIYGASSRATGIPDRFSGSGSGTDFTLTISRLEAEDFAVYYCQQYGSSPRYTFGQGTKVEIRRTVAAPSVFIFPPSDEQLKSGTASVVCLLNNFYPREAKVQWKVDNALQSGNSQESVTEQDSKDSTYSLSSTLTLSKADYEKHKLYACEVTHQGLSSPVTKSFNRGEW

SEQ ID NO: 320 - protein, 214 aa, Artificial Sequence
  Synthetic polypeptide representing artificial human antibody VL chain
EIVLTQSPGTLSLSPGERATLSCRASQSVSSRYLAWYQQKPGQAPRLLIHGASSRATGIPDRFSGSGSGTDFTLTISRLEPEDFAVYYCQQYGSAWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEW

SEQ ID NO: 321 - protein, 215 aa, Artificial Sequence
  Synthetic polypeptide representing artificial human antibody VL chain
EIVLTQSPATLSLSPGERATLSCRASQSVGSSLAWYQQKPGQAPRLLIFDSSNRATAIPARFTGSGSGTDFTLTISSLEPEDFAVYYCQQRANWPPITFGQGTRLDIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 322 - protein, 214 aa, Artificial Sequence
  Synthetic polypeptide representing artificial human antibody VL chain
DIQMTQSPSTLSASVGDRVTITCRASQSISSWLAWYQQKPGKAPKLVIYKASSLKSGVPSRFSGSGSGTEFTLTISSLQPDDFATYYCQQYNSYPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEW

SEQ ID NO: 323 - protein, 215 aa, Artificial Sequence
  Synthetic polypeptide representing artificial human antibody VL chain
PYVLTQPPSVSVAPGKTARITCGGNNIGSKSVHWYQQKPGQAPVLVIYYDSDRPSGIPERFSGSNSGNTATLTISRVEAGDEADYYCQVWDSSSDHYVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 324 - protein, 108 aa, Artificial Sequence
  Synthetic polypeptide representing artificial human antibody VL chain
EIVLTQSPATLSLSPGERATLSCRASQSVSTYLAWYQQKPGQAPRLLIYDASNRATGIPARFSGSGSGTDFTLTISSLEPEDFAVYYCQQRSNWPPLTFGGGTKVEIE

SEQ ID NO: 325 - protein, 219 aa, Artificial Sequence
  Synthetic polypeptide representing artificial human antibody VL chain
DIVMTQSPLSLPVTPGEPASISCRSSQSLLHSNGYNYLDWYVQKPGQSPQLLIYLGSNRASGVTDRLSGSGSGTDFTLEIGRVEAEDVGVYYCMQALQTPYTFGQGTKLEIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 326 - protein, 213 aa, Artificial Sequence
  Synthetic polypeptide representing artificial human antibody VL chain
DIQMTQSPSTLSASVGDRVTITCRASQSISSWLAWYQQKPGKAPKLLIYKASSLESGVPSRFSGSGSGTEFTLTISSLQPDDFATYYCQQYNSYSTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEW

SEQ ID NO: 327 - protein, 110 aa, Artificial Sequence
  Synthetic polypeptide representing artificial human antibody VL chain
QTVVTQEPSVSVSPGGTVTLTCGLRSGSVSTGNYPSWYQQTPGQAPRTLIYNINTRSSGVPHRFSASIIDNRAALTITGAQSDDESLYYCLLYMGSGISVFGGGTKVTVL

SEQ ID NO: 328 - protein, 216 aa, Artificial Sequence
  Synthetic polypeptide representing artificial human antibody VL chain
EIVLTQSPGTLSSTLGERATLSCRASQSVSSSYLAWYQQKPGQAPRLLIYGASRRATGIPDRFSGSGSGTDFTLTISRLEPEDFAVYYCQHYGASPPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 329 - protein, 215 aa, Artificial Sequence
  Synthetic polypeptide representing artificial human antibody VL chain
PYVLTQPPSVSVAPGQTARITCGGNNIGSKSVHWYQQKPGQAPVMVVYADRERPSGIPERLSGSNFGNTATLTISRVEAGDEADYYCQVWDSNNDHREVFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 330 - protein, 214 aa, Artificial Sequence
  Synthetic polypeptide representing artificial human antibody VL chain
DIQMTQSPSTLSASVGDRVTITCRASQSISRWLAWYQQKPGKAPKLLIYKASALESGVPSRFSGSGSGTEFTLTISSLQPDDFATYYCQQYDSYPLSFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEW

SEQ ID NO: 331 - protein, 214 aa, Artificial Sequence
  Synthetic polypeptide representing artificial human antibody VL chain
ATTLTQSPAFMSATPGDRVNISCKASQDIDDDMNWYQQKPGEAAIFIIQEATTLVPGVPPRFSGSGYGTDFTLTINNIESEDAAYYFCLQHDNFPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEW

SEQ ID NO: 332 - protein, 215 aa, Artificial Sequence
  Synthetic polypeptide representing artificial human antibody VL chain
EIVLTQSPGTLSLSPGERAILSCRAGQSIGAAYLAWYQQKPGQAPRLLISGASRRATGIPDRFSGSGSGTDFTLTISRLEPEDFAVYYCQQYGSSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 333 - protein, 214 aa, Artificial Sequence
  Synthetic polypeptide representing artificial human antibody VL chain
LYELTQPPSVSVSPGQTARITCSGDALPKKYAYWYQQKSGQAPVLVIYEDSKRPSGIPERFSGSSSGTMATLTISGAQVEDEADYYCYSTDSSGNHGVFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 334 - protein, 219 aa, Artificial Sequence
  Synthetic polypeptide representing artificial human antibody VL chain
DIVMTQSPLSLPVTPGEPASISCRSSQSLLHSDGYNYLDWYLQKPGQSPQLLIYLGSNRASGVPDRFSGSGSGTDFTLKISRVEAEDVGVYYCMQALQTPNTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 335 - protein, 217 aa, Artificial Sequence
  Synthetic polypeptide representing artificial human antibody VL chain
QSALTQPASVSGSPGQSITISCTGTSSDVGGYNYVSWYQHHPDKAPKLIIYEVKNRPSGVSNRFSGSKSDNTASLTISGLQAEDEADYYCNSYSSSSTLYVFGTGTKVTVLSQPKANPTVTLFPPSSEELQANKATLVCLISDFYPGAVTVAWKADSSPVKAGVETTKPSKQSNNKYAASSYLSLTPEQWKSHRSYSCQVTHEGSTVEKTVAPTECS

SEQ ID NO: 336 - protein, 215 aa, Artificial Sequence
  Synthetic polypeptide representing artificial human antibody VL chain
EIVLTQSPATLSLSPGERATLSCRASQSISSNLAWYQQKPGQAPRLLIYDASNRATGIPARFSGSGSGTDFTLTISSLEPEDFAVYYCQQHSNWPELTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 337 - protein, 216 aa, Artificial Sequence
  Synthetic polypeptide representing artificial human antibody VL chain
ASALTQPASVSGSPGQSITISCTGTSSDVGGYNYVSWYQQHPGKAPKLMIYDVSNRPSGVSNRFSGSKSGNTASLTISGLQAEDEADYYCSSYRSSGVYVFGTGTKVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 338 - protein, 219 aa, Artificial Sequence
  Synthetic polypeptide representing artificial human antibody VL chain
QVVMTQTPLSLSVTPGQPASISCKSSQRLLHSDGKTYLYWYLQKPGQSPQLLIYEVSNRFSGVPDRFSGSGSGTDFTLKISRVEAADVGVYYCMQSIHLPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEW

SEQ ID NO: 339 - protein, 216 aa, Artificial Sequence
  Synthetic polypeptide representing artificial human antibody VL chain
EIVLTQSPGTLSLSPGERATLSCRASQSVSSSFLAWYQQKPGQAPRLLIYGASSRATGVADRFSGSGSGTDFTLTINRLEPEDFAVYYCHQYGGSPPNTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 340 - protein, 215 aa, Artificial Sequence
  Synthetic polypeptide representing artificial human antibody VL chain
DIQLTQSPSFLSASVGDRVTITCRASQDVDTYLAWYQQKPGKAPKLLIYAASTLHSGVPSRFSGSGAGTEFTLTISSLQPEDFATYYCQQLNSYPPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 341 - protein, 216 aa, Artificial Sequence
  Synthetic polypeptide representing artificial human antibody VL chain
QSVLTQPPSLSAAPGQKVIISCSGSSSNIGKYSVFWYQQVPGTGPKLLIFDNNRRPSGIRDRFSASKSGTSATLEITGLQTGDEAHYYCATWDSSLTAGVFGGGTKLTVLRQPKAAPSVTLFPPSSEELQANKATLVCLISDFYPGAVTVAWKADGSPVKAGVETTTPSKQSNNKYAASSYLSLTPEQWKSHKSYSCQVTHEGSTVEKTVAPTECS

SEQ ID NO: 342 - protein, 214 aa, Artificial Sequence
  Synthetic polypeptide representing artificial human antibody VL chain
EIVLTQSPATLSLSPGNRAALSCRASQSVGSSLHWYQQKPGQAPRLLIYDVSNRAAGIPGRFSASGSGTDFTLTISNLEPEDFAVYYCQQRSAWPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 343 - protein, 216 aa, Artificial Sequence
  Synthetic polypeptide representing artificial human antibody VL chain
EIVLTQSPGTLSLSPGERATLSCRASQSVSSSYLAWYQQKPGQAPRLLISGASSRATGIPDRFSGSGSGTDFTLTISRLEPEDFAVYYCQQYGSSRKLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 344 - protein, 107 aa, Artificial Sequence
  Synthetic polypeptide representing artificial human antibody VL chain
DIQMTQSPSTLSASVGDRVTITCRASQSISVWLAWYQQKPGKAPKLLIYKASTLEAGVPSRFSGSGSGTEFSLTISGLQPDDFGTYFCQHYDSYPWTFGQGTKVEMK

SEQ ID NO: 345 - protein, 215 aa, Artificial Sequence
  Synthetic polypeptide representing artificial human antibody VL chain
VSSELTQDPAVSVALGQTVRITCQGDSLRRYYVSWYRQKPGEAPVVVIYGKNNRPSWIPDRLSGSSSGNTASLTITGAQAEDEADYYCCSRDSSGNPWVFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 346 - protein, 214 aa, Artificial Sequence
  Synthetic polypeptide representing artificial human antibody VL chain
VIQMTQSPTSLSASVGDRVTITCRASQSISSYLNWYQQKLGKAPKLLIYAASSLQSGVPSRFSGSGSGTDFTLTISSLQPEDFATYYCQQSYSTSLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 347 - protein, 217 aa, Artificial Sequence
  Synthetic polypeptide representing artificial human antibody VL chain
EIVLTQSPGTLSLSPGERATLSCRASQSVSSSYLAWYQQKPGQAPRLLIYDASSRAAGVPDRFSGSGSGTDFTLTISRLEPEDFAVYFCQQYDSSPPMYTFGQGTKLEIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 348 - protein, 217 aa, Artificial Sequence
  Synthetic polypeptide representing artificial human antibody VL chain
PSVLTQPPSVSAAPGQKVTISCSGSSSNIDNNYVSWYQQLPGTAPKLLIYENNKRASGIPDRFSGSKSGTSATLGITGLQTGDEADYYCGTWDSSLSPGGVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 349 - protein, 213 aa, Artificial Sequence
  Synthetic polypeptide representing artificial human antibody VL chain
DIQMTQSPSSLSASVGDRVTITCRASQTISTYLNWYQQKPGKAPKLLIYAASSLQSGVPSRFSGSGSETDFTLTISSLQPEDFATYYCQQSYNARTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 350 - protein, 221 aa, Artificial Sequence
  Synthetic polypeptide representing artificial human antibody VL chain
DIVMTQSPDSLAVSLGERATINCKSSQTVLHSSNNRNYLAWYQHKPGQPPKLLIYWASTRESGVPDRFSGSGSGTDFTLTINSLQAEDVAVYYCQQYYDTAPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 351 - protein, 214 aa, Artificial Sequence
  Synthetic polypeptide representing artificial human antibody VL chain
EIVMTQSPATLSVSPGERATLSCRASQSVDGNLAWYQQKPGQAPRLLIFDASTRATTIPVRFSGSGSGTEFTLTISSLQSEDFAVYYCQQYSKWPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKLYACEVTHQGLSSPVTKSFNRGEC

SEQ ID NO: 352 - protein, 214 aa, Artificial Sequence
  Synthetic polypeptide representing artificial human antibody VL chain
DIQMTQSPSSLSASLGDRITITCRATQSISNYLNWYQQKSGKVPELLIYAASHLQSGVPSRFSGTGSGTDFSLTISGLQPEDFATYYCQQTYTTPRTFGRGTTVEIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 353 - protein, 217 aa, Artificial Sequence
  Synthetic polypeptide representing artificial human antibody VL chain
PSVLTQPPSVSGAPGQRVTISCTGSSSNIGAGYDVHWYQQLPGTAPKLLIYGNINRPSGVPDRFSGSKSGPSASLTITGLQADDEADYYCQSYDSRLSGVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 354 - protein, 214 aa, Artificial Sequence
  Synthetic polypeptide representing artificial human antibody VL chain
EIVMTQSPATLSVSPGERATLSCRASQSVSTNLAWYQQRPGQAPRLFIFGASTRATGIPARFSGSGSGTEFTLTISSPQPEDSAVYYCQQYTTRPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 355 - protein, 214 aa, Artificial Sequence
  Synthetic polypeptide representing artificial human antibody VL chain
EIVLTQSPATLSLSPGEGATLSCRASQSVSGYLAWYQQKPGQAPRLLIYDASNRATGIPARFSGSGSGTDFTLTISSLEPEDFAVYYCQQRSKWPLTFGGGTQVEIKRTVAAPSVFIFPPSDEQLKSGTASVVCLLNNFYPREAKVQWKVDNALQSGNSQESVTEQDSKDSTYSLSSTLTLSKADYEKHKLYACEVTHQGLSSPVTKSFNRGEC

SEQ ID NO: 356 - protein, 217 aa, Artificial Sequence
  Synthetic polypeptide representing artificial human antibody VL chain
QSVVTQPPSASGPPGQTVTISCSGGRSNVASHAVHWYQHLPGTAPKLLIYNDHQRPSGVPDRFSGSKSGPSASLAISGLRSEDEADYYCATWDDSLGGRVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 357 - protein, 220 aa, Artificial Sequence
  Synthetic polypeptide representing artificial human antibody VL chain
DIVMTQTPLSMPVTPGEPASISCRSSQSLLDSDDGKTYLDWYLQKPGQSPQLLIYTVSYRASGVPDRFSGSGSGTDFTLKISRVEAEDVGVYYCMQRIEFPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 358 - protein, 106 aa, Artificial Sequence
  Synthetic polypeptide representing artificial human antibody VL chain
SYELTQPPSVSVSPGQTASITCSGDKLGDKYACWYQQKPGQSPVLVIYQDSKRPSGIPERFSGSNSGNTATLTISGTQAMDEADYYCQAWDSSTAVFGGGTKLTVL

SEQ ID NO: 359 - protein, 212 aa, Artificial Sequence
  Synthetic polypeptide representing artificial human antibody VL chain
PYELTQPPSVSVSPGQTANITCSGDKLGDICVCWYQQKPGQSPVLVIYQHNKRPSGIPERFSGSNSGNTATLTISATQATDEAIYYCQSWDSSSVLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 360 - protein, 220 aa, Artificial Sequence
  Synthetic polypeptide representing artificial human antibody VL chain
GIVMTQSPDSLGVSLGERATINCKSSQSLFYSSNNKNYLAWYQQKPGQPPKLLIYWASTRESGVPDRFSGSGSGTDFTLTISSLQAEDVAVYYCQQYYGRLFTFGPGTKVDIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 361 - protein, 216 aa, Artificial Sequence
  Synthetic polypeptide representing artificial human antibody VL chain
QIVLTQSPATLSLSPGERATLSCRASQSVSSYLAWYQQKPGQAPRLLIYDASNRATGIPARFSGGGSETDFTLTISSLEPEDFAVYYCQQRSNWPPRLPFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 362 - protein, 215 aa, Artificial Sequence
  Synthetic polypeptide representing artificial human antibody VL chain
QIVLTQSPATLSLSPGERATLSCRASQSVSNYLAWYQQKPGQAPRLLIYDASNRATGIPARFSGSGSGTDFTLTISSLEPEDFAVYYCQQRSNWPPYTFGQGTKLDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 363 - protein, 219 aa, Artificial Sequence
  Synthetic polypeptide representing artificial human antibody VL chain
DIVMTQSPLSLPVTPGEPASISCRSSQSLLQSNGNNYLAWYLQKPGQSPQLLIYLGSNRASGVPDRFSGSGSGTDFTLKISKLAAEDVGVYYCMQALQTPYTFGQGTKLDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 364 - protein, 214 aa, Artificial Sequence
  Synthetic polypeptide representing artificial human antibody VL chain
DIQMTQSPSTLSASVGDRVTITCRASQSISGWLAWYQQKPGKAPQLLIYLVSSLESGVPSRFSGSGSGTEFTLTISSLQPDDFATYYCQHYDSYIGTFGQGTKVEIKRTVAAPSVFIFPPSDEQLKSGTASVVCLLNNFYPREAKVQWKVDNALQSGNSQESVTEQDSKDSTYSLSSTLTLSKADYEKHKLYACEVTHQGLSSPVTKSFNRGEC

SEQ ID NO: 365 - protein, 216 aa, Artificial Sequence
  Synthetic polypeptide representing artificial human antibody VL chain
QSVLTQPPSVSAAPGQKVTISCSGGSSNIGNNYVSWYQQLPGTAPKLIIYDNDKRPAGIPDRFSGSKSGSSATLGITGLQNGDEAEYYCGTWDSSLGGGVFGGGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 366 - protein, 215 aa, Artificial Sequence; identical to SEQ ID NO: 362
  Synthetic polypeptide representing artificial human antibody VL chain

SEQ ID NO: 367 - protein, 112 aa, Artificial Sequence
  Synthetic polypeptide representing artificial human antibody VL chain
GIVMTQSPLSLPVTPGETASISCRSSQSLLRRDGNNYLEWYLQKPGQPPHLLIYLGSIRASRVPDRFSGTGSGTDFTLIISRVEADDVGVYYCMEAEQTPGTFGQGTKLEIK

SEQ ID NO: 368 - protein, 216 aa, Artificial Sequence
  Synthetic polypeptide representing artificial human antibody VL chain
QSALTQPASVSGSPGQSITISCTGTSSDVGGFNYVSWYQQHPGKAPKLLIYDVSERPSGVSSRFSGSKSGNTASLTISGLQAEDEADYYCSSYTSSTTVLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 369 - protein, 220 aa, Artificial Sequence
  Synthetic polypeptide representing artificial human antibody VL chain
GVVMTQSPLSLPVTLGQPASISCRSSQSLVYSDGNTYLNWFQQRPGQSPRRLIYKVSNRDSGVPDRFSGSGSGTDFTLKISRVEAEDVGVYYCMQGTHWPPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 370 - protein, 214 aa, Artificial Sequence
  Synthetic polypeptide representing artificial human antibody VL chain
DIQMTQSPSSLSASVGDRVTITCRASQSISSYLNWYQQKPGKAPKLLIYAASSLQSGVPSRFSGSGSGTDFTLAISSLQPEDFATYYCHQTYSTRLTFGGGTEVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 371 - protein, 214 aa, Artificial Sequence
  Synthetic polypeptide representing artificial human antibody VL chain
DIQMTQSPSSLSASVGDRVTITCQASQDISNYLNWYQQKPGKAPKLLIYDASNLETGVPSRFSGSGSGTDFTLTISSLQPEDFATYYCQQYDNLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 372 - protein, 214 aa, Artificial Sequence
  Synthetic polypeptide representing artificial human antibody VL chain
SYVLTQPPSVSVAPGQTARITCGGNNIGSKSVHWYQQKPGQAPVLVVYDDSDRPSGIPERFSGSNSGNTATLTISRVEAGDEADYYCQVWDSSSDPWVFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 373 - protein, 215 aa, Artificial Sequence
  Synthetic polypeptide representing artificial human antibody VL chain
DIQLTQSPSFLSASVGDRVTITCRASQVISDYVAWYQQKPGKAPKLLIYAASTLQSGVPSRFSGSGSGTEFTLTISSLQSEDFATYYCQQLNSYPPVTFGQGTRLDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 374 - protein, 214 aa, Artificial Sequence
  Synthetic polypeptide representing artificial human antibody VL chain
DIQMTQSPSSLSASVGDRVTITCRASQSISTYLNWYQQKPGKAPKLLIYVASSLQSGVPSRFSGSGSGTDFTLTISGLQPEDFATYYCQQSYSTPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 375 - protein, 215 aa, Artificial Sequence
  Synthetic polypeptide representing artificial human antibody VL chain
DIQMTQSPSTLSASVGDRVTITCRASQRISNWLAWYQQTPGKAPKLLIYKASSLESGVPSRFSGSGSGTEFTLTISSLQPDDFATYYCQQYSSSSPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 376 - protein, 112 aa, Artificial Sequence
  Synthetic polypeptide representing artificial human antibody VL chain
DILMTQTPLSLSVTPGQPASISCKSSQSLLNPDGKTYLYWYLQKSGQPPQLLIYELSNRFSGVPDRFSGSGSGTDFTLKISRVEAEDIGVYFCMQSLQLPITFGQGTRLEIK

SEQ ID NO: 377 - protein, 215 aa, Artificial Sequence
  Synthetic polypeptide representing artificial human antibody VL chain
DIQMTQSPSSLSASVGDRVTITCRASQSISGYLNWYQQKPGKAPKLLIYAASSLQSGVPSRFSGSGSGTDFTLTISSLQPEDFATYYCQQSYSTRLLTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 378 - protein, 217 aa, Artificial Sequence
  Synthetic polypeptide representing artificial human antibody VL chain
QSVLTQPPSVSGAPGQRVTISCTGSSSNVGADYDVHWYQQLPGTAPKLLIYGNRNRPSGVPDRFSGSKSGTSASLAITGLQAEDEADYYCQSFDSSLRGYVFGTGTKVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 379 - protein, 216 aa, Artificial Sequence
  Synthetic polypeptide representing artificial human antibody VL chain
EIVLTQSPDTLSLSPGERATLSCRASQSVSSSLAWYQQKPGQAPRLLIYYASNRATDIPARFSGSGSGTDFTLTISSLEPEDFALYYCQHRITWPPLITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 380 - protein, 215 aa, Artificial Sequence
  Synthetic polypeptide representing artificial human antibody VL chain
EIVLTQSPGTLSLSPGERATLSCRASQSFDGKSLAWYQQKPGQTPRLLVYGASSRATGIPDRFGGSGSGTDFTLTISRLESEDFAVYFCQQYAYVPITFGQGTRLERKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 381 - protein, 220 aa, Artificial Sequence
  Synthetic polypeptide representing artificial human antibody VL chain
GIVMTQSPDSLAVSLGERATINCKSSQSILYSSNNKDSLAWYQQKPGQPPKLLISSASTRQSGVPDRFSGSGSGTDFTLTISSLQAEDVAVYYCQQYYSIPLTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEW

SEQ ID NO: 382 - protein, 108 aa, Artificial Sequence
  Synthetic polypeptide representing artificial human antibody VL chain
EIVLTQSPGTLSLSLGERATLSCRASQSVSGSHLAWYQQKPGQAPRLLIYDASSRATGIPDRFSGSGSGTEFTLTISRLEPEDFAVYYCQQYGSSPLWFGQGTKVEIK

SEQ ID NO: 383 - protein, 216 aa, Artificial Sequence
  Synthetic polypeptide representing artificial human antibody VL chain
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTQVFGTGTKVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 384 - protein, 214 aa, Artificial Sequence
  Synthetic polypeptide representing artificial human antibody VL chain
PYELTQPPSVSVSPGQTARITCSGDALPKKYAYWYQQKSGQAPVLVIYEDSKRPSGIPERFSGSSSGTMATLTISGAQVEDEADYYCYSTDSSGNHRVFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 385 - protein, 215 aa, Artificial Sequence
  Synthetic polypeptide representing artificial human antibody VL chain
EIVMTQSPATLSVSPGETATLSCRASQSVSSNLAWYQQKPGQAPRLLMYGASTRATSVPARFSGSASGTDFTLTISSLQSEDFALYYCQQYNNWPQYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEW

SEQ ID NO: 386 - protein, 217 aa, Artificial Sequence
  Synthetic polypeptide representing artificial human antibody VL chain
EIVLTQSPGTLSLSPGERATLSCRASQSVSSSYLVWYQQKAGQAPRLLIYGASSRATGISDRFSGSGSGTDFTLTISRLEPEDFAVYYCQHFRSSPPTYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 387 - protein, 216 aa, Artificial Sequence
  Synthetic polypeptide representing artificial human antibody VL chain
QSALTQPASVSGSPGQSITISCTGTSSDVGLYNFVSWYQQHPGKAPKLMIFDVNNRPSGVSNRFSGSKSDNTASLTISGLQAEDEADYYCSSYSRTTTLVFGGGTKVTVLGQPKAAPSVTLFPPSSEELQANKATLVCLISDFYPGAVTVAWKADSSPIKAGVETTTPSKQSNNKYAASSYLSLTPEQWKSHRSYSCQVTHEGSTVEKTVAPTECS

SEQ ID NO: 388 - protein, 218 aa, Artificial Sequence
  Synthetic polypeptide representing artificial human antibody VL chain
PAVLTQPPSVSGAPGQRVTISCTGSNSNIGAGYYVHWYQHRPGAAPKRLIYADSDRPSGVPDRFSGSRSGTSASLAITGLQAEDEADYYCQSYDSGLSAPWVFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 389 - protein, 215 aa, Artificial Sequence
  Synthetic polypeptide representing artificial human antibody VL chain
EIVLTQSPGTLSLSPGQRATLSCRASQSVTSSYLAWYQQKPGQAPRLLIYAASSRATGTPDRFSGSGSGTDFTLTISRLEPEDFAVYSCQQYGNSPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 390 - protein, 110 aa, Artificial Sequence
  Synthetic polypeptide representing artificial human antibody VL chain
PSVLTQPLSASGTPGQRVTISCSGSSSNIGDNFVYWYQQFPGTAPKVLIFKNNQRPSGVPDRFFGSKSGTSASLAISGLRSEDEAEYYCATWDDDLSGPVFGGGTKVTVL

SEQ ID NO: 391 - protein, 107 aa, Artificial Sequence
  Synthetic polypeptide representing artificial human antibody VL chain
ETTLMQSPALISATPGDKVHISCKASQDIDDDLNWYQQKPGEAPILIIEEATNLGPGFSPRFSGSGYGTDFTLTIYDIESGDAAFYFCLQHDTFPLTFGQGTKVEIK

SEQ ID NO: 392 - protein, 214 aa, Artificial Sequence
  Synthetic polypeptide representing artificial human antibody VL chain
DIQMTQSPSTLSASVGDKVTITCRASQSVGSWLAWYQQKPGKAPKLLISVASSLESGVPSRFSGSGSGTEFTLTVSSLQPDDFATYYCQQYNSYSWTFGQGTKVELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEL

SEQ ID NO: 393 - protein, 214 aa, Artificial Sequence
  Synthetic polypeptide representing artificial human antibody VL chain
DIQLTQSPSFLSASVGDRVTITCRASQDISSFLAWYQQKPGKAPDLLIYAASTLQSGVPSRFSGSGSGTEFTLTISSLQPEDFAAYYCQHLTSFPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEL

SEQ ID NO: 394 - protein, 215 aa, Artificial Sequence
  Synthetic polypeptide representing artificial human antibody VL chain
VSSELTQDPAVSVALGQTVRITCQGDSLRDYSASWYQQKPGQAPILVIFFRNKRPSGIPDRFSGSASGNTASLTITGAQAEDEADYYCGSRDSSGNPSVFGAGTKVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 395 - protein, 214 aa, Artificial Sequence
  Synthetic polypeptide representing artificial human antibody VL chain
EIVLTQSPATLSLSPGEGATLSCRASQSVSAYLGWYQQKPGQAPRLLIYDTSNRATGIPARFSGSGSGTDFTLTISSLEPEDFAVYYCQQRSNWLYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEW

SEQ ID NO: 396 - protein, 215 aa, Artificial Sequence
  Synthetic polypeptide representing artificial human antibody VL chain
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHQEVFGGGTKLTVLGQPKAAPSVTLFPPSSEELQANKATLVCLISDFYPGAVTVAWKADGSPVKAGVETTTPSKQSNNKYAASSYLSLTPEQWKSHRSYSCQVTHEGSTVEKTVAPTECS

SEQ ID NO: 397 - protein, 216 aa, Artificial Sequence
  Synthetic polypeptide representing artificial human antibody VL chain
QSALTQPASVSGSPGQSITISCTGSSSDVGNYNLVSWYQLHPGKAPKLMIYEVIKRPSGVSSHFSGSKSGNTASLTISGLQAEDEADYYCCSYAPSNTYVFGTGTRVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 398 - protein, 214 aa, Artificial Sequence
  Synthetic polypeptide representing artificial human antibody VL chain
QIVLTQSPATLSLSPGERVTLSCRASQSVRSHLAWYQQKPGQAPRLLMYDAFNRATGTPARFSGSGSGTDFTLTISSLEPEDFAIYYCQQRSNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEL

SEQ ID NO: 399 - protein, 216 aa, Artificial Sequence
  Synthetic polypeptide representing artificial human antibody VL chain
VSSELTQDPAVSVALGQTVRITCQGDSLRSYYATWYQQKPGQAPLLVIFDKDKRPSGIPDRFSGSSSGNTASLTITGAQPEDEAVYYCNSRDSSAHDHLLFGGGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 400 - protein, 216 aa, Artificial Sequence
  Synthetic polypeptide representing artificial human antibody VL chain
EVVLTQSPGTLSLSPGERATLFCKASQAIVSNYLVWYQQKPGLAPRLLIYSASTRATGIPDRFSGGGSGTDFSLTISGLEPEDFAVYYCQHFGDSPLYIFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 401 - protein, 212 aa, Artificial Sequence
  Synthetic polypeptide representing artificial human antibody VL chain
PYELTQPLSVSVALGQTARVTCGGTNIGKKDVHWYQQKPGQAPVLVIYRDDNRPSGIPERFSGLNSGHTATLTISRAQAGDEADYYCQVWDSSTAVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 402 - protein, 108 aa, Artificial Sequence
  Synthetic polypeptide representing artificial human antibody VL chain
LYVLTQPPSVSVAPGKTARITCGGNNIGSKSVHWYQQKPGQAPVLVIYDDSDRPSGIPERFSGSNSGNTATLTISRVEAGDEADYYCQVWDSSSDHVVFGGGTKLTVQ

SEQ ID NO: 403 - protein, 214 aa, Artificial Sequence
  Synthetic polypeptide representing artificial human antibody VL chain
SYELTQTPSVSVSPGQTARITCSGDALPKQSVNWYQQRPGQAPVVVICKDTERPSGIPERFSGSTSGTTVTLTIGGVQAEDEADYYCQSADSSGFYVVFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 404 - protein, 212 aa, Artificial Sequence
  Synthetic polypeptide representing artificial human antibody VL chain
SYELTQPPSVSVSPGQTARITCSGDALPKQYAYWYQQKPGQAPVLVIYKDSERPSGIPERFSGSSSGTTVTLTISGVQAEDEADYYCQSADSSSPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 405 - protein, 213 aa, Artificial Sequence
  Synthetic polypeptide representing artificial human antibody VL chain
SYELTQPPSVSVPPGQTARITCSGDALPKKYAYWYQQKSGQAPVLVIYEDTKRPSGIPDRFSGSSSGTMATLTISGAQVEDDADYYCYSTDSRATGVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 406 - protein, 214 aa, Artificial Sequence
  Synthetic polypeptide representing artificial human antibody VL chain
AVQMTQSPSSLSASVGDRVTISCRASQTIDTYLNWYQQRPGKAPQLLIYAASSLQSGVPSRFSASGSGTHFTLIINSLQPEDFATYYCQQSYSTPQTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 407 - protein, 107 aa, Artificial Sequence
  Synthetic polypeptide representing artificial human antibody VL chain
DIQMTQSPSSLSASVGDRVTITCQATQGITNYLNWYQQKPGKAPKVLIYDASNLETGVPSRFSGNGSGTHFTFTISSLQPEDIATYYCQQYENLPLTFGGGTKVEIK

SEQ ID NO: 408 - protein, 214 aa, Artificial Sequence
  Synthetic polypeptide representing artificial human antibody VL chain
DIQMTQSPSSLSASVGDRVTITCQASQDISTFLNWYQQKPGKAPKLLIYDESNLETGVPSRFSGSGSGTDFTFTISSLQPEDIATYYCQQFDNLPLTFGGGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 409 - protein, 110 aa, Artificial Sequence
  Synthetic polypeptide representing artificial human antibody VL chain
QSALTQPRSVSGSPGQSVTISCTGTSSDIGGYNYVSWYQQHPGKAPKFVIYDVSQRPSGVPDRFSGSKSGNTASLTISGLQADDEADYYCSSYAGSYTWVFGGGTKVIVL

SEQ ID NO: 410 - protein, 105 aa, Artificial Sequence
  Synthetic polypeptide representing artificial human antibody VL chain
SYELTQPPSVSVSPGQTASITCSGDKLGDKYACWYQQKPGQSPVVVIYQDTKRPSGIPERFSGSNSGNTATLTISGTQAMDEADYYCQAWDSSTVVFGGGTKLTV

SEQ ID NO: 411 - protein, 110 aa, Artificial Sequence
  Synthetic polypeptide representing artificial human antibody VL chain
PSVLTQPPSLSAAPGQRVTISCSGSTSNIGNNFVSWYQQLPGAAPKLLIYDNDKRPSEIPDRFSGSKSGTSATLAITGLQTGDEADYYCGTWDSSLGAYVFGTGTKVTVL

SEQ ID NO: 412 - protein, 214 aa, Artificial Sequence
  Synthetic polypeptide representing artificial human antibody VL chain
EIVLTQSPGTLSLSPGERATLSCRASQSISSTYLVWYQQKPGQAPRLLIYAASYRATGIPDRFSGSGSGTDFILTISRLEPEDFAVYYCQQYGSSLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 413 - protein, 215 aa, Artificial Sequence
  Synthetic polypeptide representing artificial human antibody VL chain
EIELTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKLYACEVTHQGLSSPVTKSFNRGEC

SEQ ID NO: 414 - protein, 216 aa, Artificial Sequence
  Synthetic polypeptide representing artificial human antibody VL chain
ASALTQPASVSGSPGQSITISCNGSSSDVGDYNYVSWYQQHPGKAPKLMIYDVSNRPSGVSNRFSGSKSGNTASLTISGLQAEDEADYYCSSYTSSRSLVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 415 - protein, 214 aa, Artificial Sequence
  Synthetic polypeptide representing artificial human antibody VL chain
DIQMTQSPSSLSASVGDKVTMTCRASQFISVYVNWYQQKPGKAPKLLIYTASSLESGVSSRFSGGGSGTDFTLTIRSLQPEDFAIYYCQQTYSTPWTFGPGTRVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 416 - protein, 214 aa, Artificial Sequence
  Synthetic polypeptide representing artificial human antibody VL chain
GEVVMTQSPATLSVSPGERATLSCRASQSVSSKVAWYQQRPGRAPRLLIYGASTRATDIPARFSGSGSGTEFTLTISSLQSEDFAVYYCQQYNNWLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEW

SEQ ID NO: 417 - protein, 106 aa, Artificial Sequence
  Synthetic polypeptide representing artificial human antibody VL chain
SYELTQPSSVSVSPGQTARITCSGDVLAKNYARWFQQKPGQAPLLVIYKDNIRPSGIPERFSGSSSGTTVTLTISGAHVDDEADYYCYSTPDNNGVFGGGTKLIVL

SEQ ID NO: 418 - protein, 216 aa, Artificial Sequence
  Synthetic polypeptide representing artificial human antibody VL chain
QSALTQPASVSGSPGQSITISCTGTSSDVGAYPYVSWYQHHPGRAPKLTIFDVINRPSGVSNRFSGSKSGNTASLTISGLQAEDEAFYYCSSYTTSNSVVFGGGTKLTVLSQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 419 - protein, 215 aa, Artificial Sequence
  Synthetic polypeptide representing artificial human antibody VL chain
EIVLTQSPGTLSLSPGERATLSCRASQSLSSGYLAWYQQKPGQAPRLLIYGASYRATDIPDRFSGSGSGTDFTLTISRLEPEDFAVYYCQQYDNSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 420 - protein, 113 aa, Artificial Sequence
  Synthetic polypeptide representing artificial human antibody VL chain
GIVMTQSPDSLAVSLGERATINCKSSQSLLYRSNDKNYFAWYQQKPGQPPKLLIYWASTRESGVPDRFSGSGSGTDFTLTISSLQAEDVAVYYCQQYWGTPYTFGQGTKLEIK

SEQ ID NO: 421 - protein, 216 aa, Artificial Sequence
  Synthetic polypeptide representing artificial human antibody VL chain
PAVLTQAPSVSGAPGQRVTISCTGSGSNIGAGYDAHWYQQLPGTAPKLLIYRNTNRPSGVPDRFSGSKSGSSASLAITGLQPEDEAEYYCQSYDSGLGVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 422 - protein, 216 aa, Artificial Sequence
  Synthetic polypeptide representing artificial human antibody VL chain
QSALTQPPSASGSPGQSVTISCTGTSSDVGGYDHVSWYQQHPGKAPKVMIYEVTKRPSGVPDRFSGSKSGNTASLTVSGLQAEDEAEYYCSSYAGINNLVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 423 - protein, 214 aa, Artificial Sequence
  Synthetic polypeptide representing artificial human antibody VL chain
DIQMTQSPSTLSASVGDRVTITCRASQSISSWLAWYQQKPGKAPKLLIYKASSLESGVPSRFSGSGSGTEFTLTISSLQPDDFATYYCQQYNSYSQTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 424 - protein, 214 aa, Artificial Sequence
  Synthetic polypeptide representing artificial human antibody VL chain
EIVMTQSPATLSVSPGERATLSCRASQSIVTNLAWFQQKPAQAPRLLIYGASTRATDVPARFSGSGSGTEFTLTVSSLQSEDFAIYFCQQYTDWPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 425 - protein, 216 aa, Artificial Sequence
  Synthetic polypeptide representing artificial human antibody VL chain
PLVLTQSPSASASLGASVKLTCTLSSGHSTYAIAWHQQRPEKGPRYLMKLNSDGSHIKGDGIPARFSGASSGVDRYLIISSSQSEDEADYYCQTWGTVGVFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 426 - protein, 215 aa, Artificial Sequence
  Synthetic polypeptide representing artificial human antibody VL chain
EIVLTQSPGTLSLSPGERATLSCRAGQSVSSSYLAWYQQKPGQAPRLLIYGASSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 427 - protein, 217 aa, Artificial Sequence
  Synthetic polypeptide representing artificial human antibody VL chain
QSVLTQPPSVSGAPGQRVTIPCTGSSSNLGAGYAVHWYQQLPATTPKLLIYANSSRPSGVPDRFSGSRSDTSASLAITGLQAEDEADYYCQSYDSSLSGYVFGTGTWVTVLSQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 428 - protein, 217 aa, Artificial Sequence
  Synthetic polypeptide representing artificial human antibody VL chain
QSVLTQPPSVSGAPGQRITISCTGGSTNIGTIYDVHWYQQLPGAAPKLLIYGNSRRPSGVPDRFSASKSGTSASLAISGLRPEDEADYYCQCFDTSLTAKVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 429 - protein, 112 aa, Artificial Sequence
  Synthetic polypeptide representing artificial human antibody VL chain
DILLTQSPLFLSVTPGEPASISCRSNQSLLSSNGHHLLDWYFQKPGQSPQLLMFLGSTRASGVPDRFSGSASGTEFTLKISTVEAEDFGVYYCMQALQVPRTFGRGTKVEIK

SEQ ID NO: 430 - protein, 214 aa, Artificial Sequence
  Synthetic polypeptide representing artificial human antibody VL chain
DIQLTQSPSFLSASVGDRVTITCRASQGISSYLAWYQQKPGKAPKLLIYAASTLQSGVPSRFSGSGSGTEFTLTISSLQPEDFATYYCQQLNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKLYACEVTHQGLSSPVTKSFNRGEL

SEQ ID NO: 431 - protein, 216 aa, Artificial Sequence
  Synthetic polypeptide representing artificial human antibody VL chain
PAVLTQPPSASGTPGQRVTISCSGSNSNIGSTFVYWYQQLPGTAPKLLIHSNNQRPSGVPDRVSGSKSGTSASLAISGLRSEDEADYYCAAWDDSLSGPVFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 432 - protein, 219 aa, Artificial Sequence
  Synthetic polypeptide representing artificial human antibody VL chain
DIVLTQSPLSLPVTPGEPASISCRSSQSLLHSNGVYYLDWYLLKPGQSPQLVIYMGSSRASGVPDRFSGSGSGTDFRLKISRVEAEDVGIYYCMQALQTPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEW

SEQ ID NO: 433 - protein, 216 aa, Artificial Sequence
  Synthetic polypeptide representing artificial human antibody VL chain
VSSELTQDPAVSVALGQTVRITCQGDSLRSYFATWYQQKPGQAPVLVIYGKNSRPSGIPDRFSGSTSGNTASLTISGAQAEDEADYYCNSRDSSDDHLEVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 434 - protein, 214 aa, Artificial Sequence
  Synthetic polypeptide representing artificial human antibody VL chain
YIQMTQSPSTLSASVGDRVTITCRASQSISSWLAWFQQKPGKAPKLLIYKASTLESGVPSRFSGSESGTEFTLTIGSLQPDDFATYYCQQYNSYPRTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 435 - protein, 220 aa, Artificial Sequence
  Synthetic polypeptide representing artificial human antibody VL chain
DIVMTQSPDSLAVTLGERATINCRSSQTVLYDSNNKNYLAWYQQKPGQPPKLLIYWASIRESGVPDRFSGSGSGTDFTLTINTLQAEDVAIYFCQQYFTTPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEL

SEQ ID NO: 436 - protein, 217 aa, Artificial Sequence
  Synthetic polypeptide representing artificial human antibody VL chain
PAVLTQPPSVSGTPGQRVTISCSGGSSNIGGKYVYWYQQLPGTAPKVVIYRNNQRPSGVSDRFSGSKSGISASLTISGLRSEDEAVYYCAAWDDGLGGLYVFGTGTKVTALGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 437 - protein, 213 aa, Artificial Sequence
  Synthetic polypeptide representing artificial human antibody VL chain
DIQMTQSPSTLSASVGDRVTISCRASQSISDWLAWYQQKPGKAPKLLIYAASILQSGVPSRFSGSGSGTEFTLTISSLQTDDFATYYCQQYNRGSTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEW

SEQ ID NO: 438 - protein, 214 aa, Artificial Sequence
  Synthetic polypeptide representing artificial human antibody VL chain
SYVLPQPPSVSVAPGQTAKITCGGNNPGIKSVHWYQQRPGQAPVLVIYDDSDRPSGIPERFSGSNSGNTVTLTISWVEAGDEADYYCQVWDRNSHRVIFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 439 - protein, 217 aa, Artificial Sequence
  Synthetic polypeptide representing artificial human antibody VL chain
PSVLTQPPSVSGAPGQRVTISCTGSTSNIGADYDVHWYQQLPRTAPKLLIYANNNRPSGVPDRFSGSKSGTSASLAITGLQAEDEADYYCQSYDNSLSAWVFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 440 - protein, 214 aa, Artificial Sequence
  Synthetic polypeptide representing artificial human antibody VL chain
SSELTQDPAVSVALGQTVRITCQGDSLRSFYGSWYQQKPGQAPVLVIYGENNRPSGIPDRFSGSSSGNTASLTITGAQAEDEADYYCNSRDSSGNHWVFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 441 - protein, 217 aa, Artificial Sequence
  Synthetic polypeptide representing artificial human antibody VL chain
QSALTQPASVSGSPGQSITISCTGISSDVDGYNYVSWYQLYSGKAPKLIIYDVTNRPSGVSHRFSGSKSGNTASLTISGLQAEDEADYYCSSYIRSSTPVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 442 - protein, 220 aa, Artificial Sequence
  Synthetic polypeptide representing artificial human antibody VL chain
DIVMTQSPDSLAVSLGERATINCKSSQSVLYSSDNKNYLAWYQQKPGQPPKLLIYWASTRESGVPDRFSGSGSGTDFTLTISSLEAEDVAVYYCQQYYDTPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 443 - protein, 216 aa, Artificial Sequence
  Synthetic polypeptide representing artificial human antibody VL chain
ASALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLVFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 444 - protein, 213 aa, Artificial Sequence
  Synthetic polypeptide representing artificial human antibody VL chain
DIQMTQSPSSLSASVGDRVTITCQASQDISNYLNWYQQKPGKAPKLLIYDASNLETGVPSRFSGSGSGTDFTFTISSLQPEDIATYYCQQYDNLWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 445 - protein, 215 aa, Artificial Sequence
  Synthetic polypeptide representing artificial human antibody VL chain
PYVLTQPPSVSVAPGQTARITCGGNNIGSKSVHWYQQKPGQAPVLVVYDDSDRPSGIPERFSGSNSGNTATLTISRVEAGDEADYYCQVWDSSSDHLYVFGTGTKVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 446 - protein, 215 aa, Artificial Sequence
  Synthetic polypeptide representing artificial human antibody VL chain
EIVLAQSPGTLYLSPGERATLSCRASQSVRGNYLAWYQQRPGQAPRLLIYGASSRATGIPDRFGGSGSGTDFTLTITRLLPEDFAVYYCHQYGSSPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 447 - protein, 217 aa, Artificial Sequence
  Synthetic polypeptide representing artificial human antibody VL chain
QSVLTQPPSVSAATGQKVTISCSGGSSNIGSNYVSWYQQLPGTAPKLLIFENNKRPSGIPDRFSGSKSGTSATLGITGLQTGDEADYYCGTWDSSLTGGFVFGTGTKVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 448 - protein, 214 aa, Artificial Sequence
  Synthetic polypeptide representing artificial human antibody VL chain
SYVLTQPPSVSVAPGKTATIACGENNIGSYNVNWYQQRPGQAPVLVIHSDSDRPSGISERFSGSNSGNTATLTISRVEAGDEADYYCQVWDTSNDVGVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 449 - protein, 215 aa, Artificial Sequence
  Synthetic polypeptide representing artificial human antibody VL chain
EIVLTQSPGTLSLSPGGRATLSCRASQRVSSNYLAWYQQKPGQAPRLLIYGPSSRATGVPDRFSSSGSGTDFTLSISRLEPEDFAVYFCQQYGSSPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 450 - protein, 216 aa, Artificial Sequence
  Synthetic polypeptide representing artificial human antibody VL chain
ASALTQPASVSGSPGQSITISCTGTSSDVGSYNLVSWYQQHPGKAPELMIYEGSKRPSGVSNRFSGSKSGNTASLTISGLQAEDEADYYCCSYAGSSNWVFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 451 - protein, 218 aa, Artificial Sequence
  Synthetic polypeptide representing artificial human antibody VL chain
DVVMTQSPLYLPVTLGQPASISCRASQSLVYSDGNTYLNWVHQRPGQSPRRLIYMVSQRGSGVPDRFSGSGSDTDFTLKISRVEAEDVGVYYCMQGTHWSAFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 452 - protein, 216 aa, Artificial Sequence
  Synthetic polypeptide representing artificial human antibody VL chain
PSVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGQVFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 453 - protein, 214 aa, Artificial Sequence
  Synthetic polypeptide representing artificial human antibody VL chain
VSSELTQDPAVSVALGQTVRITCQGDSLRSYYASWYQQRPGQAPVLVIYGKNNRPSGIPDRFSGSSSGNTASLTITGAQAEDEADYYCNSRDSSGNHVFGTGTKVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 454 - protein, 213 aa, Artificial Sequence
  Synthetic polypeptide representing artificial human antibody VL chain
DIQMTQSPSSLSASVGDRVTITCRASQSISSYLNWYQQKPGKAPKLLIYAASSLQSGVPSRFSGSGSGTDFTLTISSLQPEDFATYYCQQSYSTPTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 455 - protein, 213 aa, Artificial Sequence
  Synthetic polypeptide representing artificial human antibody VL chain
YVLTQPPSVSVAPGQTARITCGGNNIGYRNVYWYHQKPGQAPVLVVYDDSDRPSGIPERFSGSNSGNTATLTISRVEAGDEADYFCQVWESGGDHPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 456 - protein, 214 aa, Artificial Sequence
  Synthetic polypeptide representing artificial human antibody VL chain
DIQMTQSPSSLSASVGDRVTITCRASQGIRNDLGWFQQKPGKAPKRLIYAASNLPSGVSSRFSGSGSGTEFTLTISSLQPEDFATYYCLQHNNYPLTFGQGTKVEFKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 457 - protein, 214 aa, Artificial Sequence
  Synthetic polypeptide representing artificial human antibody VL chain
DIQMTQSPSTLSASVGDRVTITCRASQSISSWLAWYQQKPGKAPKLLIYDASSLESGVPSRFSGSGSGTEFTLTISSLQPDDFATFYCQQYNSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 458 - protein, 219 aa, Artificial Sequence
  Synthetic polypeptide representing artificial human antibody VL chain
DIVMTQSPLSLPVTPGEPASISCRSSQSLLHSNGFNYLDWYLQKPGQSPQLLIYLGSNRASGVPDRFSGSGSGTDFTLKISRVEAEDVGVYYCMQALQIPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 459 - protein, 212 aa, Artificial Sequence
  Synthetic polypeptide representing artificial human antibody VL chain
PYELTQPPSVSVSPGQTASITCSGDKLGDKYACWYQQKPGQSPVLVIYQDSKRPSGIPERFSGSNSGNTATLTISGTQAMDEADYYCQAWDSNVHVFGTGTKVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 460 - protein, 214 aa, Artificial Sequence
  Synthetic polypeptide representing artificial human antibody VL chain
SYELTQPPSVSVSPGQTARITCSGDALPKKYAFWYQQKSGQAPVLVIYEDSKRPSGIPERFSGSSSGTMATLTISGAQVEDESDYYCYSTDSSGNVWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 461 - protein, 215 aa, Artificial Sequence
  Synthetic polypeptide representing artificial human antibody VL chain
VSSELTQDPAVSVALGQTVRITCQGDSLRSYYASWYQQKPGQAPVLVIYGKNNRPSGIPDRFSGSSSGNTASLTITGAQAEDEADYYCNSRDSSGNLYVFGTGTKVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 462 - protein, 220 aa, Artificial Sequence
  Synthetic polypeptide representing artificial human antibody VL chain
DIAMTQSPDSLAVSLGERATINCKSSQSVLYSSSSKNYLAWYQQKPGQPPKLLIYWASTRESGVPDRFSGSGSGTDFTLTISSLQAEDVAVYYCQQYYSSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 463 - protein, 220 aa, Artificial Sequence
  Synthetic polypeptide representing artificial human antibody VL chain
DIVMTQSPLSLPVTPGEPASISCRSSQSLLHSNGYNYLDWYLQKPGQSPQLLIYLGSNRASGVPDRFSGSGSGTDFTLKISRVEADDVGVYYCMQALQTPPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 464 - protein, 216 aa, Artificial Sequence
  Synthetic polypeptide representing artificial human antibody VL chain
ASALTQPASVSGSPGQSITISCTGTSSDVGGYNYVSWYQQHPGKAPQLMIFDVSNRPSGVSNRFSGSKSGDTASLTISGLQAEDEADYYCSSYTSSSTWVFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 465 - protein, 220 aa, Artificial Sequence
  Synthetic polypeptide representing artificial human antibody VL chain
DIVMTQSPDSLAVSLGERATINCKSSQSVLYSSNNKNYLGWYQQKPGEPPKLVIHWASTRESGVPDRFSGSGSGTDFTLTISSLQAEDVAVYYCQQSYSTPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 466 - protein, 111 aa, Artificial Sequence
  Synthetic polypeptide representing artificial human antibody VL chain
QSALTQPASVSGSPGQSITISCTGTSSDVGSYNLVSWYQQHPGKAPKLMIYEGSKRPSGVSNRFSGSKSGNTASLTISGLQAEDEADYYCCSYAGSSTPWVFGGGTKLTVL

SEQ ID NO: 467 - protein, 214 aa, Artificial Sequence
  Synthetic polypeptide representing artificial human antibody VL chain
PYELTQPPSVSLSPGQTARITCSGDALPKKYAYWYQQKSGQAPVLVIYEDSKRPSGIPERFSGSSSGTTATLTISGAQVDDEGDYYCYSPDSSGNVWVFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 468 - protein, 103 aa, Artificial Sequence
  Synthetic polypeptide representing artificial human antibody VL chain
EIVMTQSPATLSVSPGERATLSCRASQSVSSNLAWYQQKPGQAPRLLIYGASTRATGLPARFSGSGSGTEFTLTISSLQSEDFAVYYCQSRGTFGGGTKVEIK

SEQ ID NO: 469 - protein, 109 aa, Artificial Sequence
  Synthetic polypeptide representing artificial human antibody VL chain
EIVLTQSPVTLSLSPGERATLSCRASQSVSSSYIAWYQQKPGQAPRLLIYGASTRATGIPDRFSGSGSGTDFTLTISRLEPEDCAVFYCQQYGSSHYTFGQGTKLEIKR

SEQ ID NO: 470 - protein, 215 aa, Artificial Sequence
  Synthetic polypeptide representing artificial human antibody VL chain
SYVLTQPPSVSVAPGKTARITCGGDNIGSRSVHWYQQKPGQAPVLVIYYDSDRPSGIPERFSGSNSGNTATLTISRVEAGDEADYYCQVWDSSSDHPWVFGGGTKLTVLRQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 471 - protein, 111 aa, Artificial Sequence
  Synthetic polypeptide representing artificial human antibody VL chain
QSALTQPASVSGSPGQSITISCTGTSSDIGTYNLVSWYQQRPGKAPKLIIYDVIKRPSGISDRFSGSKSDNMASLTISGLQAEDEAHYYCCSYRSSTAPVVFGGGTKVTVL

SEQ ID NO: 472 - protein, 113 aa, Artificial Sequence
  Synthetic polypeptide representing artificial human antibody VL chain
GIVMTQSPDSLAVSLGERATINCKSSQSVLSTSNNKNYLAWYQQKPGQPPKLLIYWASTRESGVPDRFSGSGSGTDFTLTISSLQAEDVAVYYCQQYFSTPWTFGQGTKVEIK

SEQ ID NO: 473 - protein, 214 aa, Artificial Sequence
  Synthetic polypeptide representing artificial human antibody VL chain
SYVLTQPPSVSVAPGQTARITCGGNNIGSKSVHWYQQKPGQAPVLVVYDDSDRPSGIPERFSGSNSGNTATLTISRVEAGDEADYYCQVWDGYSDPLVFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 474 - protein, 214 aa, Artificial Sequence
  Synthetic polypeptide representing artificial human antibody VL chain
EVQMTQSPSSLSASVGDRVTITCRASQHIAGRLNWYQQKPGKAPKLLIHSASSVQREVPSRFGGSGFGTDFTLTIYSLQAEDFATYFCQQSYYTPPTFAGGTRVDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 475 - protein, 217 aa, Artificial Sequence
  Synthetic polypeptide representing artificial human antibody VL chain
RSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGLWVFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 476 - protein, 217 aa, Artificial Sequence
  Synthetic polypeptide representing artificial human antibody VL chain
DFLLTQPHSVSESPGKTVTISCTRSSGSIASNYVQWYQQRPGSSPSTVIYEDHQRPSGVPGRFSGSIDSSSNSASLTISGLKTEDEADYFCQSSDSNNHVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 477 - protein, 217 aa, Artificial Sequence
  Synthetic polypeptide representing artificial human antibody VL chain
RSVLTQPPSVSGAPGQRVTISCTGSSSNIGAHYDVHWYQQLPGTAPKLLIYGNSNRPSGVPDRFSGSKSGTSASLAITGLQAEDEADYYCQSYDSSLSGVLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 478 - protein, 214 aa, Artificial Sequence
  Synthetic polypeptide representing artificial human antibody VL chain
DIQMTQSPSSLSASVGDRVTITCRASQSISSYLNWYQQKPGKAPKFLIYAASSLQSGVPSRFSGSGSGTDFTLTISSLQPEDFATYYCQQSYSTPFTFGPGTKVDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 479 - protein, 214 aa, Artificial Sequence
  Synthetic polypeptide representing artificial human antibody VL chain
DIQMTQSPPSLSASVGDRVTITCQASQDISNYLNWYQQKPGKTPKLLIYAASTLETGVPSRFSGSGSGTDFTFTINSLQPEDIATYYCQQYDSLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 480 - protein, 216 aa, Artificial Sequence
  Synthetic polypeptide representing artificial human antibody VL chain
EIVLTQSPGTLSLSPGHRATLSCRASQDVASTYLAWYQQKPGQAPRLLIYGASSRATGIPDRFSGSGSGTDFTLTISRLEPEDFAVFYCQYYGGSPGFTFGPGTKVDFKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 481 - protein, 216 aa, Artificial Sequence
  Synthetic polypeptide representing artificial human antibody VL chain
QSALTQPASVSGSPGQSITISCTGTTSDVGTYNLVSWYQQLPGKAPKLIIYEVTKRPSGVSNRFSASKSGSTASLTISGLQAEDEADYYCCSYAGSSTYVFGSGARVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 482 - protein, 216 aa, Artificial Sequence
  Synthetic polypeptide representing artificial human antibody VL chain
EIVLTQSPGTLSLSPGETATLSCRASQSVANNYLAWHQQKPGQAPRLLIYGASKRAAGIPDRFSGSGSGTEFTLTISRLEPEDCAVYYCQEYVKSPGFAFGPGTRVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 483 - protein, 215 aa, Artificial Sequence
  Synthetic polypeptide representing artificial human antibody VL chain
EIVLTQSPATLSLSPGERATLSCRASQSVSSNYLAWYQQKPGQAPRLLIHGASSRATGFPDRFSGSGSGTDFTLTINRLEPEDFAVYYCQQYGTSPQTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 484 - protein, 216 aa, Artificial Sequence
  Synthetic polypeptide representing artificial human antibody VL chain
QTVVTQEPSFSVSPGGTVTFTCAWSSGSVSTSFYTSWYRQTPGQAPQTLIYNTNRRSSGVPDRFSGSILGNKAALTITGAQADDDSDYYCMLYMGSGISLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 485 - protein, 218 aa, Artificial Sequence
  Synthetic polypeptide representing artificial human antibody VL chain
QSVLTQPPSVSGAPGQRVTISCTGSSSNIGAQYDVHWYKVIPGTAPKLLIYGNDNRPSGVPDRFSGSKSGTSASLAITGLQSEDEADYYCQSNDISLSGSVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 486 - protein, 217 aa, Artificial Sequence
  Synthetic polypeptide representing artificial human antibody VL chain
PSVLTQPPSVSGAPGQRVTISCTGSSSNIGAGYDVHWYQQLPGTAPKLLIYANTNRPSGVPDRFSGSKSGTSASLAITGLQAEDEADYYCQSYDNSLSGGVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 487 - protein, 215 aa, Artificial Sequence
  Synthetic polypeptide representing artificial human antibody VL chain
KIVLTQSPGTLSLSPGERATLSCRASQSVSSSYLAWYQQRPGQSPRLLIYETSTRATGIPDRFSGSGSGTDFTLTISGLEPEDFAVYYCQQFDISPFTFGPGTKVDVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 488 - protein, 216 aa, Artificial Sequence
  Synthetic polypeptide representing artificial human antibody VL chain
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSSLVFGGGTKVTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 489 - protein, 110 aa, Artificial Sequence
  Synthetic polypeptide representing artificial human antibody VL chain
QSALTQPASVSGSPGQSITISCTGTSSDIGGYDLVSWYQHHPGKAPKLVISEGSKRPSGVSNRFFGSKSGNTASLTISGLQAEDEADYYCCSFTGTSTFVFGTGTKVTVL

SEQ ID NO: 490 - protein, 113 aa, Artificial Sequence
  Synthetic polypeptide representing artificial human antibody VL chain
DIVMTQSPDSLAVSLGERATINCKSSQSVLYSSNNKNYLAWYQQKPGQPPKLLIYWASTRESGVPDRFSGSGSGTDFTLTISSLEPEDFAVYYCQQYYSTPYTFGQGTKLEIK

SEQ ID NO: 491 - protein, 216 aa, Artificial Sequence
  Synthetic polypeptide representing artificial human antibody VL chain
QSVLTQPPSASGTPGQRVTISCSGSSSNIGSNTVNWYQQFPGTAPKLLIYSNNHRPLGVPDRFSGSKSGTSASLAISEVRSEDEADYYCATWDDSLNGGVFGAGTKLTVVGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 492 - protein, 215 aa, Artificial Sequence
  Synthetic polypeptide representing artificial human antibody VL chain
PAVVTQEPSLTVSPGGTVTLTCGSSTGVVTTGHYPYWFQQKPGQAPTTLIFDTSNKHSWTPARFSGSLLGGKAALTLSAAQPEDEADYYCWLISGGAPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 493 - protein, 111 aa, Artificial Sequence
  Synthetic polypeptide representing artificial human antibody VL chain
QSVLTQPPSVSGAPGQRVTISCAGSYSNIGAGYDVHWYRQLPGTAPTLLIYSNNNRPSGVSDRFSGSKSGTSASLAITGLQAEDEADYYCQSFDSSLSRSVFGTGTKVTVL

SEQ ID NO: 494 - protein, 107 aa, Artificial Sequence
  Synthetic polypeptide representing artificial human antibody VL chain
EIVLTQSPATLSFSPGDRATLSCRASQNINRFLAWYQQKPGQTPRLLIYDASTRATGIPARFSGSGSGTDFSLIISSLEPEDFAIYYCQQRNNWPITFGPGTKVDVK

SEQ ID NO: 495 - protein, 214 aa, Artificial Sequence
  Synthetic polypeptide representing artificial human antibody VL chain
AIQMTQSPSSLSASVGDRVTITCRASQGIRNDLGWYQQKPGKAPKLLIYAASSLQSGVPSRFSGSGSGTDFTLTISSLQPEDFATYYCLQDYNYPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKLYACEVTHQGLSSPVTKSFNRGEC

SEQ ID NO: 496 - protein, 108 aa, Artificial Sequence
  Synthetic polypeptide representing artificial human antibody VL chain
SSELTQDPAVSVALGQTVRITCQGDSLRTDYATWYQQKPGQAPILVFYGEDNRPSGIPDRFSGSSSGNTASLTITGAQAEDEADYYCNSRDSSGHHWVFGGGTKLTVL

SEQ ID NO: 497 - protein, 113 aa, Artificial Sequence
  Synthetic polypeptide representing artificial human antibody VL chain
DIVMTQSPDSLAVSLGERATLNCKSSQSVLSSYNNKDYLAWFQQKPGQPPQLLFYWASTRKTGVPDRFSGSGSGTDFTLTISSLQTEDVAVYYCQQYYSTPYTFGQGTKLEIK

SEQ ID NO: 498 - protein, 220 aa, Artificial Sequence
  Synthetic polypeptide representing artificial human antibody VL chain
DVVMTQSPLSLPVTLGQAASISCRSSQSLVYSDGNTYLNWFQQRPGQSPRRLIYKVSNRESGVPDRFSGSGSGTDFTLQISRVEAEDVGIYYCMQGAHWPPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 499 - protein, 107 aa, Artificial Sequence
  Synthetic polypeptide representing artificial human antibody VL chain
SYELTQPPSVSVSPGQTARITCSGDALPKKYVFWYQQRSGQAPVLVIYEDSKRPSGIPDRFSGSSSGTLATLTISGAQVEDEADYYCYSTDTIGNWVFGGGTRLTVL

SEQ ID NO: 500 - protein, 214 aa, Artificial Sequence
  Synthetic polypeptide representing artificial human antibody VL chain
LYVLTQPPSVSVAPGQTARITCGGNNIGSKSVHWYQQKPGQAPVLVVYDDSDRPSGIPERFSGSNSGNTATLTISRVEAGDEADYYCQVWDSSSDHWIFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 501 - protein, 214 aa, Artificial Sequence
  Synthetic polypeptide representing artificial human antibody VL chain
DIQMTQSPSSLSASVGDRVTITCRASQSISTYLNWYQQKPGKAPKLLIYAASNLQSGVPSTFSGSGSGTDFTLTISSLQPEDFATYYCQQSYSPPLTFGGGTTVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 502 - protein, 215 aa, Artificial Sequence
  Synthetic polypeptide representing artificial human antibody VL chain
EIVMTQSPATLSVSQGERATLSCRASQSVGSDLAWYQQKPGQAPRLLIYDASARATDIPARFSGSGSETEFTLTISSLQSEDFAVYYCQHYSDWRALTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 503 - protein, 220 aa, Artificial Sequence
  Synthetic polypeptide representing artificial human antibody VL chain
GIVMTQSPDSLAVSLGERATINCRSSQSVLYSSNNKNYLAWYQQKPGQPPKLLIYWASTRESGVPDRFSGSGSGTDFTLTISSLQAEDVAVYYCQQYYGPLWTFGQGTRVEIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 504 - protein, 214 aa, Artificial Sequence
  Synthetic polypeptide representing artificial human antibody VL chain
SDELTQPPSVSVSPGQTARITCSGDALAKEYAYWYQQKSGQAPVLVISKDTERPSGIPARFSGSSSGTTVTLTISGVQSDDEADYYCQSADSSLTYWLFGGGTKLTVLRQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 505 - protein, 106 aa, Artificial Sequence
  Synthetic polypeptide representing artificial human antibody VL chain
DIQMTQAPSTLSASVGDRVSITCRASQNIRDFLAWYQQKPGRAPDLLIYRASTLEKGVSARFSGSGSGTEFTLTITGLQPDDFATYYCQQYSDYSTFGGGTRVEIK

SEQ ID NO: 506 - protein, 220 aa, Artificial Sequence
  Synthetic polypeptide representing artificial human antibody VL chain
DIVMTQSPDSLAVSLGERATITCKSSQTILYSSNNKNYLAWYQQKPGQPPKLLIYWASTRESGVPDRFSGSGSGTDFTLTISSLQAEDVAVYYCHQYYTTPFTFGPGTTVDIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 507 - protein, 212 aa, Artificial Sequence
  Synthetic polypeptide representing artificial human antibody VL chain
SYELTQPPSVSVSPGQTASITCSGDKLGNKYVCWYQQKPGQSPVLVIYQDTKRPSGIPERFSGSKSGNTATLTISGTQALDEADYYCQAWDSSTAEFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 508 - protein, 216 aa, Artificial Sequence
  Synthetic polypeptide representing artificial human antibody VL chain
RSVLTQPPSASGTPGQTVTISCSGSRSNIGSNFVYWYQHLPGSAPKTTIHSNTQRPPGVPDRFSGSKSGTSASLAISGLRSEDEADYYCVTWDDDLHGWVFGGGTRLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 509 - protein, 218 aa, Artificial Sequence
  Synthetic polypeptide representing artificial human antibody VL chain
RSVLTQPPSVSAAPGQKVIISCSGSSSNIGNNYVSWYQQFLGTAPKLLIYDTDKRPSGIPDRFSGSKSGTSATLGITGLQTGDEAHYYCATWDSSLRAGPVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 510 - protein, 214 aa, Artificial Sequence
  Synthetic polypeptide representing artificial human antibody VL chain
DIQMTQSPSTLSASVGDRVTITCRASQSVSFWLAWYQQKPGKAPNLLISKASTLESGVPSRFSGSGSGTEFTLTISSLQPDDFATYYCQQYNAYPVTFGGGTKVEIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 511 - protein, 220 aa, Artificial Sequence
  Synthetic polypeptide representing artificial human antibody VL chain
GIVMIQSPDSLAVSLGERATINCKSSQSVFYSSNNKNYLAWYQQKPGQPPKLLIYWASTRESGVPDRFSGSGSGTDFTLTLTSLQAEDVAVYYCQQYYSTPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 512 - protein, 220 aa, Artificial Sequence
  Synthetic polypeptide representing artificial human antibody VL chain
DIVMTQSPDSLAVSLGERAAINCKSSQSVLYSSNNKNYLAWYQQRPGQPPKLLIHWASMRESGVPDRFSGSGSGTDFTLTISSLQAEDVAIYYCQQYYSPPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 513 - protein, 110 aa, Artificial Sequence
  Synthetic polypeptide representing artificial human antibody VL chain
QSALTQPASVSGSPGQSITISCTGSSNDIGRYKYVSWFQHHPGRAPKLIIYEVNNRPSGLSHRFSGSKSGNTASLTISGLQAEDEADYYCCSYTSSLTYVFGTGTAVTVL

SEQ ID NO: 514 - protein, 219 aa, Artificial Sequence
  Synthetic polypeptide representing artificial human antibody VL chain
DVVMTQSPLSLPVTLGQPASISCRSSQSLVYSDGNTYLNWFQQRPGQSPRRLIYKVSNRDSGVPDRFSGSGSGTDFTLKISRVEAEDVGVYYCMQGTHWPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 515 - protein, 212 aa, Artificial Sequence
  Synthetic polypeptide representing artificial human antibody VL chain
PYELTQPPSVSVSPGQTASITCSGDKLGDKYACWYQQKPGQSPVLVIYQDSKRPSGIPERFSGSNSGNTATLTISGTQAMDEADYYCQAWDSSTYVFGTGTKVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 516 - protein, 216 aa, Artificial Sequence
  Synthetic polypeptide representing artificial human antibody VL chain
ENVLTQSPGTLSLSPGERATLSCRASQRVNSNYLAWYQQKSGQAPRLLIYGASSRATGIPDRFSGSGSGTDFTLTISRLEPEDFAVYYCQQYGGSPLFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKLYACEVTHQGLSSPVTKSFNRGEC

SEQ ID NO: 517 - protein, 106 aa, Artificial Sequence
  Synthetic polypeptide representing artificial human antibody VL chain
PYELTQPPSVSVSPGQTASIACSGDNLGNKYAWWYRQKPGQSPVLVMYKDNKRPSGIPERFSGSNSGNTATLTISGTQAMDEADYYCQTWDSSTVIFGGGTKLTVQ

SEQ ID NO: 518 - protein, 219 aa, Artificial Sequence
  Synthetic polypeptide representing artificial human antibody VL chain
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 519 - protein, 216 aa, Artificial Sequence
  Synthetic polypeptide representing artificial human antibody VL chain
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGTGTKVTVLGQPKANPTVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 520 - protein, 213 aa, Artificial Sequence
  Synthetic polypeptide representing artificial human antibody VL chain
DIQMTQSPSTLSASVGDRVTITCRASQSISSWLAWYQQKPGKAPKLLIYKASSLESGVPSRFSGSGSGTEFTLTISSLQPDDFATYYCQQYNSYWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 521 - protein, 214 aa, Artificial Sequence
  Synthetic polypeptide representing artificial human antibody VL chain
DIQMTQSPSTLSASVGDRVTITCRASQSISSWLAWYQQKPGKAPKLLIYKASSLESGVPSRFSGSGSGTEFTLTISSLQPDDFATYYCQQYNSYPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 522 - protein, 218 aa, Artificial Sequence
  Synthetic polypeptide representing artificial human antibody VL chain
PAVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSGVFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 523 - protein, 213 aa, Artificial Sequence
  Synthetic polypeptide representing artificial human antibody VL chain
SYELTQPPSVSVSPGQTARITCSGDALPKQYAYWYQQKPGQAPVLVIYKDSERPSGIPERFSGSSSGTTVTLTISGVQAEDEADYYCQSADSSGTYVFGTGTKVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 524 - protein, 102 aa, Artificial Sequence
  Synthetic polypeptide representing artificial human antibody VL chain
DIQMTQSPSSLSASVGDRVTFTCRASQNIRNNLAWYQLKPGKAPQLLIYSASSLETGVPSRFSGSGSGTDFTLAISSLQPEDFATYYCQQAHGFPITFGQGS

SEQ ID NO: 525 - protein, 106 aa, Artificial Sequence
  Synthetic polypeptide representing artificial human antibody VL chain
EIVMTQSPATLSVSPGERATLSCRASQSVSSNLAWYQQKPGQAPRLLIYGASTRATGIPARFSGSGSGTEFTLTISSLQSEDFAIYYCQQYNSWPAFGGGTKVEIK

SEQ ID NO: 526 - protein, 214 aa, Artificial Sequence
  Synthetic polypeptide representing artificial human antibody VL chain
DIQMTQSPSSLSASVGDRVTITCRASQSISSYLNWYQQKPGKAPKLLIYAASSLQSGVPSRFSGSGSGTDFTLTVSSLQPEDFATYYCQQSYNTPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 527 - protein, 214 aa, Artificial Sequence
  Synthetic polypeptide representing artificial human antibody VL chain
DIQMTQSPSSLSASVGDRVTITCRASQSISTYLNWYQQKPGMAPKLLIYAASTLQSGVPSRFSGSGSATDYTLTISSLQPEDFATYYCQQSYNTPLTFGGGTKVDIKRTVAAPSVFIFPPSDEQLKSGTASVVCLLNNFYPREAKVQWKVDNALQSGNSQESVTEQDSKDSTYSLSSTLTLSKADYEKHKLYACEVTHQGLSSPVTKSFNRGEC

SEQ ID NO: 528 - protein, 216 aa, Artificial Sequence
  Synthetic polypeptide representing artificial human antibody VL chain
EIVLTQSPGTLSLSPGERATLSCRASQSVTSSYLAWYQQKPGQAPRLLIYGASSRATGIPDRFSGSGSGTDFTLTISRLEPEDFAVYYCQQYGSSPPNSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 529 - protein, 108 aa, Artificial Sequence
  Synthetic polypeptide representing artificial human antibody VL chain
SYVLTQPPSVSVAPGKTARITCGGNNIGSKSVHWYQQKPGQAPVLVIYYDRDRPSGIPERFSGSNSGNTATLTISRVEAGDEADYYCQVWDSSSDHPVFGGGTKLTVL

SEQ ID NO: 530 - protein, 217 aa, Artificial Sequence
  Synthetic polypeptide representing artificial human antibody VL chain
NFMLTQPHSVSESPGKTVTISCTRSSGSIADKYVHWYRQRPGSSPTIVIYEDKQRPSGVPDRVSGAIDTSSNSASLTISGLKTEDEADYYCQSYDSNTHWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 531 - protein, 219 aa, Artificial Sequence
  Synthetic polypeptide representing artificial human antibody VL chain
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALETPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 532 - protein, 213 aa, Artificial Sequence
  Synthetic polypeptide representing artificial human antibody VL chain
DIQMTQSPSTLSASVGDRVTITCRASQSISSWLAWYQQKPGKAPKLLIYKASSLESGVPSRFSGSGSGTEFTLTISSLQPDDFATYYCQQYNSYSTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 533 - protein, 219 aa, Artificial Sequence
  Synthetic polypeptide representing artificial human antibody VL chain
GIAMTQSPRSLPVTPGEPASISCRSSQSLLYRDGEHYLDWYLQKPGQSPHLLIYSGSNRASGVPDRFSGSGSGTDFTLIISRVEAEDAGVYYCMQALQPPYTFGQGTKLEITRTVAAPSVFIFPPSDEQLKSGTASVVCLLNNFYPREAKVQWKVDNALQSGNSQESVTEQDSKDSTYSLSSTLTLSKADYEKHKLYACEVTHQGLSSPVTKSFNRGEC

SEQ ID NO: 534 - protein, 215 aa, Artificial Sequence
  Synthetic polypeptide representing artificial human antibody VL chain
DIQMTQSPSSLPASVGDRVTITCRASQSISSYLNWYQKKPGKAPKLLIDAASSLQSGVPSRFSGSGSGTDFTLTISSLQPEDFATYYCQQSYSTPPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 535 - protein, 220 aa, Artificial Sequence
  Synthetic polypeptide representing artificial human antibody VL chain
DIVMTQSPDSLSLSLGERATINCKSSQSLLYSSNYKNYLAWYQQKPGQPPKLLIYWASTRESGVPDRFSGSGSGTDFTLTISSLQAEDVAVYYCQQYYLVPVTFGQGTRLDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 536 - protein, 217 aa, Artificial Sequence
  Synthetic polypeptide representing artificial human antibody VL chain
ASVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGPYVFGTGTKVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 537 - protein, 217 aa, Artificial Sequence
  Synthetic polypeptide representing artificial human antibody VL chain
QSALTQPPSASGSPGQSVTISCTGTSSDVGGYNYVSWYQQHPGKAPKLMIYEVSKRPSGVPDRFSGSKSGNTASLTVSGLQAEDEADYYCSSYAGSNNFYVFGTGTKVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 538 - protein, 218 aa, Artificial Sequence
  Synthetic polypeptide representing artificial human antibody VL chain
QSVLTQPPSVSGAPGQRVTISCTGSNSNIGAGYDVHWYQQLPGAAPKLLIYGNGNRPSGVPDRFSGSKSDTSASLAITGLQADDEADYYCQSYDSSLSGSMIFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 539 - protein, 220 aa, Artificial Sequence
  Synthetic polypeptide representing artificial human antibody VL chain
LPVLTQPPSSSASPGESARLTCTLPSDINVTNYNIYWYQQKPGSPPRYLLYQYSDSDKGQVSGVPSRFSGSKDASANTGILLISGLQSEDEADYYCMIWSSLVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 540 - protein, 219 aa, Artificial Sequence
  Synthetic polypeptide representing artificial human antibody VL chain
DIVMTQSPLSLPVTPGEPASISCRSSQSLLHSDGYNYLDWFLQKPGQSPQLLIYLGSYRASGVPDRFSGSGSGTDFTLKITRVEAEDVGVYYCMQALQTPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 541 - protein, 214 aa, Artificial Sequence
  Synthetic polypeptide representing artificial human antibody VL chain
VIQMTQSPSSLSASVGDRVTIACRASQGIRNDLGWYQQKPGRAPKLLIYAASTLQSGVPSRFSGSGSGTDFTLTIYSLQPEDFATYYCLQNYNYPWTFGQGTKVEIQGTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 542 - protein, 219 aa, Artificial Sequence
  Synthetic polypeptide representing artificial human antibody VL chain
DIVMTQTPLSLSVTPGQPASISCKSSQSLLHSDGKTYLYWYLQKPGQSPQLLIYEVSSRFSGVPDRFSGSGSGTDFTLKISRVEAEDVGVYYCMQGIHLPRTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 543 - protein, 8 aa, Artificial Sequence
  Synthetic polypeptide representing artificial human antibody CDR-H1 region
EVTFNTYG

SEQ ID NO: 544 - protein, 8 aa, Artificial Sequence
  Synthetic polypeptide representing artificial human antibody CDR-H1 region
GFTFSSYW

SEQ ID NO: 545 - protein, 8 aa, Artificial Sequence
  Synthetic polypeptide representing artificial human antibody CDR-H1 region
GFTFEDYA

SEQ ID NO: 546 - protein, 10 aa, Artificial Sequence
  Synthetic polypeptide representing artificial human antibody CDR-H1 region
GFSLSTSGVG

SEQ ID NO: 547 - protein, 8 aa, Artificial Sequence
  Synthetic polypeptide representing artificial human antibody CDR-H1 region
GYTFTTYY

SEQ ID NO: 548 - protein, 8 aa, Artificial Sequence
  Synthetic polypeptide representing artificial human antibody CDR-H1 region
GFVFDDYA

SEQ ID NO: 549 - protein, 8 aa, Artificial Sequence
  Synthetic polypeptide representing artificial human antibody CDR-H1 region
GYTFTNYG

SEQ ID NO: 550 - protein, 8 aa, Artificial Sequence
  Synthetic polypeptide representing artificial human antibody CDR-H1 region
GFTFDDYA

SEQ ID NO: 551 - protein, 8 aa, Artificial Sequence
  Synthetic polypeptide representing artificial human antibody CDR-H1 region
GFTFSYYG

SEQ ID NO: 552 - protein, 8 aa, Artificial Sequence
  Synthetic polypeptide representing artificial human antibody CDR-H1 region
GFPFGDYA

SEQ ID NO: 553 - protein, 8 aa, Artificial Sequence
  Synthetic polypeptide representing artificial human antibody CDR-H1 region
GYIDINNG

SEQ ID NO: 554 - protein, 8 aa, Artificial Sequence
  Synthetic polypeptide representing artificial human antibody CDR-H1 region
GFTFTRHG

SEQ ID NO: 555 - protein, 8 aa, Artificial Sequence
  Synthetic polypeptide representing artificial human antibody CDR-H1 region
RFTFSSYA

SEQ ID NO: 556 - protein, 10 aa, Artificial Sequence
  Synthetic polypeptide representing artificial human antibody CDR-H1 region
GDGVSSNSAS

SEQ ID NO: 557 - protein, 8 aa, Artificial Sequence
  Synthetic polypeptide representing artificial human antibody CDR-H1 region
GFAFSSNG

SEQ ID NO: 558 - protein, 8 aa, Artificial Sequence
  Synthetic polypeptide representing artificial human antibody CDR-H1 region
GITFSSYD

SEQ ID NO: 559 - protein, 8 aa, Artificial Sequence
  Synthetic polypeptide representing artificial human antibody CDR-H1 region
GYNFTNYG

SEQ ID NO: 560 - protein, 8 aa, Artificial Sequence
  Synthetic polypeptide representing artificial human antibody CDR-H1 region
GFSFRSYE

SEQ ID NO: 561 - protein, 8 aa, Artificial Sequence
  Synthetic polypeptide representing artificial human antibody CDR-H1 region
GYIFTSYA

SEQ ID NO: 562 - protein, 9 aa, Artificial Sequence
  Synthetic polypeptide representing artificial human antibody CDR-H1 region
GYLISSGYY

SEQ ID NO: 563 - protein, 10 aa, Artificial Sequence
  Synthetic polypeptide representing artificial human antibody CDR-H1 region
GFSLNTSGVG

SEQ ID NO: 564 - protein, 8 aa, Artificial Sequence
  Synthetic polypeptide representing artificial human antibody CDR-H1 region
GFTFSNYS

SEQ ID NO: 565 - protein, 8 aa, Artificial Sequence
  Synthetic polypeptide representing artificial human antibody CDR-H1 region
GFTFSSYS

SEQ ID NO: 566 - protein, 8 aa, Artificial Sequence
  Synthetic polypeptide representing artificial human antibody CDR-H1 region
GDSMSFYY

SEQ ID NO: 567 - protein, 10 aa, Artificial Sequence
  Synthetic polypeptide representing artificial human antibody CDR-H1 region
GGSISSGSYY

SEQ ID NO: 568 - protein, 8 aa, Artificial Sequence
  Synthetic polypeptide representing artificial human antibody CDR-H1 region
GFSFSSYS

SEQ ID NO: 569 - protein, 10 aa, Artificial Sequence
  Synthetic polypeptide representing artificial human antibody CDR-H1 region
GGSISRSPYF

SEQ ID NO: 570 - protein, 8 aa, Artificial Sequence
  Synthetic polypeptide representing artificial human antibody CDR-H1 region
GFTFTSYG

SEQ ID NO: 571 - protein, 8 aa, Artificial Sequence
  Synthetic polypeptide representing artificial human antibody CDR-H1 region
SGSSGSYY

SEQ ID NO: 572 - protein, 8 aa, Artificial Sequence
  Synthetic polypeptide representing artificial human antibody CDR-H1 region
GYNFRDYY

SEQ ID NO: 573 - protein, 10 aa, Artificial Sequence
  Synthetic polypeptide representing artificial human antibody CDR-H1 region
GGSINSGDYH

SEQ ID NO: 574 - protein, 10 aa, Artificial Sequence
  Synthetic polypeptide representing artificial human antibody CDR-H1 region
GGSISSSGYY

SEQ ID NO: 575 - protein, 8 aa, Artificial Sequence
  Synthetic polypeptide representing artificial human antibody CDR-H1 region
GFTFSSYG

SEQ ID NO: 576 - protein, 10 aa, Artificial Sequence
  Synthetic polypeptide representing artificial human antibody CDR-H1 region
GFSLTTSGVG

SEQ ID NO: 577 - protein, 8 aa, Artificial Sequence
  Synthetic polypeptide representing artificial human antibody CDR-H1 region
GFTFSTYE

SEQ ID NO: 578 - protein, 8 aa, Artificial Sequence
  Synthetic polypeptide representing artificial human antibody CDR-H1 region
GGTFSSYA

SEQ ID NO: 579 - protein, 10 aa, Artificial Sequence
  Synthetic polypeptide representing artificial human antibody CDR-H1 region
GGSISSDNYY

SEQ ID NO: 580 - protein, 8 aa, Artificial Sequence
  Synthetic polypeptide representing artificial human antibody CDR-H1 region
GASISSYY

SEQ ID NO: 581 - protein, 8 aa, Artificial Sequence
  Synthetic polypeptide representing artificial human antibody CDR-H1 region
GNTFTTYT

SEQ ID NO: 582 - protein, 8 aa, Artificial Sequence
  Synthetic polypeptide representing artificial human antibody CDR-H1 region
GFTFSSYA

SEQ ID NO: 583 - protein, 8 aa, Artificial Sequence
  Synthetic polypeptide representing artificial human antibody CDR-H1 region
GFTFDDYG

SEQ ID NO: 584 - protein, 8 aa, Artificial Sequence
  Synthetic polypeptide representing artificial human antibody CDR-H1 region
GFTFSSYG

SEQ ID NO: 585 - protein, 10 aa, Artificial Sequence
  Synthetic polypeptide representing artificial human antibody CDR-H1 region
GGSISSGGYY

SEQ ID NO: 586 - protein, 8 aa, Artificial Sequence
  Synthetic polypeptide representing artificial human antibody CDR-H1 region
GYTFTGYY

SEQ ID NO: 587 - protein, 8 aa, Artificial Sequence
  Synthetic polypeptide representing artificial human antibody CDR-H1 region
GFTFSSYD

SEQ ID NO: 588 - protein, 8 aa, Artificial Sequence
  Synthetic polypeptide representing artificial human antibody CDR-H1 region
GFTFRSYG

SEQ ID NO: 589 - protein, 8 aa, Artificial Sequence
  Synthetic polypeptide representing artificial human antibody CDR-H1 region
GFTFSDYY

SEQ ID NO: 590 - protein, 8 aa, Artificial Sequence
  Synthetic polypeptide representing artificial human antibody CDR-H1 region
GFTFSSYH

SEQ ID NO: 591 - protein, 8 aa, Artificial Sequence
  Synthetic polypeptide representing artificial human antibody CDR-H1 region
GFTFSSYA

SEQ ID NO: 592 - protein, 8 aa, Artificial Sequence
  Synthetic polypeptide representing artificial human antibody CDR-H1 region
GFTLEEFA

SEQ ID NO: 593 - protein, 8 aa, Artificial Sequence
  Synthetic polypeptide representing artificial human antibody CDR-H1 region
GGSISDYY

SEQ ID NO: 594 - protein, 8 aa, Artificial Sequence
  Synthetic polypeptide representing artificial human antibody CDR-H1 region
GGTFSSYA

SEQ ID NO: 595 - protein, 8 aa, Artificial Sequence
  Synthetic polypeptide representing artificial human antibody CDR-H1 region
GYTFSSYG

SEQ ID NO: 596 - protein, 8 aa, Artificial Sequence
  Synthetic polypeptide representing artificial human antibody CDR-H1 region
GFTFRSYE

SEQ ID NO: 597 - protein, 8 aa, Artificial Sequence
  Synthetic polypeptide representing artificial human antibody CDR-H1 region
GGTFSSYA

SEQ ID NO: 598 - protein, 8 aa, Artificial Sequence
  Synthetic polypeptide representing artificial human antibody CDR-H1 region
GDSFNKYF

SEQ ID NO: 599 - protein, 8 aa, Artificial Sequence
  Synthetic polypeptide representing artificial human antibody CDR-H1 region
GFTFSTYG

SEQ ID NO: 600 - protein, 8 aa, Artificial Sequence
  Synthetic polypeptide representing artificial human antibody CDR-H1 region
GFAFSSYA

SEQ ID NO: 601 - protein, 8 aa, Artificial Sequence
  Synthetic polypeptide representing artificial human antibody CDR-H1 region
GFTFSNHA

SEQ ID NO: 602 - protein, 8 aa, Artificial Sequence
  Synthetic polypeptide representing artificial human antibody CDR-H1 region
GFTFSSHG

SEQ ID NO: 603 - protein, 10 aa, Artificial Sequence
  Synthetic polypeptide representing artificial human antibody CDR-H1 region
GGSVDNVDSY

SEQ ID NO: 604 - protein, 8 aa, Artificial Sequence
  Synthetic polypeptide representing artificial human antibody CDR-H1 region
GYSFTTYW

SEQ ID NO: 605 - protein, 10 aa, Artificial Sequence
  Synthetic polypeptide representing artificial human antibody CDR-H1 region
GDSISSGSYY

SEQ ID NO: 606 - protein, 10 aa, Artificial Sequence
  Synthetic polypeptide representing artificial human antibody CDR-H1 region
GDSVSSNSAA

SEQ ID NO: 607 - protein, 8 aa, Artificial Sequence
  Synthetic polypeptide representing artificial human antibody CDR-H1 region
GYTLSELS

SEQ ID NO: 608 - protein, 8 aa, Artificial Sequence
  Synthetic polypeptide representing artificial human antibody CDR-H1 region
GFTFSSYS

SEQ ID NO: 609 - protein, 8 aa, Artificial Sequence
  Synthetic polypeptide representing artificial human antibody CDR-H1 region
GFTFSNYA

SEQ ID NO: 610 - protein, 8 aa, Artificial Sequence
  Synthetic polypeptide representing artificial human antibody CDR-H1 region
GGPFSSYT

SEQ ID NO: 611 - protein, 10 aa, Artificial Sequence
  Synthetic polypeptide representing artificial human antibody CDR-H1 region
GGSVNTGTSY

SEQ ID NO: 612 - protein, 8 aa, Artificial Sequence
  Synthetic polypeptide representing artificial human antibody CDR-H1 region
GFHFGSHG

SEQ ID NO: 613 - protein, 10 aa, Artificial Sequence
  Synthetic polypeptide representing artificial human antibody CDR-H1 region
GGSITTGSYY

SEQ ID NO: 614 - protein, 8 aa, Artificial Sequence
  Synthetic polypeptide representing artificial human antibody CDR-H1 region
GFTFDDYA

SEQ ID NO: 615 - protein, 8 aa, Artificial Sequence
  Synthetic polypeptide representing artificial human antibody CDR-H1 region
GASMNNYY

SEQ ID NO: 616 - protein, 10 aa, Artificial Sequence
  Synthetic polypeptide representing artificial human antibody CDR-H1 region
GFSLTTTDVG

SEQ ID NO: 617 - protein, 8 aa, Artificial Sequence
  Synthetic polypeptide representing artificial human antibody CDR-H1 region
GFTFSSYS

SEQ ID NO: 618 - protein, 8 aa, Artificial Sequence
  Synthetic polypeptide representing artificial human antibody CDR-H1 region
GYNFISHW

SEQ ID NO: 619 - protein, 8 aa, Artificial Sequence
  Synthetic polypeptide representing artificial human antibody CDR-H1 region
GYSFTSFW

SEQ ID NO: 620 - protein, 8 aa, Artificial Sequence
  Synthetic polypeptide representing artificial human antibody CDR-H1 region
GGSIDSYY

SEQ ID NO: 621 - protein, 8 aa, Artificial Sequence
  Synthetic polypeptide representing artificial human antibody CDR-H1 region
GGIFSYFA

SEQ ID NO: 622 - protein, 8 aa, Artificial Sequence
  Synthetic polypeptide representing artificial human antibody CDR-H1 region
EFSFQYFS

SEQ ID NO: 623 - protein, 9 aa, Artificial Sequence
  Synthetic polypeptide representing artificial human antibody CDR-H1 region
GYTLNNDVA

SEQ ID NO: 624 - protein, 8 aa, Artificial Sequence
  Synthetic polypeptide representing artificial human antibody CDR-H1 region
GFRFNYYW

SEQ ID NO: 625 - protein, 10 aa, Artificial Sequence
  Synthetic polypeptide representing artificial human antibody CDR-H1 region
GGSISGDKNF

SEQ ID NO: 626 - protein, 8 aa, Artificial Sequence
  Synthetic polypeptide representing artificial human antibody CDR-H1 region
GFTFSDYE

SEQ ID NO: 627 - protein, 8 aa, Artificial Sequence
  Synthetic polypeptide representing artificial human antibody CDR-H1 region
GFPPRSFA

SEQ ID NO: 628 - protein, 8 aa, Artificial Sequence
  Synthetic polypeptide representing artificial human antibody CDR-H1 region
GFTFSNYG

SEQ ID NO: 629 - protein, 8 aa, Artificial Sequence
  Synthetic polypeptide representing artificial human antibody CDR-H1 region
GFTFDDYT

SEQ ID NO: 630 - protein, 8 aa, Artificial Sequence
  Synthetic polypeptide representing artificial human antibody CDR-H1 region
GDTFPNYV

SEQ ID NO: 631 - protein, 8 aa, Artificial Sequence
  Synthetic polypeptide representing artificial human antibody CDR-H1 region
GFTFDDYA

SEQ ID NO: 632 - protein, 8 aa, Artificial Sequence
  Synthetic polypeptide representing artificial human antibody CDR-H1 region
GFTFSSYA

SEQ ID NO: 633 - protein, 8 aa, Artificial Sequence
  Synthetic polypeptide representing artificial human antibody CDR-H1 region
GFTFSNYD

SEQ ID NO: 634 - protein, 8 aa, Artificial Sequence
  Synthetic polypeptide representing artificial human antibody CDR-H1 region
GFTFSPYS

SEQ ID NO: 635 - protein, 10 aa, Artificial Sequence
  Synthetic polypeptide representing artificial human antibody CDR-H1 region
GGSITSGSYF

SEQ ID NO: 636 - protein, 10 aa, Artificial Sequence
  Synthetic polypeptide representing artificial human antibody CDR-H1 region
GGSVSSSSYY

SEQ ID NO: 637 - protein, 8 aa, Artificial Sequence
  Synthetic polypeptide representing artificial human antibody CDR-H1 region
GFTFSNYD

SEQ ID NO: 638 - protein, 8 aa, Artificial Sequence
  Synthetic polypeptide representing artificial human antibody CDR-H1 region
GYAFIGNW

SEQ ID NO: 639 - protein, 10 aa, Artificial Sequence
  Synthetic polypeptide representing artificial human antibody CDR-H1 region
GFTFSFSSYA

SEQ ID NO: 640 - protein, 8 aa, Artificial Sequence
  Synthetic polypeptide representing artificial human antibody CDR-H1 region
GFTFNNYE

SEQ ID NO: 641 - protein, 8 aa, Artificial Sequence
  Synthetic polypeptide representing artificial human antibody CDR-H1 region
GFTFSSNW

SEQ ID NO: 642 - protein, 10 aa, Artificial Sequence
  Synthetic polypeptide representing artificial human antibody CDR-H1 region
GGSISSGGYY

SEQ ID NO: 643 - protein, 8 aa, Artificial Sequence
  Synthetic polypeptide representing artificial human antibody CDR-H1 region
GFTFSSYG

SEQ ID NO: 644 - protein, 8 aa, Artificial Sequence
  Synthetic polypeptide representing artificial human antibody CDR-H1 region
GFTFSDYY

SEQ ID NO: 645 - protein, 10 aa, Artificial Sequence
  Synthetic polypeptide representing artificial human antibody CDR-H1 region
GGSISSGGYP

SEQ ID NO: 646 - protein, 8 aa, Artificial Sequence
  Synthetic polypeptide representing artificial human antibody CDR-H1 region
GGSISIYY

SEQ ID NO: 647 - protein, 8 aa, Artificial Sequence
  Synthetic polypeptide representing artificial human antibody CDR-H1 region
NSSISSYY

SEQ ID NO: 648 - protein, 8 aa, Artificial Sequence
  Synthetic polypeptide representing artificial human antibody CDR-H1 region
GFTFNSYW

SEQ ID NO: 649 - protein, 8 aa, Artificial Sequence
  Synthetic polypeptide representing artificial human antibody CDR-H1 region
GFTFDDYA

SEQ ID NO: 650 - protein, 8 aa, Artificial Sequence
  Synthetic polypeptide representing artificial human antibody CDR-H1 region
GYRFNAYW

SEQ ID NO: 651 - protein, 10 aa, Artificial Sequence
  Synthetic polypeptide representing artificial human antibody CDR-H1 region
GDSVSSTSGA

SEQ ID NO: 652 - protein, 10 aa, Artificial Sequence
  Synthetic polypeptide representing artificial human antibody CDR-H1 region
GDSVSSNSAA

SEQ ID NO: 653 - protein, 8 aa, Artificial Sequence
  Synthetic polypeptide representing artificial human antibody CDR-H1 region
GGSISSYY

SEQ ID NO: 654 - protein, 8 aa, Artificial Sequence
  Synthetic polypeptide representing artificial human antibody CDR-H1 region
GYSFTSYW

SEQ ID NO: 655 - protein, 8 aa, Artificial Sequence
  Synthetic polypeptide representing artificial human antibody CDR-H1 region
GFTFSSYG

SEQ ID NO: 656 - protein, 8 aa, Artificial Sequence
  Synthetic polypeptide representing artificial human antibody CDR-H1 region
GFTFRSYS

SEQ ID NO: 657 - protein, 8 aa, Artificial Sequence
  Synthetic polypeptide representing artificial human antibody CDR-H1 region
GGTFSSYT

SEQ ID NO: 658 - protein, 8 aa, Artificial Sequence
  Synthetic polypeptide representing artificial human antibody CDR-H1 region
GFSFSRYN

SEQ ID NO: 659 - protein, 8 aa, Artificial Sequence
  Synthetic polypeptide representing artificial human antibody CDR-H1 region
GFTFTNYA

SEQ ID NO: 660 - protein, 8 aa, Artificial Sequence
  Synthetic polypeptide representing artificial human antibody CDR-H1 region
GFSFSSFG

SEQ ID NO: 661 - protein, 8 aa, Artificial Sequence
  Synthetic polypeptide representing artificial human antibody CDR-H1 region
GFTFSSYA

SEQ ID NO: 662 - protein, 8 aa, Artificial Sequence
  Synthetic polypeptide representing artificial human antibody CDR-H1 region
GFTFSSHG

SEQ ID NO: 663 - protein, 8 aa, Artificial Sequence
  Synthetic polypeptide representing artificial human antibody CDR-H1 region
GFSFSTYW

SEQ ID NO: 664 - protein, 8 aa, Artificial Sequence
  Synthetic polypeptide representing artificial human antibody CDR-H1 region
GFTFNNYW

SEQ ID NO: 665 - protein, 8 aa, Artificial Sequence
  Synthetic polypeptide representing artificial human antibody CDR-H1 region
GFTFSHGW

SEQ ID NO: 666 - protein, 8 aa, Artificial Sequence
  Synthetic polypeptide representing artificial human antibody CDR-H1 region
GGSIRNDY

SEQ ID NO: 667 - protein, 8 aa, Artificial Sequence
  Synthetic polypeptide representing artificial human antibody CDR-H1 region
GGTFSSYA

SEQ ID NO: 668 - protein, 10 aa, Artificial Sequence
  Synthetic polypeptide representing artificial human antibody CDR-H1 region
GGSISSSNYF

SEQ ID NO: 669 - protein, 8 aa, Artificial Sequence
  Synthetic polypeptide representing artificial human antibody CDR-H1 region
GFTFSDYW

SEQ ID NO: 670 - protein, 10 aa, Artificial Sequence
  Synthetic polypeptide representing artificial human antibody CDR-H1 region
DVSIISSFYY

SEQ ID NO: 671 - protein, 10 aa, Artificial Sequence
  Synthetic polypeptide representing artificial human antibody CDR-H1 region
GASVSSGSYY

SEQ ID NO: 672 - protein, 8 aa, Artificial Sequence
  Synthetic polypeptide representing artificial human antibody CDR-H1 region
GGTFSGYG

SEQ ID NO: 673 - protein, 8 aa, Artificial Sequence
  Synthetic polypeptide representing artificial human antibody CDR-H1 region
GFTFSSYW

SEQ ID NO: 674 - protein, 10 aa, Artificial Sequence
  Synthetic polypeptide representing artificial human antibody CDR-H1 region
GGSISSGDYY

SEQ ID NO: 675 - protein, 8 aa, Artificial Sequence
  Synthetic polypeptide representing artificial human antibody CDR-H1 region
GFTFSSYA

SEQ ID NO: 676 - protein, 8 aa, Artificial Sequence
  Synthetic polypeptide representing artificial human antibody CDR-H1 region
GFTFSSYA

SEQ ID NO: 677 - protein, 8 aa, Artificial Sequence
  Synthetic polypeptide representing artificial human antibody CDR-H1 region
GFTLSSYA

SEQ ID NO: 678 - protein, 10 aa, Artificial Sequence
  Synthetic polypeptide representing artificial human antibody CDR-H1 region
GGSISSGGYS

SEQ ID NO: 679 - protein, 8 aa, Artificial Sequence
  Synthetic polypeptide representing artificial human antibody CDR-H1 region
GFTFSNSA

SEQ ID NO: 680 - protein, 8 aa, Artificial Sequence
  Synthetic polypeptide representing artificial human antibody CDR-H1 region
GYTFTSHY

SEQ ID NO: 681 - protein, 8 aa, Artificial Sequence
  Synthetic polypeptide representing artificial human antibody CDR-H1 region
GFTFSAYW

SEQ ID NO: 682 - protein, 8 aa, Artificial Sequence
  Synthetic polypeptide representing artificial human antibody CDR-H1 region
GYSLTEIS

SEQ ID NO: 683 - protein, 10 aa, Artificial Sequence
  Synthetic polypeptide representing artificial human antibody CDR-H1 region
GGSIRSSAPF

SEQ ID NO: 684 - protein, 8 aa, Artificial Sequence
  Synthetic polypeptide representing artificial human antibody CDR-H1 region
GYIFTTYV

SEQ ID NO: 685 - protein, 8 aa, Artificial Sequence
  Synthetic polypeptide representing artificial human antibody CDR-H1 region
GFTFDDYA

SEQ ID NO: 686 - protein, 8 aa, Artificial Sequence
  Synthetic polypeptide representing artificial human antibody CDR-H1 region
GFTFNNYW

SEQ ID NO: 687 - protein, 8 aa, Artificial Sequence
  Synthetic polypeptide representing artificial human antibody CDR-H1 region
GDSVSSFY

SEQ ID NO: 688 - protein, 8 aa, Artificial Sequence
  Synthetic polypeptide representing artificial human antibody CDR-H1 region
GYNFNDDR

SEQ ID NO: 689 - protein, 8 aa, Artificial Sequence
  Synthetic polypeptide representing artificial human antibody CDR-H1 region
GFTVSTNY

SEQ ID NO: 690 - protein, 8 aa, Artificial Sequence
  Synthetic polypeptide representing artificial human antibody CDR-H1 region
GFTFSDHY

SEQ ID NO: 691 - protein, 8 aa, Artificial Sequence
  Synthetic polypeptide representing artificial human antibody CDR-H1 region
GFTFRDYG

SEQ ID NO: 692 - protein, 8 aa, Artificial Sequence
  Synthetic polypeptide representing artificial human antibody CDR-H1 region
GFDIRSYT

SEQ ID NO: 693 - protein, 8 aa, Artificial Sequence
  Synthetic polypeptide representing artificial human antibody CDR-H1 region
GYTFTDYY

SEQ ID NO: 694 - protein, 8 aa, Artificial Sequence
  Synthetic polypeptide representing artificial human antibody CDR-H1 region
GFTFSNYA

SEQ ID NO: 695 - protein, 8 aa, Artificial Sequence
  Synthetic polypeptide representing artificial human antibody CDR-H1 region
GFNFNSYT

SEQ ID NO: 696 - protein, 8 aa, Artificial Sequence
  Synthetic polypeptide representing artificial human antibody CDR-H1 region
GFTFDDYA

SEQ ID NO: 697 - protein, 8 aa, Artificial Sequence
  Synthetic polypeptide representing artificial human antibody CDR-H1 region
GGTFSSYG

SEQ ID NO: 698 - protein, 8 aa, Artificial Sequence
  Synthetic polypeptide representing artificial human antibody CDR-H1 region
GLTFNRFA

SEQ ID NO: 699 - protein, 9 aa, Artificial Sequence
  Synthetic polypeptide representing artificial human antibody CDR-H1 region
GYSISTAYY

SEQ ID NO: 700 - protein, 8 aa, Artificial Sequence
  Synthetic polypeptide representing artificial human antibody CDR-H1 region
GGNVRSYS

SEQ ID NO: 701 - protein, 8 aa, Artificial Sequence
  Synthetic polypeptide representing artificial human antibody CDR-H1 region
GDSISSNY

SEQ ID NO: 702 - protein, 8 aa, Artificial Sequence
  Synthetic polypeptide representing artificial human antibody CDR-H1 region
GYRFSNFG

SEQ ID NO: 703 - protein, 8 aa, Artificial Sequence
  Synthetic polypeptide representing artificial human antibody CDR-H1 region
GYTFTNYA

SEQ ID NO: 704 - protein, 10 aa, Artificial Sequence
  Synthetic polypeptide representing artificial human antibody CDR-H1 region
GDSISSSSYF

SEQ ID NO: 705 - protein, 8 aa, Artificial Sequence
  Synthetic polypeptide representing artificial human antibody CDR-H1 region
GFTFSNYG

SEQ ID NO: 706 - protein, 8 aa, Artificial Sequence
  Synthetic polypeptide representing artificial human antibody CDR-H1 region
GGSFNTYA

SEQ ID NO: 707 - protein, 8 aa, Artificial Sequence
  Synthetic polypeptide representing artificial human antibody CDR-H1 region
GDTFTSFA

SEQ ID NO: 708 - protein, 10 aa, Artificial Sequence
  Synthetic polypeptide representing artificial human antibody CDR-H1 region
GDSISNGDYC

SEQ ID NO: 709 - protein, 8 aa, Artificial Sequence
  Synthetic polypeptide representing artificial human antibody CDR-H1 region
GFTFRSYW

SEQ ID NO: 710 - protein, 8 aa, Artificial Sequence
  Synthetic polypeptide representing artificial human antibody CDR-H1 region
GFTYDSYV

SEQ ID NO: 711 - protein, 10 aa, Artificial Sequence
  Synthetic polypeptide representing artificial human antibody CDR-H1 region
SGSVSSGSHY

SEQ ID NO: 712 - protein, 8 aa, Artificial Sequence
  Synthetic polypeptide representing artificial human antibody CDR-H1 region
GYSFTGYY

SEQ ID NO: 713 - protein, 8 aa, Artificial Sequence
  Synthetic polypeptide representing artificial human antibody CDR-H1 region
GFTFSNYG

SEQ ID NO: 714 - protein, 8 aa, Artificial Sequence
  Synthetic polypeptide representing artificial human antibody CDR-H1 region
GFTFSNYN

SEQ ID NO: 715 - protein, 10 aa, Artificial Sequence
  Synthetic polypeptide representing artificial human antibody CDR-H1 region
GGSISSSSYY

SEQ ID NO: 716 - protein, 8 aa, Artificial Sequence
  Synthetic polypeptide representing artificial human antibody CDR-H1 region
GFTFSNAW

SEQ ID NO: 717 - protein, 8 aa, Artificial Sequence
  Synthetic polypeptide representing artificial human antibody CDR-H1 region
GYTFTNYF

SEQ ID NO: 718 - protein, 8 aa, Artificial Sequence
  Synthetic polypeptide representing artificial human antibody CDR-H1 region
GGTFNNYG

SEQ ID NO: 719 - protein, 8 aa, Artificial Sequence
  Synthetic polypeptide representing artificial human antibody CDR-H1 region
GFTFSSYE

SEQ ID NO: 720 - protein, 8 aa, Artificial Sequence
  Synthetic polypeptide representing artificial human antibody CDR-H1 region
GFTFTTYA

SEQ ID NO: 721 - protein, 8 aa, Artificial Sequence
  Synthetic polypeptide representing artificial human antibody CDR-H1 region
GYTFTSYW

SEQ ID NO: 722 - protein, 8 aa, Artificial Sequence
  Synthetic polypeptide representing artificial human antibody CDR-H1 region
GLTFSIYS

SEQ ID NO: 723 - protein, 10 aa, Artificial Sequence
  Synthetic polypeptide representing artificial human antibody CDR-H1 region
GFSLSNARMG

SEQ ID NO: 724 - protein, 8 aa, Artificial Sequence
  Synthetic polypeptide representing artificial human antibody CDR-H1 region
GYTFTVYY

SEQ ID NO: 725 - protein, 8 aa, Artificial Sequence
  Synthetic polypeptide representing artificial human antibody CDR-H1 region
GYTFTSYG

SEQ ID NO: 726 - protein, 10 aa, Artificial Sequence
  Synthetic polypeptide representing artificial human antibody CDR-H1 region
GDSVSSTSAA

SEQ ID NO: 727 - protein, 9 aa, Artificial Sequence
  Synthetic polypeptide representing artificial human antibody CDR-H1 region
GGSISSSNC

SEQ ID NO: 728 - protein, 8 aa, Artificial Sequence
  Synthetic polypeptide representing artificial human antibody CDR-H1 region
GFTVSSNY

SEQ ID NO: 729 - protein, 8 aa, Artificial Sequence
  Synthetic polypeptide representing artificial human antibody CDR-H1 region
GYTFTTYY

SEQ ID NO: 730 - protein, 10 aa, Artificial Sequence
  Synthetic polypeptide representing artificial human antibody CDR-H1 region
GGSVSSGSYY

SEQ ID NO: 731 - protein, 10 aa, Artificial Sequence
  Synthetic polypeptide representing artificial human antibody CDR-H1 region
GGSISSSFFY

SEQ ID NO: 732 - protein, 8 aa, Artificial Sequence
  Synthetic polypeptide representing artificial human antibody CDR-H1 region
GFTFSSYA

SEQ ID NO: 733 - protein, 8 aa, Artificial Sequence
  Synthetic polypeptide representing artificial human antibody CDR-H1 region
GFTFSTYV

SEQ ID NO: 734 - protein, 10 aa, Artificial Sequence
  Synthetic polypeptide representing artificial human antibody CDR-H1 region
GGSISSSSYY

SEQ ID NO: 735 - protein, 8 aa, Artificial Sequence
  Synthetic polypeptide representing artificial human antibody CDR-H1 region
GYTFTGYY

SEQ ID NO: 736 - protein, 8 aa, Artificial Sequence
  Synthetic polypeptide representing artificial human antibody CDR-H1 region
GYSFTSYW

SEQ ID NO: 737 - protein, 8 aa, Artificial Sequence
  Synthetic polypeptide representing artificial human antibody CDR-H1 region
GYSFTTYW

SEQ ID NO: 738 - protein, 8 aa, Artificial Sequence
  Synthetic polypeptide representing artificial human antibody CDR-H1 region
GFTFRIYA

SEQ ID NO: 739 - protein, 8 aa, Artificial Sequence
  Synthetic polypeptide representing artificial human antibody CDR-H1 region
GYTFTSYY

SEQ ID NO: 740 - protein, 8 aa, Artificial Sequence
  Synthetic polypeptide representing artificial human antibody CDR-H1 region
GLDFRDYY

SEQ ID NO: 741 - protein, 8 aa, Artificial Sequence
  Synthetic polypeptide representing artificial human antibody CDR-H1 region
GFTFISYA

SEQ ID NO: 742 - protein, 8 aa, Artificial Sequence
  Synthetic polypeptide representing artificial human antibody CDR-H1 region
GYTFTSHA

SEQ ID NO: 743 - protein, 8 aa, Artificial Sequence
  Synthetic polypeptide representing artificial human antibody CDR-H1 region
GYTFTNYA

SEQ ID NO: 744 - protein, 8 aa, Artificial Sequence
  Synthetic polypeptide representing artificial human antibody CDR-H1 region
GFTFSNFA

SEQ ID NO: 745 - protein, 8 aa, Artificial Sequence
  Synthetic polypeptide representing artificial human antibody CDR-H1 region
GFTFSHYA

SEQ ID NO: 746 - protein, 8 aa, Artificial Sequence
  Synthetic polypeptide representing artificial human antibody CDR-H1 region
GFTFSSYS

SEQ ID NO: 747 - protein, 10 aa, Artificial Sequence
  Synthetic polypeptide representing artificial human antibody CDR-H1 region
GFSLSTNGVG

SEQ ID NO: 748 - protein, 10 aa, Artificial Sequence
  Synthetic polypeptide representing artificial human antibody CDR-H1 region
GLSLSTSGVA

SEQ ID NO: 749 - protein, 10 aa, Artificial Sequence
  Synthetic polypeptide representing artificial human antibody CDR-H1 region
GGSISSGGYC

SEQ ID NO: 750 - protein, 8 aa, Artificial Sequence
  Synthetic polypeptide representing artificial human antibody CDR-H1 region
GFTFSSYW

SEQ ID NO: 751 - protein, 8 aa, Artificial Sequence
  Synthetic polypeptide representing artificial human antibody CDR-H1 region
RGTFSNHA

SEQ ID NO: 752 - protein, 8 aa, Artificial Sequence
  Synthetic polypeptide representing artificial human antibody CDR-H1 region
GGTFNFYA

SEQ ID NO: 753 - protein, 8 aa, Artificial Sequence
  Synthetic polypeptide representing artificial human antibody CDR-H1 region
GYNFIDNA

SEQ ID NO: 754 - protein, 8 aa, Artificial Sequence
  Synthetic polypeptide representing artificial human antibody CDR-H1 region
GYTFTHYG

SEQ ID NO: 755 - protein, 8 aa, Artificial Sequence
  Synthetic polypeptide representing artificial human antibody CDR-H1 region
GFTFSNYA

SEQ ID NO: 756 - protein, 8 aa, Artificial Sequence
  Synthetic polypeptide representing artificial human antibody CDR-H1 region
GYTFSSYY

SEQ ID NO: 757 - protein, 8 aa, Artificial Sequence
  Synthetic polypeptide representing artificial human antibody CDR-H1 region
GYNFSRYW

SEQ ID NO: 758 - protein, 8 aa, Artificial Sequence
  Synthetic polypeptide representing artificial human antibody CDR-H1 region
GFTFNRYG

SEQ ID NO: 759 - protein, 8 aa, Artificial Sequence
  Synthetic polypeptide representing artificial human antibody CDR-H1 region
GYSFTSFW

SEQ ID NO: 760 - protein, 8 aa, Artificial Sequence
  Synthetic polypeptide representing artificial human antibody CDR-H1 region
GFTLDDYV

SEQ ID NO: 761 - protein, 10 aa, Artificial Sequence
  Synthetic polypeptide representing artificial human antibody CDR-H1 region
GDSISSSGFF

SEQ ID NO: 762 - protein, 8 aa, Artificial Sequence
  Synthetic polypeptide representing artificial human antibody CDR-H1 region
GGPFKTYP

SEQ ID NO: 763 - protein, 8 aa, Artificial Sequence
  Synthetic polypeptide representing artificial human antibody CDR-H1 region
GFTFGDNA

SEQ ID NO: 764 - protein, 8 aa, Artificial Sequence
  Synthetic polypeptide representing artificial human antibody CDR-H1 region
GYTFSNYG

SEQ ID NO: 765 - protein, 8 aa, Artificial Sequence
  Synthetic polypeptide representing artificial human antibody CDR-H1 region
GFDFTSYW

SEQ ID NO: 766 - protein, 8 aa, Artificial Sequence
  Synthetic polypeptide representing artificial human antibody CDR-H1 region
GFTFSSYS

SEQ ID NO: 767 - protein, 10 aa, Artificial Sequence
  Synthetic polypeptide representing artificial human antibody CDR-H1 region
GVSIGTSSYY

SEQ ID NO: 768 - protein, 8 aa, Artificial Sequence
  Synthetic polypeptide representing artificial human antibody CDR-H1 region
GDSFSDYY

SEQ ID NO: 769 - protein, 8 aa, Artificial Sequence
  Synthetic polypeptide representing artificial human antibody CDR-H1 region
GFTFSNYA

SEQ ID NO: 770 - protein, 8 aa, Artificial Sequence
  Synthetic polypeptide representing artificial human antibody CDR-H1 region
GYRFTSNG

SEQ ID NO: 771 - protein, 8 aa, Artificial Sequence
  Synthetic polypeptide representing artificial human antibody CDR-H1 region
GFTFDDYG

SEQ ID NO: 772 - protein, 8 aa, Artificial Sequence
  Synthetic polypeptide representing artificial human antibody CDR-H1 region
GFSFSAYG

SEQ ID NO: 773 - protein, 8 aa, Artificial Sequence
  Synthetic polypeptide representing artificial human antibody CDR-H1 region
EFTFSAYA

SEQ ID NO: 774 - protein, 8 aa, Artificial Sequence
  Synthetic polypeptide representing artificial human antibody CDR-H1 region
GFTFSNAW

SEQ ID NO: 775 - protein, 8 aa, Artificial Sequence
  Synthetic polypeptide representing artificial human antibody CDR-H1 region
GLTFSDYG

SEQ ID NO: 776 - protein, 8 aa, Artificial Sequence
  Synthetic polypeptide representing artificial human antibody CDR-H1 region
GYVFTSFG

SEQ ID NO: 777 - protein, 8 aa, Artificial Sequence
  Synthetic polypeptide representing artificial human antibody CDR-H1 region
GFTFEDFG

SEQ ID NO: 778 - protein, 8 aa, Artificial Sequence
  Synthetic polypeptide representing artificial human antibody CDR-H1 region
GFTLSTYG

SEQ ID NO: 779 - protein, 8 aa, Artificial Sequence
  Synthetic polypeptide representing artificial human antibody CDR-H1 region
GYTFSNYA

SEQ ID NO: 780 - protein, 8 aa, Artificial Sequence
  Synthetic polypeptide representing artificial human antibody CDR-H1 region
GYSFSTYW

SEQ ID NO: 781 - protein, 10 aa, Artificial Sequence
  Synthetic polypeptide representing artificial human antibody CDR-H1 region
GFSLTTYGVG

SEQ ID NO: 782 - protein, 8 aa, Artificial Sequence
  Synthetic polypeptide representing artificial human antibody CDR-H1 region
GFTFSAYG

SEQ ID NO: 783 - protein, 8 aa, Artificial Sequence
  Synthetic polypeptide representing artificial human antibody CDR-H1 region
GGTFSEYG

SEQ ID NO: 784 - protein, 10 aa, Artificial Sequence
  Synthetic polypeptide representing artificial human antibody CDR-H1 region
GASVNSGTHF

SEQ ID NO: 785 - protein, 8 aa, Artificial Sequence
  Synthetic polypeptide representing artificial human antibody CDR-H1 region
GFTFSSYA

SEQ ID NO: 786 - protein, 8 aa, Artificial Sequence
  Synthetic polypeptide representing artificial human antibody CDR-H1 region
GFTFSSYS

SEQ ID NO: 787 - protein, 10 aa, Artificial Sequence
  Synthetic polypeptide representing artificial human antibody CDR-H1 region
GDSISRSNYY

SEQ ID NO: 788 - protein, 8 aa, Artificial Sequence
  Synthetic polypeptide representing artificial human antibody CDR-H1 region
GFTFSKFW

SEQ ID NO: 789 - protein, 10 aa, Artificial Sequence
  Synthetic polypeptide representing artificial human antibody CDR-H1 region
GFSLTTTGVG

SEQ ID NO: 790 - protein, 8 aa, Artificial Sequence
  Synthetic polypeptide representing artificial human antibody CDR-H1 region
GFIFSSYG

SEQ ID NO: 791 - protein, 8 aa, Artificial Sequence
  Synthetic polypeptide representing artificial human antibody CDR-H1 region
GFTFSSYE

SEQ ID NO: 792 - protein, 8 aa, Artificial Sequence
  Synthetic polypeptide representing artificial human antibody CDR-H1 region
GFTFSSYS

SEQ ID NO: 793 - protein, 10 aa, Artificial Sequence
  Synthetic polypeptide representing artificial human antibody CDR-H1 region
GFSLSTSGMC

SEQ ID NO: 794 - protein, 8 aa, Artificial Sequence
  Synthetic polypeptide representing artificial human antibody CDR-H1 region
GFTFSSYW

SEQ ID NO: 795 - protein, 8 aa, Artificial Sequence
  Synthetic polypeptide representing artificial human antibody CDR-H1 region
GFTFASYG

SEQ ID NO: 796 - protein, 8 aa, Artificial Sequence
  Synthetic polypeptide representing artificial human antibody CDR-H1 region
GFTFSSYS

SEQ ID NO: 797 - protein, 8 aa, Artificial Sequence
  Synthetic polypeptide representing artificial human antibody CDR-H1 region
GYIFTGSF

SEQ ID NO: 798 - protein, 10 aa, Artificial Sequence
  Synthetic polypeptide representing artificial human antibody CDR-H1 region
GGSISSGTYY

SEQ ID NO: 799 - protein, 8 aa, Artificial Sequence
  Synthetic polypeptide representing artificial human antibody CDR-H1 region
GYSFTNYW

SEQ ID NO: 800 - protein, 8 aa, Artificial Sequence
  Synthetic polypeptide representing artificial human antibody CDR-H1 region
GFTFSNAW

SEQ ID NO: 801 - protein, 8 aa, Artificial Sequence
  Synthetic polypeptide representing artificial human antibody CDR-H1 region
GFPFSTYA

SEQ ID NO: 802 - protein, 8 aa, Artificial Sequence
  Synthetic polypeptide representing artificial human antibody CDR-H1 region
GFSFSGSS

SEQ ID NO: 803 - protein, 8 aa, Artificial Sequence
  Synthetic polypeptide representing artificial human antibody CDR-H1 region
GGSISSYY

SEQ ID NO: 804 - protein, 8 aa, Artificial Sequence
  Synthetic polypeptide representing artificial human antibody CDR-H1 region
GFTFGDYA

SEQ ID NO: 805 - protein, 8 aa, Artificial Sequence
  Synthetic polypeptide representing artificial human antibody CDR-H1 region
GFTLSNYG

SEQ ID NO: 806 - protein, 8 aa, Artificial Sequence
  Synthetic polypeptide representing artificial human antibody CDR-H1 region
GFSITTHS

SEQ ID NO: 807 - protein, 8 aa, Artificial Sequence
  Synthetic polypeptide representing artificial human antibody CDR-H1 region
GFTFSSYE

SEQ ID NO: 808 - protein, 8 aa, Artificial Sequence
  Synthetic polypeptide representing artificial human antibody CDR-H1 region
GFTFSSYS

SEQ ID NO: 809 - protein, 8 aa, Artificial Sequence
  Synthetic polypeptide representing artificial human antibody CDR-H1 region
GFSVSSKY

SEQ ID NO: 810 - protein, 8 aa, Artificial Sequence
  Synthetic polypeptide representing artificial human antibody CDR-H1 region
GYSFTNYW

SEQ ID NO: 811 - protein, 8 aa, Artificial Sequence
  Synthetic polypeptide representing artificial human antibody CDR-H1 region
GFTFSGSA

SEQ ID NO: 812 - protein, 8 aa, Artificial Sequence
  Synthetic polypeptide representing artificial human antibody CDR-H1 region
GFTFSDYG

SEQ ID NO: 813 - protein, 8 aa, Artificial Sequence
  Synthetic polypeptide representing artificial human antibody CDR-H1 region
GYTFNNYG

SEQ ID NO: 814 - protein, 6 aa, Artificial Sequence
  Synthetic polypeptide representing artificial human antibody CDR-L1 region
QGVSSY

SEQ ID NO: 815 - protein, 6 aa, Artificial Sequence
  Synthetic polypeptide representing artificial human antibody CDR-L1 region
QSIGSY

SEQ ID NO: 816 - protein, 6 aa, Artificial Sequence
  Synthetic polypeptide representing artificial human antibody CDR-L1 region
QGIDVW

SEQ ID NO: 817 - protein, 8 aa, Artificial Sequence
  Synthetic polypeptide representing artificial human antibody CDR-L1 region
SSNIGSNY

SEQ ID NO: 818 - protein, 6 aa, Artificial Sequence
  Synthetic polypeptide representing artificial human antibody CDR-L1 region
SLRNYY

SEQ ID NO: 819 - protein, 6 aa, Artificial Sequence
  Synthetic polypeptide representing artificial human antibody CDR-L1 region
NIGIKS

SEQ ID NO: 820 - protein, 6 aa, Artificial Sequence
  Synthetic polypeptide representing artificial human antibody CDR-L1 region
QSISSY

SEQ ID NO: 821 - protein, 7 aa, Artificial Sequence
  Synthetic polypeptide representing artificial human antibody CDR-L1 region
QSVSSSY

SEQ ID NO: 822 - protein, 8 aa, Artificial Sequence
  Synthetic polypeptide representing artificial human antibody CDR-L1 region
SGNIASYY

SEQ ID NO: 823 - protein, 7 aa, Artificial Sequence
  Synthetic polypeptide representing artificial human antibody CDR-L1 region
QSVSSSY

SEQ ID NO: 824 - protein, 8 aa, Artificial Sequence
  Synthetic polypeptide representing artificial human antibody CDR-L1 region
SSNIENND

SEQ ID NO: 825 - protein, 11 aa, Artificial Sequence
  Synthetic polypeptide representing artificial human antibody CDR-L1 region
QSLVHSDGNTY

SEQ ID NO: 826 - protein, 8 aa, Artificial Sequence
  Synthetic polypeptide representing artificial human antibody CDR-L1 region
SSNIGRNY

SEQ ID NO: 827 - protein, 8 aa, Artificial Sequence
  Synthetic polypeptide representing artificial human antibody CDR-L1 region
ISNIGSNP

SEQ ID NO: 828 - protein, 6 aa, Artificial Sequence
  Synthetic polypeptide representing artificial human antibody CDR-L1 region
QNVNFN

SEQ ID NO: 829 - protein, 7 aa, Artificial Sequence
  Synthetic polypeptide representing artificial human antibody CDR-L1 region
QSVSSSS

SEQ ID NO: 830 - protein, 6 aa, Artificial Sequence
  Synthetic polypeptide representing artificial human antibody CDR-L1 region
ALPKQY

SEQ ID NO: 831 - protein, 6 aa, Artificial Sequence
  Synthetic polypeptide representing artificial human antibody CDR-L1 region
QSVSSY

SEQ ID NO: 832 - protein, 6 aa, Artificial Sequence
  Synthetic polypeptide representing artificial human antibody CDR-L1 region
QSVGSY

SEQ ID NO: 833 - protein, 6 aa, Artificial Sequence
  Synthetic polypeptide representing artificial human antibody CDR-L1 region
QAIANS

SEQ ID NO: 834 - protein, 12 aa, Artificial Sequence
  Synthetic polypeptide representing artificial human antibody CDR-L1 region
QSVLYSSNNENY

SEQ ID NO: 835 - protein, 6 aa, Artificial Sequence
  Synthetic polypeptide representing artificial human antibody CDR-L1 region
HNINTY

SEQ ID NO: 836 - protein, 9 aa, Artificial Sequence
  Synthetic polypeptide representing artificial human antibody CDR-L1 region
SSDVGGYNY

SEQ ID NO: 837 - protein, 8 aa, Artificial Sequence
  Synthetic polypeptide representing artificial human antibody CDR-L1 region
SANIGKNY

SEQ ID NO: 838 - protein, 6 aa, Artificial Sequence
  Synthetic polypeptide representing artificial human antibody CDR-L1 region
QSISTY

SEQ ID NO: 839 - protein, 6 aa, Artificial Sequence
  Synthetic polypeptide representing artificial human antibody CDR-L1 region
QSIKNY

SEQ ID NO: 840 - protein, 9 aa, Artificial Sequence
  Synthetic polypeptide representing artificial human antibody CDR-L1 region
SSNIGAGYD

SEQ ID NO: 841 - protein, 6 aa, Artificial Sequence
  Synthetic polypeptide representing artificial human antibody CDR-L1 region
NIGSKT

SEQ ID NO: 842 - protein, 6 aa, Artificial Sequence
  Synthetic polypeptide representing artificial human antibody CDR-L1 region
QDISNW

SEQ ID NO: 843 - protein, 6 aa, Artificial Sequence
  Synthetic polypeptide representing artificial human antibody CDR-L1 region
ALPNEN

SEQ ID NO: 844 - protein, 9 aa, Artificial Sequence
  Synthetic polypeptide representing artificial human antibody CDR-L1 region
TSDIGSYDR

SEQ ID NO: 845 - protein, 8 aa, Artificial Sequence
  Synthetic polypeptide representing artificial human antibody CDR-L1 region
SSNIGNNY

SEQ ID NO: 846 - protein, 11 aa, Artificial Sequence
  Synthetic polypeptide representing artificial human antibody CDR-L1 region
QSLVYSDGNTY

SEQ ID NO: 847 - protein, 7 aa, Artificial Sequence
  Synthetic polypeptide representing artificial human antibody CDR-L1 region
QSIRSSY

SEQ ID NO: 848 - protein, 9 aa, Artificial Sequence
  Synthetic polypeptide representing artificial human antibody CDR-L1 region
TSNIGAGYD

SEQ ID NO: 849 - protein, 6 aa, Artificial Sequence
  Synthetic polypeptide representing artificial human antibody CDR-L1 region
QSISSY

SEQ ID NO: 850 - protein, 12 aa, Artificial Sequence
  Synthetic polypeptide representing artificial human antibody CDR-L1 region
QNVLYSSNNKNY

SEQ ID NO: 851 - protein, 9 aa, Artificial Sequence
  Synthetic polypeptide representing artificial human antibody CDR-L1 region
SSNIGAGYD

SEQ ID NO: 852 - protein, 8 aa, Artificial Sequence
  Synthetic polypeptide representing artificial human antibody CDR-L1 region
SGSIASSY

SEQ ID NO: 853 - protein, 6 aa, Artificial Sequence
  Synthetic polypeptide representing artificial human antibody CDR-L1 region
QSISSY

SEQ ID NO: 854 - protein, 6 aa, Artificial Sequence
  Synthetic polypeptide representing artificial human antibody CDR-L1 region
NIGSKS

SEQ ID NO: 855 - protein, 9 aa, Artificial Sequence
  Synthetic polypeptide representing artificial human antibody CDR-L1 region
SSDVGGYNY

SEQ ID NO: 856 - protein, 6 aa, Artificial Sequence
  Synthetic polypeptide representing artificial human antibody CDR-L1 region
QSISSY

SEQ ID NO: 857 - protein, 6 aa, Artificial Sequence
  Synthetic polypeptide representing artificial human antibody CDR-L1 region
QGINSA

SEQ ID NO: 858 - protein, 6 aa, Artificial Sequence
  Synthetic polypeptide representing artificial human antibody CDR-L1 region
SLRRYY

SEQ ID NO: 859 - protein, 6 aa, Artificial Sequence
  Synthetic polypeptide representing artificial human antibody CDR-L1 region
QGIRNW

SEQ ID NO: 860 - protein, 6 aa, Artificial Sequence
  Synthetic polypeptide representing artificial human antibody CDR-L1 region
QSVGTY

SEQ ID NO: 861 - protein, 7 aa, Artificial Sequence
  Synthetic polypeptide representing artificial human antibody CDR-L1 region
QSVSSNY

SEQ ID NO: 862 - protein, 7 aa, Artificial Sequence
  Synthetic polypeptide representing artificial human antibody CDR-L1 region
QSVSSRY

SEQ ID NO: 863 - protein, 6 aa, Artificial Sequence
  Synthetic polypeptide representing artificial human antibody CDR-L1 region
QSVGSS

SEQ ID NO: 864 - protein, 6 aa, Artificial Sequence
  Synthetic polypeptide representing artificial human antibody CDR-L1 region
QSISSW

SEQ ID NO: 865 - protein, 6 aa, Artificial Sequence
  Synthetic polypeptide representing artificial human antibody CDR-L1 region
NIGSKS

SEQ ID NO: 866 - protein, 6 aa, Artificial Sequence
  Synthetic polypeptide representing artificial human antibody CDR-L1 region
QSVSTY

SEQ ID NO: 867 - protein, 11 aa, Artificial Sequence
  Synthetic polypeptide representing artificial human antibody CDR-L1 region
QSLLHSNGYNY

SEQ ID NO: 868 - protein, 6 aa, Artificial Sequence
  Synthetic polypeptide representing artificial human antibody CDR-L1 region
QSISSW

SEQ ID NO: 869 - protein, 9 aa, Artificial Sequence
  Synthetic polypeptide representing artificial human antibody CDR-L1 region
SGSVSTGNY

SEQ ID NO: 870 - protein, 7 aa, Artificial Sequence
  Synthetic polypeptide representing artificial human antibody CDR-L1 region
QSVSSSY

SEQ ID NO: 871 - protein, 6 aa, Artificial Sequence
  Synthetic polypeptide representing artificial human antibody CDR-L1 region
NIGSKS

SEQ ID NO: 872 - protein, 6 aa, Artificial Sequence
  Synthetic polypeptide representing artificial human antibody CDR-L1 region
QSISRW

SEQ ID NO: 873 - protein, 6 aa, Artificial Sequence
  Synthetic polypeptide representing artificial human antibody CDR-L1 region
QDIDDD

SEQ ID NO: 874 - protein, 7 aa, Artificial Sequence
  Synthetic polypeptide representing artificial human antibody CDR-L1 region
QSIGAAY

SEQ ID NO: 875 - protein, 6 aa, Artificial Sequence
  Synthetic polypeptide representing artificial human antibody CDR-L1 region
ALPKKY

SEQ ID NO: 876 - protein, 11 aa, Artificial Sequence
  Synthetic polypeptide representing artificial human antibody CDR-L1 region
QSLLHSDGYNY

SEQ ID NO: 877 - protein, 9 aa, Artificial Sequence
  Synthetic polypeptide representing artificial human antibody CDR-L1 region
SSDVGGYNY

SEQ ID NO: 878 - protein, 6 aa, Artificial Sequence
  Synthetic polypeptide representing artificial human antibody CDR-L1 region
QSISSN

SEQ ID NO: 879 - protein, 9 aa, Artificial Sequence
  Synthetic polypeptide representing artificial human antibody CDR-L1 region
SSDVGGYNY

SEQ ID NO: 880 - protein, 11 aa, Artificial Sequence
  Synthetic polypeptide representing artificial human antibody CDR-L1 region
QRLLHSDGKTY

SEQ ID NO: 881 - protein, 7 aa, Artificial Sequence
  Synthetic polypeptide representing artificial human antibody CDR-L1 region
QSVSSSF

SEQ ID NO: 882 - protein, 6 aa, Artificial Sequence
  Synthetic polypeptide representing artificial human antibody CDR-L1 region
QDVDTY

SEQ ID NO: 883 - protein, 8 aa, Artificial Sequence
  Synthetic polypeptide representing artificial human antibody CDR-L1 region
SSNIGKYS

SEQ ID NO: 884 - protein, 6 aa, Artificial Sequence
  Synthetic polypeptide representing artificial human antibody CDR-L1 region
QSVGSS

SEQ ID NO: 885 - protein, 7 aa, Artificial Sequence
  Synthetic polypeptide representing artificial human antibody CDR-L1 region
QSVSSSY

SEQ ID NO: 886 - protein, 6 aa, Artificial Sequence
  Synthetic polypeptide representing artificial human antibody CDR-L1 region
QSISVW

SEQ ID NO: 887 - protein, 6 aa, Artificial Sequence
  Synthetic polypeptide representing artificial human antibody CDR-L1 region
SLRRYY

SEQ ID NO: 888 - protein, 6 aa, Artificial Sequence
  Synthetic polypeptide representing artificial human antibody CDR-L1 region
QSISSY

SEQ ID NO: 889 - protein, 7 aa, Artificial Sequence
  Synthetic polypeptide representing artificial human antibody CDR-L1 region
QSVSSSY

SEQ ID NO: 890 - protein, 8 aa, Artificial Sequence
  Synthetic polypeptide representing artificial human antibody CDR-L1 region
SSNIDNNY

SEQ ID NO: 891 - protein, 6 aa, Artificial Sequence
  Synthetic polypeptide representing artificial human antibody CDR-L1 region
QTISTY

SEQ ID NO: 892 - protein, 12 aa, Artificial Sequence
  Synthetic polypeptide representing artificial human antibody CDR-L1 region
QTVLHSSNNRNY

SEQ ID NO: 893 - protein, 6 aa, Artificial Sequence
  Synthetic polypeptide representing artificial human antibody CDR-L1 region
QSVDGN

SEQ ID NO: 894 - protein, 6 aa, Artificial Sequence
  Synthetic polypeptide representing artificial human antibody CDR-L1 region
QSISNY

SEQ ID NO: 895 - protein, 9 aa, Artificial Sequence
  Synthetic polypeptide representing artificial human antibody CDR-L1 region
SSNIGAGYD

SEQ ID NO: 896 - protein, 6 aa, Artificial Sequence
  Synthetic polypeptide representing artificial human antibody CDR-L1 region
QSVSTN

SEQ ID NO: 897 - protein, 6 aa, Artificial Sequence
  Synthetic polypeptide representing artificial human antibody CDR-L1 region
QSVSGY

SEQ ID NO: 898 - protein, 8 aa, Artificial Sequence
  Synthetic polypeptide representing artificial human antibody CDR-L1 region
RSNVASHA

SEQ ID NO: 899 - protein, 12 aa, Artificial Sequence
  Synthetic polypeptide representing artificial human antibody CDR-L1 region
QSLLDSDDGKTY

SEQ ID NO: 900 - protein, 6 aa, Artificial Sequence
  Synthetic polypeptide representing artificial human antibody CDR-L1 region
KLGDKY

SEQ ID NO: 901 - protein, 6 aa, Artificial Sequence
  Synthetic polypeptide representing artificial human antibody CDR-L1 region
KLGDIC

SEQ ID NO: 902 - protein, 12 aa, Artificial Sequence
  Synthetic polypeptide representing artificial human antibody CDR-L1 region
QSLFYSSNNKNY

SEQ ID NO: 903 - protein, 6 aa, Artificial Sequence
  Synthetic polypeptide representing artificial human antibody CDR-L1 region
QSVSSY

SEQ ID NO: 904 - protein, 6 aa, Artificial Sequence
  Synthetic polypeptide representing artificial human antibody CDR-L1 region
QSVSNY

SEQ ID NO: 905 - protein, 11 aa, Artificial Sequence
  Synthetic polypeptide representing artificial human antibody CDR-L1 region
QSLLQSNGNNY

SEQ ID NO: 906 - protein, 6 aa, Artificial Sequence
  Synthetic polypeptide representing artificial human antibody CDR-L1 region
QSISGW

SEQ ID NO: 907 - protein, 8 aa, Artificial Sequence
  Synthetic polypeptide representing artificial human antibody CDR-L1 region
SSNIGNNY

SEQ ID NO: 908 - protein, 6 aa, Artificial Sequence
  Synthetic polypeptide representing artificial human antibody CDR-L1 region
QSVSNY

SEQ ID NO: 909 - protein, 11 aa, Artificial Sequence
  Synthetic polypeptide representing artificial human antibody CDR-L1 region
QSLLRRDGNNY

SEQ ID NO: 910 - protein, 9 aa, Artificial Sequence
  Synthetic polypeptide representing artificial human antibody CDR-L1 region
SSDVGGFNY

SEQ ID NO: 911 - protein, 11 aa, Artificial Sequence
  Synthetic polypeptide representing artificial human antibody CDR-L1 region
QSLVYSDGNTY

SEQ ID NO: 912 - protein, 6 aa, Artificial Sequence
  Synthetic polypeptide representing artificial human antibody CDR-L1 region
QSISSY

SEQ ID NO: 913 - protein, 6 aa, Artificial Sequence
  Synthetic polypeptide representing artificial human antibody CDR-L1 region
QDISNY

SEQ ID NO: 914 - protein, 6 aa, Artificial Sequence
  Synthetic polypeptide representing artificial human antibody CDR-L1 region
NIGSKS

SEQ ID NO: 915 - protein, 6 aa, Artificial Sequence
  Synthetic polypeptide representing artificial human antibody CDR-L1 region
QVISDY

SEQ ID NO: 916 - protein, 6 aa, Artificial Sequence
  Synthetic polypeptide representing artificial human antibody CDR-L1 region
QSISTY

SEQ ID NO: 917 - protein, 6 aa, Artificial Sequence
  Synthetic polypeptide representing artificial human antibody CDR-L1 region
QRISNW

SEQ ID NO: 918 - protein, 11 aa, Artificial Sequence
  Synthetic polypeptide representing artificial human antibody CDR-L1 region
QSLLNPDGKTY

SEQ ID NO: 919 - protein, 6 aa, Artificial Sequence
  Synthetic polypeptide representing artificial human antibody CDR-L1 region
QSISGY

SEQ ID NO: 920 - protein, 9 aa, Artificial Sequence
  Synthetic polypeptide representing artificial human antibody CDR-L1 region
SSNVGADYD

SEQ ID NO: 921 - protein, 6 aa, Artificial Sequence
  Synthetic polypeptide representing artificial human antibody CDR-L1 region
QSVSSS

SEQ ID NO: 922 - protein, 7 aa, Artificial Sequence
  Synthetic polypeptide representing artificial human antibody CDR-L1 region
QSFDGKS

SEQ ID NO: 923 - protein, 12 aa, Artificial Sequence
  Synthetic polypeptide representing artificial human antibody CDR-L1 region
QSILYSSNNKDS

SEQ ID NO: 924 - protein, 7 aa, Artificial Sequence
  Synthetic polypeptide representing artificial human antibody CDR-L1 region
QSVSGSH

SEQ ID NO: 925 - protein, 9 aa, Artificial Sequence
  Synthetic polypeptide representing artificial human antibody CDR-L1 region
SSDVGGYNY

SEQ ID NO: 926 - protein, 6 aa, Artificial Sequence
  Synthetic polypeptide representing artificial human antibody CDR-L1 region
ALPKKY

SEQ ID NO: 927 - protein, 6 aa, Artificial Sequence
  Synthetic polypeptide representing artificial human antibody CDR-L1 region
QSVSSN

SEQ ID NO: 928 - protein, 7 aa, Artificial Sequence
  Synthetic polypeptide representing artificial human antibody CDR-L1 region
QSVSSSY

SEQ ID NO: 929 - protein, 9 aa, Artificial Sequence
  Synthetic polypeptide representing artificial human antibody CDR-L1 region
SSDVGLYNF

SEQ ID NO: 930 - protein, 9 aa, Artificial Sequence
  Synthetic polypeptide representing artificial human antibody CDR-L1 region
NSNIGAGYY

SEQ ID NO: 931 - protein, 7 aa, Artificial Sequence
  Synthetic polypeptide representing artificial human antibody CDR-L1 region
QSVTSSY

SEQ ID NO: 932 - protein, 8 aa, Artificial Sequence
  Synthetic polypeptide representing artificial human antibody CDR-L1 region
SSNIGDNF

SEQ ID NO: 933 - protein, 6 aa, Artificial Sequence
  Synthetic polypeptide representing artificial human antibody CDR-L1 region
QDIDDD

SEQ ID NO: 934 - protein, 6 aa, Artificial Sequence
  Synthetic polypeptide representing artificial human antibody CDR-L1 region
QSVGSW

SEQ ID NO: 935 - protein, 6 aa, Artificial Sequence
  Synthetic polypeptide representing artificial human antibody CDR-L1 region
QDISSF

SEQ ID NO: 936 - protein, 6 aa, Artificial Sequence
  Synthetic polypeptide representing artificial human antibody CDR-L1 region
SLRDYS

SEQ ID NO: 937 - protein, 6 aa, Artificial Sequence
  Synthetic polypeptide representing artificial human antibody CDR-L1 region
QSVSAY

SEQ ID NO: 938 - protein, 6 aa, Artificial Sequence
  Synthetic polypeptide representing artificial human antibody CDR-L1 region
NIGSKS

SEQ ID NO: 939 - protein, 9 aa, Artificial Sequence
  Synthetic polypeptide representing artificial human antibody CDR-L1 region
SSDVGNYNL

SEQ ID NO: 940 - protein, 6 aa, Artificial Sequence
  Synthetic polypeptide representing artificial human antibody CDR-L1 region
QSVRSH

SEQ ID NO: 941 - protein, 6 aa, Artificial Sequence
  Synthetic polypeptide representing artificial human antibody CDR-L1 region
SLRSYY

SEQ ID NO: 942 - protein, 7 aa, Artificial Sequence
  Synthetic polypeptide representing artificial human antibody CDR-L1 region
QAIVSNY

SEQ ID NO: 943 - protein, 6 aa, Artificial Sequence
  Synthetic polypeptide representing artificial human antibody CDR-L1 region
NIGKKD

SEQ ID NO: 944 - protein, 6 aa, Artificial Sequence
  Synthetic polypeptide representing artificial human antibody CDR-L1 region
NIGSKS

SEQ ID NO: 945 - protein, 6 aa, Artificial Sequence
  Synthetic polypeptide representing artificial human antibody CDR-L1 region
ALPKQS

SEQ ID NO: 946 - protein, 6 aa, Artificial Sequence
  Synthetic polypeptide representing artificial human antibody CDR-L1 region
ALPKQY

SEQ ID NO: 947 - protein, 6 aa, Artificial Sequence
  Synthetic polypeptide representing artificial human antibody CDR-L1 region
ALPKKY

SEQ ID NO: 948 - protein, 6 aa, Artificial Sequence
  Synthetic polypeptide representing artificial human antibody CDR-L1 region
QTIDTY

SEQ ID NO: 949 - protein, 6 aa, Artificial Sequence
  Synthetic polypeptide representing artificial human antibody CDR-L1 region
QGITNY

SEQ ID NO: 950 - protein, 6 aa, Artificial Sequence
  Synthetic polypeptide representing artificial human antibody CDR-L1 region
QDISTF

SEQ ID NO: 951 - protein, 9 aa, Artificial Sequence
  Synthetic polypeptide representing artificial human antibody CDR-L1 region
SSDIGGYNY

SEQ ID NO: 952 - protein, 6 aa, Artificial Sequence
  Synthetic polypeptide representing artificial human antibody CDR-L1 region
KLGDKY

SEQ ID NO: 953 - protein, 8 aa, Artificial Sequence
  Synthetic polypeptide representing artificial human antibody CDR-L1 region
TSNIGNNF

SEQ ID NO: 954 - protein, 7 aa, Artificial Sequence
  Synthetic polypeptide representing artificial human antibody CDR-L1 region
QSISSTY

SEQ ID NO: 955 - protein, 7 aa, Artificial Sequence
  Synthetic polypeptide representing artificial human antibody CDR-L1 region
QSVSSSY

SEQ ID NO: 956 - protein, 9 aa, Artificial Sequence
  Synthetic polypeptide representing artificial human antibody CDR-L1 region
SSDVGDYNY

SEQ ID NO: 957 - protein, 6 aa, Artificial Sequence
  Synthetic polypeptide representing artificial human antibody CDR-L1 region
QFISVY

SEQ ID NO: 958 - protein, 6 aa, Artificial Sequence
  Synthetic polypeptide representing artificial human antibody CDR-L1 region
QSVSSK

SEQ ID NO: 959 - protein, 6 aa, Artificial Sequence
  Synthetic polypeptide representing artificial human antibody CDR-L1 region
VLAKNY

SEQ ID NO: 960 - protein, 9 aa, Artificial Sequence
  Synthetic polypeptide representing artificial human antibody CDR-L1 region
SSDVGAYPY

SEQ ID NO: 961 - protein, 7 aa, Artificial Sequence
  Synthetic polypeptide representing artificial human antibody CDR-L1 region
QSLSSGY

SEQ ID NO: 962 - protein, 12 aa, Artificial Sequence
  Synthetic polypeptide representing artificial human antibody CDR-L1 region
QSLLYRSNDKNY

SEQ ID NO: 963 - protein, 9 aa, Artificial Sequence
  Synthetic polypeptide representing artificial human antibody CDR-L1 region
GSNIGAGYD

SEQ ID NO: 964 - protein, 9 aa, Artificial Sequence
  Synthetic polypeptide representing artificial human antibody CDR-L1 region
SSDVGGYDH

SEQ ID NO: 965 - protein, 6 aa, Artificial Sequence
  Synthetic polypeptide representing artificial human antibody CDR-L1 region
QSISSW

SEQ ID NO: 966 - protein, 6 aa, Artificial Sequence
  Synthetic polypeptide representing artificial human antibody CDR-L1 region
QSIVTN

SEQ ID NO: 967 - protein, 7 aa, Artificial Sequence
  Synthetic polypeptide representing artificial human antibody CDR-L1 region
SGHSTYA

SEQ ID NO: 968 - protein, 7 aa, Artificial Sequence
  Synthetic polypeptide representing artificial human antibody CDR-L1 region
QSVSSSY

SEQ ID NO: 969 - protein, 9 aa, Artificial Sequence
  Synthetic polypeptide representing artificial human antibody CDR-L1 region
SSNLGAGYA

SEQ ID NO: 970 - protein, 9 aa, Artificial Sequence
  Synthetic polypeptide representing artificial human antibody CDR-L1 region
STNIGTIYD

SEQ ID NO: 971 - protein, 11 aa, Artificial Sequence
  Synthetic polypeptide representing artificial human antibody CDR-L1 region
QSLLSSNGHHL

SEQ ID NO: 972 - protein, 6 aa, Artificial Sequence
  Synthetic polypeptide representing artificial human antibody CDR-L1 region
QGISSY

SEQ ID NO: 973 - protein, 8 aa, Artificial Sequence
  Synthetic polypeptide representing artificial human antibody CDR-L1 region
NSNIGSTF

SEQ ID NO: 974 - protein, 11 aa, Artificial Sequence
  Synthetic polypeptide representing artificial human antibody CDR-L1 region
QSLLHSNGVYY

SEQ ID NO: 975 - protein, 6 aa, Artificial Sequence
  Synthetic polypeptide representing artificial human antibody CDR-L1 region
SLRSYF

SEQ ID NO: 976 - protein, 6 aa, Artificial Sequence
  Synthetic polypeptide representing artificial human antibody CDR-L1 region
QSISSW

SEQ ID NO: 977 - protein, 12 aa, Artificial Sequence
  Synthetic polypeptide representing artificial human antibody CDR-L1 region
QTVLYDSNNKNY

SEQ ID NO: 978 - protein, 8 aa, Artificial Sequence
  Synthetic polypeptide representing artificial human antibody CDR-L1 region
SSNIGGKY

SEQ ID NO: 979 - protein, 6 aa, Artificial Sequence
  Synthetic polypeptide representing artificial human antibody CDR-L1 region
QSISDW

SEQ ID NO: 980 - protein, 6 aa, Artificial Sequence
  Synthetic polypeptide representing artificial human antibody CDR-L1 region
NPGIKS

SEQ ID NO: 981 - protein, 9 aa, Artificial Sequence
  Synthetic polypeptide representing artificial human antibody CDR-L1 region
TSNIGADYD

SEQ ID NO: 982 - protein, 6 aa, Artificial Sequence
  Synthetic polypeptide representing artificial human antibody CDR-L1 region
SLRSFY

SEQ ID NO: 983 - protein, 9 aa, Artificial Sequence
  Synthetic polypeptide representing artificial human antibody CDR-L1 region
SSDVDGYNY

SEQ ID NO: 984 - protein, 12 aa, Artificial Sequence
  Synthetic polypeptide representing artificial human antibody CDR-L1 region
QSVLYSSDNKNY

SEQ ID NO: 985 - protein, 9 aa, Artificial Sequence
  Synthetic polypeptide representing artificial human antibody CDR-L1 region
SSDVGGYNY

SEQ ID NO: 986 - protein, 6 aa, Artificial Sequence
  Synthetic polypeptide representing artificial human antibody CDR-L1 region
QDISNY

SEQ ID NO: 987 - protein, 6 aa, Artificial Sequence
  Synthetic polypeptide representing artificial human antibody CDR-L1 region
NIGSKS

SEQ ID NO: 988 - protein, 7 aa, Artificial Sequence
  Synthetic polypeptide representing artificial human antibody CDR-L1 region
QSVRGNY

SEQ ID NO: 989 - protein, 8 aa, Artificial Sequence
  Synthetic polypeptide representing artificial human antibody CDR-L1 region
SSNIGSNY

SEQ ID NO: 990 - protein, 6 aa, Artificial Sequence
  Synthetic polypeptide representing artificial human antibody CDR-L1 region
NIGSYN

SEQ ID NO: 991 - protein, 7 aa, Artificial Sequence
  Synthetic polypeptide representing artificial human antibody CDR-L1 region
QRVSSNY

SEQ ID NO: 992 - protein, 9 aa, Artificial Sequence
  Synthetic polypeptide representing artificial human antibody CDR-L1 region
SSDVGSYNL

SEQ ID NO: 993 - protein, 11 aa, Artificial Sequence
  Synthetic polypeptide representing artificial human antibody CDR-L1 region
QSLVYSDGNTY

SEQ ID NO: 994 - protein, 8 aa, Artificial Sequence
  Synthetic polypeptide representing artificial human antibody CDR-L1 region
SSNIGSNY

SEQ ID NO: 995 - protein, 6 aa, Artificial Sequence
  Synthetic polypeptide representing artificial human antibody CDR-L1 region
SLRSYY

SEQ ID NO: 996 - protein, 6 aa, Artificial Sequence
  Synthetic polypeptide representing artificial human antibody CDR-L1 region
QSISSY

SEQ ID NO: 997 - protein, 6 aa, Artificial Sequence
  Synthetic polypeptide representing artificial human antibody CDR-L1 region
NIGYRN

SEQ ID NO: 998 - protein, 6 aa, Artificial Sequence
  Synthetic polypeptide representing artificial human antibody CDR-L1 region
QGIRND

SEQ ID NO: 999 - protein, 6 aa, Artificial Sequence
  Synthetic polypeptide representing artificial human antibody CDR-L1 region
QSISSW

SEQ ID NO: 1000 - protein, 11 aa, Artificial Sequence
  Synthetic polypeptide representing artificial human antibody CDR-L1 region
QSLLHSNGFNY

SEQ ID NO: 1001 - protein, 6 aa, Artificial Sequence
  Synthetic polypeptide representing artificial human antibody CDR-L1 region
KLGDKY

SEQ ID NO: 1002 - protein, 6 aa, Artificial Sequence
  Synthetic polypeptide representing artificial human antibody CDR-L1 region
ALPKKY

SEQ ID NO: 1003 - protein, 6 aa, Artificial Sequence
  Synthetic polypeptide representing artificial human antibody CDR-L1 region
SLRSYY

SEQ ID NO: 1004 - protein, 12 aa, Artificial Sequence
  Synthetic polypeptide representing artificial human antibody CDR-L1 region
QSVLYSSSSKNY

SEQ ID NO: 1005 - protein, 11 aa, Artificial Sequence
  Synthetic polypeptide representing artificial human antibody CDR-L1 region
QSLLHSNGYNY

SEQ ID NO: 1006 - protein, 9 aa, Artificial Sequence
  Synthetic polypeptide representing artificial human antibody CDR-L1 region
SSDVGGYNY

SEQ ID NO: 1007 - protein, 12 aa, Artificial Sequence
  Synthetic polypeptide representing artificial human antibody CDR-L1 region
QSVLYSSNNKNY

SEQ ID NO: 1008 - protein, 9 aa, Artificial Sequence
  Synthetic polypeptide representing artificial human antibody CDR-L1 region
SSDVGSYNL

SEQ ID NO: 1009 - protein, 6 aa, Artificial Sequence
  Synthetic polypeptide representing artificial human antibody CDR-L1 region
ALPKKY

SEQ ID NO: 1010 - protein, 6 aa, Artificial Sequence
  Synthetic polypeptide representing artificial human antibody CDR-L1 region
QSVSSN

SEQ ID NO: 1011 - protein, 7 aa, Artificial Sequence
  Synthetic polypeptide representing artificial human antibody CDR-L1 region
QSVSSSY

SEQ ID NO: 1012 - protein, 6 aa, Artificial Sequence
  Synthetic polypeptide representing artificial human antibody CDR-L1 region
NIGSRS

SEQ ID NO: 1013 - protein, 9 aa, Artificial Sequence
  Synthetic polypeptide representing artificial human antibody CDR-L1 region
SSDIGTYNL

SEQ ID NO: 1014 - protein, 12 aa, Artificial Sequence
  Synthetic polypeptide representing artificial human antibody CDR-L1 region
QSVLSTSNNKNY

SEQ ID NO: 1015 - protein, 6 aa, Artificial Sequence
  Synthetic polypeptide representing artificial human antibody CDR-L1 region
NIGSKS

SEQ ID NO: 1016 - protein, 6 aa, Artificial Sequence
  Synthetic polypeptide representing artificial human antibody CDR-L1 region
QHIAGR

SEQ ID NO: 1017 - protein, 8 aa, Artificial Sequence
  Synthetic polypeptide representing artificial human antibody CDR-L1 region
SSNIGSNT

SEQ ID NO: 1018 - protein, 8 aa, Artificial Sequence
  Synthetic polypeptide representing artificial human antibody CDR-L1 region
SGSIASNY

SEQ ID NO: 1019 - protein, 9 aa, Artificial Sequence
  Synthetic polypeptide representing artificial human antibody CDR-L1 region
SSNIGAHYD

SEQ ID NO: 1020 - protein, 6 aa, Artificial Sequence
  Synthetic polypeptide representing artificial human antibody CDR-L1 region
QSISSY

SEQ ID NO: 1021 - protein, 6 aa, Artificial Sequence
  Synthetic polypeptide representing artificial human antibody CDR-L1 region
QDISNY

SEQ ID NO: 1022 - protein, 7 aa, Artificial Sequence
  Synthetic polypeptide representing artificial human antibody CDR-L1 region
QDVASTY

SEQ ID NO: 1023 - protein, 9 aa, Artificial Sequence
  Synthetic polypeptide representing artificial human antibody CDR-L1 region
TSDVGTYNL

SEQ ID NO: 1024 - protein, 7 aa, Artificial Sequence
  Synthetic polypeptide representing artificial human antibody CDR-L1 region
QSVANNY

SEQ ID NO: 1025 - protein, 7 aa, Artificial Sequence
  Synthetic polypeptide representing artificial human antibody CDR-L1 region
QSVSSNY

SEQ ID NO: 1026 - protein, 9 aa, Artificial Sequence
  Synthetic polypeptide representing artificial human antibody CDR-L1 region
SGSVSTSFY

SEQ ID NO: 1027 - protein, 9 aa, Artificial Sequence
  Synthetic polypeptide representing artificial human antibody CDR-L1 region
SSNIGAQYD

SEQ ID NO: 1028 - protein, 9 aa, Artificial Sequence
  Synthetic polypeptide representing artificial human antibody CDR-L1 region
SSNIGAGYD

SEQ ID NO: 1029 - protein, 7 aa, Artificial Sequence
  Synthetic polypeptide representing artificial human antibody CDR-L1 region
QSVSSSY

SEQ ID NO: 1030 - protein, 9 aa, Artificial Sequence
  Synthetic polypeptide representing artificial human antibody CDR-L1 region
SSDVGGYNY

SEQ ID NO: 1031 - protein, 9 aa, Artificial Sequence
  Synthetic polypeptide representing artificial human antibody CDR-L1 region
SSDIGGYDL

SEQ ID NO: 1032 - protein, 12 aa, Artificial Sequence
  Synthetic polypeptide representing artificial human antibody CDR-L1 region
QSVLYSSNNKNY

SEQ ID NO: 1033 - protein, 8 aa, Artificial Sequence
  Synthetic polypeptide representing artificial human antibody CDR-L1 region
SSNIGSNT

SEQ ID NO: 1034 - protein, 9 aa, Artificial Sequence
  Synthetic polypeptide representing artificial human antibody CDR-L1 region
TGVVTTGHY

SEQ ID NO: 1035 - protein, 9 aa, Artificial Sequence
  Synthetic polypeptide representing artificial human antibody CDR-L1 region
YSNIGAGYD

SEQ ID NO: 1036 - protein, 6 aa, Artificial Sequence
  Synthetic polypeptide representing artificial human antibody CDR-L1 region
QNINRF

SEQ ID NO: 1037 - protein, 6 aa, Artificial Sequence
  Synthetic polypeptide representing artificial human antibody CDR-L1 region
QGIRND

SEQ ID NO: 1038 - protein, 6 aa, Artificial Sequence
  Synthetic polypeptide representing artificial human antibody CDR-L1 region
SLRTDY

SEQ ID NO: 1039 - protein, 12 aa, Artificial Sequence
  Synthetic polypeptide representing artificial human antibody CDR-L1 region
QSVLSSYNNKDY

SEQ ID NO: 1040 - protein, 11 aa, Artificial Sequence
  Synthetic polypeptide representing artificial human antibody CDR-L1 region
QSLVYSDGNTY

SEQ ID NO: 1041 - protein, 6 aa, Artificial Sequence
  Synthetic polypeptide representing artificial human antibody CDR-L1 region
ALPKKY

SEQ ID NO: 1042 - protein, 6 aa, Artificial Sequence
  Synthetic polypeptide representing artificial human antibody CDR-L1 region
NIGSKS

SEQ ID NO: 1043 - protein, 6 aa, Artificial Sequence
  Synthetic polypeptide representing artificial human antibody CDR-L1 region
QSISTY

SEQ ID NO: 1044 - protein, 6 aa, Artificial Sequence
  Synthetic polypeptide representing artificial human antibody CDR-L1 region
QSVGSD

SEQ ID NO: 1045 - protein, 12 aa, Artificial Sequence
  Synthetic polypeptide representing artificial human antibody CDR-L1 region
QSVLYSSNNKNY

SEQ ID NO: 1046 - protein, 6 aa, Artificial Sequence
  Synthetic polypeptide representing artificial human antibody CDR-L1 region
ALAKEY

SEQ ID NO: 1047 - protein, 6 aa, Artificial Sequence
  Synthetic polypeptide representing artificial human antibody CDR-L1 region
QNIRDF

SEQ ID NO: 1048 - protein, 12 aa, Artificial Sequence
  Synthetic polypeptide representing artificial human antibody CDR-L1 region
QTILYSSNNKNY

SEQ ID NO: 1049 - protein, 6 aa, Artificial Sequence
  Synthetic polypeptide representing artificial human antibody CDR-L1 region
KLGNKY

SEQ ID NO: 1050 - protein, 8 aa, Artificial Sequence
  Synthetic polypeptide representing artificial human antibody CDR-L1 region
RSNIGSNF

SEQ ID NO: 1051 - protein, 8 aa, Artificial Sequence
  Synthetic polypeptide representing artificial human antibody CDR-L1 region
SSNIGNNY

SEQ ID NO: 1052 - protein, 6 aa, Artificial Sequence
  Synthetic polypeptide representing artificial human antibody CDR-L1 region
QSVSFW

SEQ ID NO: 1053 - protein, 12 aa, Artificial Sequence
  Synthetic polypeptide representing artificial human antibody CDR-L1 region
QSVFYSSNNKNY

SEQ ID NO: 1054 - protein, 12 aa, Artificial Sequence
  Synthetic polypeptide representing artificial human antibody CDR-L1 region
QSVLYSSNNKNY

SEQ ID NO: 1055 - protein, 9 aa, Artificial Sequence
  Synthetic polypeptide representing artificial human antibody CDR-L1 region
SNDIGRYKY

SEQ ID NO: 1056 - protein, 11 aa, Artificial Sequence
  Synthetic polypeptide representing artificial human antibody CDR-L1 region
QSLVYSDGNTY

SEQ ID NO: 1057 - protein, 6 aa, Artificial Sequence
  Synthetic polypeptide representing artificial human antibody CDR-L1 region
KLGDKY

SEQ ID NO: 1058 - protein, 7 aa, Artificial Sequence
  Synthetic polypeptide representing artificial human antibody CDR-L1 region
QRVNSNY

SEQ ID NO: 1059 - protein, 6 aa, Artificial Sequence
  Synthetic polypeptide representing artificial human antibody CDR-L1 region
NLGNKY

SEQ ID NO: 1060 - protein, 11 aa, Artificial Sequence
  Synthetic polypeptide representing artificial human antibody CDR-L1 region
QSLLHSNGYNY

SEQ ID NO: 1061 - protein, 8 aa, Artificial Sequence
  Synthetic polypeptide representing artificial human antibody CDR-L1 region
SSNIGNNY

SEQ ID NO: 1062 - protein, 6 aa, Artificial Sequence
  Synthetic polypeptide representing artificial human antibody CDR-L1 region
QSISSW

SEQ ID NO: 1063 - protein, 6 aa, Artificial Sequence
  Synthetic polypeptide representing artificial human antibody CDR-L1 region
QSISSW

SEQ ID NO: 1064 - protein, 9 aa, Artificial Sequence
  Synthetic polypeptide representing artificial human antibody CDR-L1 region
SSNIGAGYD

SEQ ID NO: 1065 - protein, 6 aa, Artificial Sequence
  Synthetic polypeptide representing artificial human antibody CDR-L1 region
ALPKQY

SEQ ID NO: 1066 - protein, 6 aa, Artificial Sequence
  Synthetic polypeptide representing artificial human antibody CDR-L1 region
QNIRNN

SEQ ID NO: 1067 - protein, 6 aa, Artificial Sequence
  Synthetic polypeptide representing artificial human antibody CDR-L1 region
QSVSSN

SEQ ID NO: 1068 - protein, 6 aa, Artificial Sequence
  Synthetic polypeptide representing artificial human antibody CDR-L1 region
QSISSY

SEQ ID NO: 1069 - protein, 6 aa, Artificial Sequence
  Synthetic polypeptide representing artificial human antibody CDR-L1 region
QSISTY

SEQ ID NO: 1070 - protein, 7 aa, Artificial Sequence
  Synthetic polypeptide representing artificial human antibody CDR-L1 region
QSVTSSY

SEQ ID NO: 1071 - protein, 6 aa, Artificial Sequence
  Synthetic polypeptide representing artificial human antibody CDR-L1 region
NIGSKS

SEQ ID NO: 1072 - protein, 8 aa, Artificial Sequence
  Synthetic polypeptide representing artificial human antibody CDR-L1 region
SGSIADKY

SEQ ID NO: 1073 - protein, 11 aa, Artificial Sequence
  Synthetic polypeptide representing artificial human antibody CDR-L1 region
QSLLHSNGYNY

SEQ ID NO: 1074 - protein, 6 aa, Artificial Sequence
  Synthetic polypeptide representing artificial human antibody CDR-L1 region
QSISSW

SEQ ID NO: 1075 - protein, 11 aa, Artificial Sequence
  Synthetic polypeptide representing artificial human antibody CDR-L1 region
QSLLYRDGEHY

SEQ ID NO: 1076 - protein, 6 aa, Artificial Sequence
  Synthetic polypeptide representing artificial human antibody CDR-L1 region
QSISSY

SEQ ID NO: 1077 - protein, 12 aa, Artificial Sequence
  Synthetic polypeptide representing artificial human antibody CDR-L1 region
QSLLYSSNYKNY

SEQ ID NO: 1078 - protein, 8 aa, Artificial Sequence
  Synthetic polypeptide representing artificial human antibody CDR-L1 region
SSNIGSNY

SEQ ID NO: 1079 - protein, 9 aa, Artificial Sequence
  Synthetic polypeptide representing artificial human antibody CDR-L1 region
SSDVGGYNY

SEQ ID NO: 1080 - protein, 9 aa, Artificial Sequence
  Synthetic polypeptide representing artificial human antibody CDR-L1 region
NSNIGAGYD

SEQ ID NO: 1081 - protein, 9 aa, Artificial Sequence
  Synthetic polypeptide representing artificial human antibody CDR-L1 region
SDINVTNYN

SEQ ID NO: 1082 - protein, 11 aa, Artificial Sequence
  Synthetic polypeptide representing artificial human antibody CDR-L1 region
QSLLHSDGYNY

SEQ ID NO: 1083 - protein, 6 aa, Artificial Sequence
  Synthetic polypeptide representing artificial human antibody CDR-L1 region
QGIRND

SEQ ID NO: 1084 - protein, 11 aa, Artificial Sequence
  Synthetic polypeptide representing artificial human antibody CDR-L1 region
QSLLHSDGKTY

SEQ ID NO: 1085 - protein, 8 aa, Artificial Sequence
  Synthetic polypeptide representing artificial human antibody CDR-H2 region
MSGGGGSI

SEQ ID NO: 1086 - protein, 8 aa, Artificial Sequence
  Synthetic polypeptide representing artificial human antibody CDR-H2 region
IKQDGSEK

SEQ ID NO: 1087 - protein, 8 aa, Artificial Sequence
  Synthetic polypeptide representing artificial human antibody CDR-H2 region
ISWNSGNI

SEQ ID NO: 1088 - protein, 7 aa, Artificial Sequence
  Synthetic polypeptide representing artificial human antibody CDR-H2 region
IYWDDDK

SEQ ID NO: 1089 - protein, 8 aa, Artificial Sequence
  Synthetic polypeptide representing artificial human antibody CDR-H2 region
INTSGGST

SEQ ID NO: 1090 - protein, 8 aa, Artificial Sequence
  Synthetic polypeptide representing artificial human antibody CDR-H2 region
ISWNSVSI

SEQ ID NO: 1091 - protein, 8 aa, Artificial Sequence
  Synthetic polypeptide representing artificial human antibody CDR-H2 region
ITTYNRDT

SEQ ID NO: 1092 - protein, 8 aa, Artificial Sequence
  Synthetic polypeptide representing artificial human antibody CDR-H2 region
ISGDGGGT

SEQ ID NO: 1093 - protein, 8 aa, Artificial Sequence
  Synthetic polypeptide representing artificial human antibody CDR-H2 region
IRYDGRNK

SEQ ID NO: 1094 - protein, 8 aa, Artificial Sequence
  Synthetic polypeptide representing artificial human antibody CDR-H2 region
IGWDSGGI

SEQ ID NO: 1095 - protein, 8 aa, Artificial Sequence
  Synthetic polypeptide representing artificial human antibody CDR-H2 region
ISIYSGNT

SEQ ID NO: 1096 - protein, 8 aa, Artificial Sequence
  Synthetic polypeptide representing artificial human antibody CDR-H2 region
ISSDGRKI

SEQ ID NO: 1097 - protein, 8 aa, Artificial Sequence
  Synthetic polypeptide representing artificial human antibody CDR-H2 region
ISATTGST

SEQ ID NO: 1098 - protein, 9 aa, Artificial Sequence
  Synthetic polypeptide representing artificial human antibody CDR-H2 region
TYYRSKWYN

SEQ ID NO: 1099 - protein, 8 aa, Artificial Sequence
  Synthetic polypeptide representing artificial human antibody CDR-H2 region
IHYDGRNK

SEQ ID NO: 1100 - protein, 8 aa, Artificial Sequence
  Synthetic polypeptide representing artificial human antibody CDR-H2 region
ISSSSSSI

SEQ ID NO: 1101 - protein, 8 aa, Artificial Sequence
  Synthetic polypeptide representing artificial human antibody CDR-H2 region
ISAYNGNT

SEQ ID NO: 1102 - protein, 8 aa, Artificial Sequence
  Synthetic polypeptide representing artificial human antibody CDR-H2 region
IGIGGNTI

SEQ ID NO: 1103 - protein, 8 aa, Artificial Sequence
  Synthetic polypeptide representing artificial human antibody CDR-H2 region
INAGNGNT

SEQ ID NO: 1104 - protein, 7 aa, Artificial Sequence
  Synthetic polypeptide representing artificial human antibody CDR-H2 region
VYHSGNA

SEQ ID NO: 1105 - protein, 7 aa, Artificial Sequence
  Synthetic polypeptide representing artificial human antibody CDR-H2 region
IYWDDDE

SEQ ID NO: 1106 - protein, 8 aa, Artificial Sequence
  Synthetic polypeptide representing artificial human antibody CDR-H2 region
ISWGSSYI

SEQ ID NO: 1107 - protein, 8 aa, Artificial Sequence
  Synthetic polypeptide representing artificial human antibody CDR-H2 region
ISSSSRYI

SEQ ID NO: 1108 - protein, 7 aa, Artificial Sequence
  Synthetic polypeptide representing artificial human antibody CDR-H2 region
IYYSGNR

SEQ ID NO: 1109 - protein, 7 aa, Artificial Sequence
  Synthetic polypeptide representing artificial human antibody CDR-H2 region
IYTSGNT

SEQ ID NO: 1110 - protein, 8 aa, Artificial Sequence
  Synthetic polypeptide representing artificial human antibody CDR-H2 region
ISSKSSSK

SEQ ID NO: 1111 - protein, 7 aa, Artificial Sequence
  Synthetic polypeptide representing artificial human antibody CDR-H2 region
IYYRGTT

SEQ ID NO: 1112 - protein, 8 aa, Artificial Sequence
  Synthetic polypeptide representing artificial human antibody CDR-H2 region
IWYDGSNK

SEQ ID NO: 1113 - protein, 7 aa, Artificial Sequence
  Synthetic polypeptide representing artificial human antibody CDR-H2 region
MYTSGST

SEQ ID NO: 1114 - protein, 8 aa, Artificial Sequence
  Synthetic polypeptide representing artificial human antibody CDR-H2 region
INPNSGGT

SEQ ID NO: 1115 - protein, 7 aa, Artificial Sequence
  Synthetic polypeptide representing artificial human antibody CDR-H2 region
IHHTGSA

SEQ ID NO: 1116 - protein, 7 aa, Artificial Sequence
  Synthetic polypeptide representing artificial human antibody CDR-H2 region
IYYSGDT

SEQ ID NO: 1117 - protein, 8 aa, Artificial Sequence
  Synthetic polypeptide representing artificial human antibody CDR-H2 region
ISHDGSNK

SEQ ID NO: 1118 - protein, 7 aa, Artificial Sequence
  Synthetic polypeptide representing artificial human antibody CDR-H2 region
IYWDDDK

SEQ ID NO: 1119 - protein, 8 aa, Artificial Sequence
  Synthetic polypeptide representing artificial human antibody CDR-H2 region
INTTSDPI

SEQ ID NO: 1120 - protein, 8 aa, Artificial Sequence
  Synthetic polypeptide representing artificial human antibody CDR-H2 region
IIPIFGTA

SEQ ID NO: 1121 - protein, 7 aa, Artificial Sequence
  Synthetic polypeptide representing artificial human antibody CDR-H2 region
IYFSVTT

SEQ ID NO: 1122 - protein, 7 aa, Artificial Sequence
  Synthetic polypeptide representing artificial human antibody CDR-H2 region
LSYSGNT

SEQ ID NO: 1123 - protein, 8 aa, Artificial Sequence
  Synthetic polypeptide representing artificial human antibody CDR-H2 region
INAGNGDI

SEQ ID NO: 1124 - protein, 8 aa, Artificial Sequence
  Synthetic polypeptide representing artificial human antibody CDR-H2 region
ISGSGHST

SEQ ID NO: 1125 - protein, 8 aa, Artificial Sequence
  Synthetic polypeptide representing artificial human antibody CDR-H2 region
INWNGGST

SEQ ID NO: 1126 - protein, 8 aa, Artificial Sequence
  Synthetic polypeptide representing artificial human antibody CDR-H2 region
ISYDGSNK

SEQ ID NO: 1127 - protein, 7 aa, Artificial Sequence
  Synthetic polypeptide representing artificial human antibody CDR-H2 region
IYYSGST

SEQ ID NO: 1128 - protein, 8 aa, Artificial Sequence
  Synthetic polypeptide representing artificial human antibody CDR-H2 region
INPNSGGT

SEQ ID NO: 1129 - protein, 7 aa, Artificial Sequence
  Synthetic polypeptide representing artificial human antibody CDR-H2 region
IGTAGDT

SEQ ID NO: 1130 - protein, 8 aa, Artificial Sequence
  Synthetic polypeptide representing artificial human antibody CDR-H2 region
ISYDGSNS

SEQ ID NO: 1131 - protein, 8 aa, Artificial Sequence
  Synthetic polypeptide representing artificial human antibody CDR-H2 region
MSSGGNRR

SEQ ID NO: 1132 - protein, 8 aa, Artificial Sequence
  Synthetic polypeptide representing artificial human antibody CDR-H2 region
ISSSGTYI

SEQ ID NO: 1133 - protein, 8 aa, Artificial Sequence
  Synthetic polypeptide representing artificial human antibody CDR-H2 region
ISYDGSNK

SEQ ID NO: 1134 - protein, 8 aa, Artificial Sequence
  Synthetic polypeptide representing artificial human antibody CDR-H2 region
ISWNSGSI

SEQ ID NO: 1135 - protein, 7 aa, Artificial Sequence
  Synthetic polypeptide representing artificial human antibody CDR-H2 region
IYYSGST

SEQ ID NO: 1136 - protein, 8 aa, Artificial Sequence
  Synthetic polypeptide representing artificial human antibody CDR-H2 region
IIPIFGTA

SEQ ID NO: 1137 - protein, 8 aa, Artificial Sequence
  Synthetic polypeptide representing artificial human antibody CDR-H2 region
INGYNGNT

SEQ ID NO: 1138 - protein, 8 aa, Artificial Sequence
  Synthetic polypeptide representing artificial human antibody CDR-H2 region
ITSSGDTI

SEQ ID NO: 1139 - protein, 8 aa, Artificial Sequence
  Synthetic polypeptide representing artificial human antibody CDR-H2 region
IIPIFGTT

SEQ ID NO: 1140 - protein, 8 aa, Artificial Sequence
  Synthetic polypeptide representing artificial human antibody CDR-H2 region
IYPGDSDT

SEQ ID NO: 1141 - protein, 8 aa, Artificial Sequence
  Synthetic polypeptide representing artificial human antibody CDR-H2 region
TWYEGTNE

SEQ ID NO: 1142 - protein, 8 aa, Artificial Sequence
  Synthetic polypeptide representing artificial human antibody CDR-H2 region
MSGSGAGT

SEQ ID NO: 1143 - protein, 8 aa, Artificial Sequence
  Synthetic polypeptide representing artificial human antibody CDR-H2 region
ISYDGGTK

SEQ ID NO: 1144 - protein, 8 aa, Artificial Sequence
  Synthetic polypeptide representing artificial human antibody CDR-H2 region
IWYDGSTK

SEQ ID NO: 1145 - protein, 7 aa, Artificial Sequence
  Synthetic polypeptide representing artificial human antibody CDR-H2 region
IYFTGST

SEQ ID NO: 1146 - protein, 8 aa, Artificial Sequence
  Synthetic polypeptide representing artificial human antibody CDR-H2 region
IYPGDSDT

SEQ ID NO: 1147 - protein, 7 aa, Artificial Sequence
  Synthetic polypeptide representing artificial human antibody CDR-H2 region
IYTSGST

SEQ ID NO: 1148 - protein, 9 aa, Artificial Sequence
  Synthetic polypeptide representing artificial human antibody CDR-H2 region
THYRSKWYN

SEQ ID NO: 1149 - protein, 8 aa, Artificial Sequence
  Synthetic polypeptide representing artificial human antibody CDR-H2 region
FDPEDGET

SEQ ID NO: 1150 - protein, 8 aa, Artificial Sequence
  Synthetic polypeptide representing artificial human antibody CDR-H2 region
ISSSSSYI

SEQ ID NO: 1151 - protein, 8 aa, Artificial Sequence
  Synthetic polypeptide representing artificial human antibody CDR-H2 region
ISGSGGST

SEQ ID NO: 1152 - protein, 8 aa, Artificial Sequence
  Synthetic polypeptide representing artificial human antibody CDR-H2 region
ITPIFNIT

SEQ ID NO: 1153 - protein, 7 aa, Artificial Sequence
  Synthetic polypeptide representing artificial human antibody CDR-H2 region
IYYSGST

SEQ ID NO: 1154 - protein, 8 aa, Artificial Sequence
  Synthetic polypeptide representing artificial human antibody CDR-H2 region
ITYDGQIK

SEQ ID NO: 1155 - protein, 7 aa, Artificial Sequence
  Synthetic polypeptide representing artificial human antibody CDR-H2 region
IYYSGTT

SEQ ID NO: 1156 - protein, 8 aa, Artificial Sequence
  Synthetic polypeptide representing artificial human antibody CDR-H2 region
ISWNSGSI

SEQ ID NO: 1157 - protein, 7 aa, Artificial Sequence
  Synthetic polypeptide representing artificial human antibody CDR-H2 region
IYSSGDT

SEQ ID NO: 1158 - protein, 7 aa, Artificial Sequence
  Synthetic polypeptide representing artificial human antibody CDR-H2 region
IYWDDDE

SEQ ID NO: 1159 - protein, 8 aa, Artificial Sequence
  Synthetic polypeptide representing artificial human antibody CDR-H2 region
VSSSGSTM

SEQ ID NO: 1160 - protein, 8 aa, Artificial Sequence
  Synthetic polypeptide representing artificial human antibody CDR-H2 region
IDPSDSYT

SEQ ID NO: 1161 - protein, 8 aa, Artificial Sequence
  Synthetic polypeptide representing artificial human antibody CDR-H2 region
IFPADSDT

SEQ ID NO: 1162 - protein, 7 aa, Artificial Sequence
  Synthetic polypeptide representing artificial human antibody CDR-H2 region
IFYSGIT

SEQ ID NO: 1163 - protein, 8 aa, Artificial Sequence
  Synthetic polypeptide representing artificial human antibody CDR-H2 region
IIPIFGTS

SEQ ID NO: 1164 - protein, 8 aa, Artificial Sequence
  Synthetic polypeptide representing artificial human antibody CDR-H2 region
ITWDGSII

SEQ ID NO: 1165 - protein, 8 aa, Artificial Sequence
  Synthetic polypeptide representing artificial human antibody CDR-H2 region
INAYQGVT

SEQ ID NO: 1166 - protein, 8 aa, Artificial Sequence
  Synthetic polypeptide representing artificial human antibody CDR-H2 region
IKEDGSEK

SEQ ID NO: 1167 - protein, 7 aa, Artificial Sequence
  Synthetic polypeptide representing artificial human antibody CDR-H2 region
ISYNGNT

SEQ ID NO: 1168 - protein, 6 aa, Artificial Sequence
  Synthetic polypeptide representing artificial human antibody CDR-H2 region
IGSSGT

SEQ ID NO: 1169 - protein, 8 aa, Artificial Sequence
  Synthetic polypeptide representing artificial human antibody CDR-H2 region
ISGLGNSI

SEQ ID NO: 1170 - protein, 8 aa, Artificial Sequence
  Synthetic polypeptide representing artificial human antibody CDR-H2 region
ISDDGNDK

SEQ ID NO: 1171 - protein, 8 aa, Artificial Sequence
  Synthetic polypeptide representing artificial human antibody CDR-H2 region
ISWDGGST

SEQ ID NO: 1172 - protein, 8 aa, Artificial Sequence
  Synthetic polypeptide representing artificial human antibody CDR-H2 region
INTNNGKT

SEQ ID NO: 1173 - protein, 8 aa, Artificial Sequence
  Synthetic polypeptide representing artificial human antibody CDR-H2 region
IDWSGKTT

SEQ ID NO: 1174 - protein, 8 aa, Artificial Sequence
  Synthetic polypeptide representing artificial human antibody CDR-H2 region
ISGSGGST

SEQ ID NO: 1175 - protein, 8 aa, Artificial Sequence
  Synthetic polypeptide representing artificial human antibody CDR-H2 region
VSYDGTNK

SEQ ID NO: 1176 - protein, 8 aa, Artificial Sequence
  Synthetic polypeptide representing artificial human antibody CDR-H2 region
ITSTSSYL

SEQ ID NO: 1177 - protein, 7 aa, Artificial Sequence
  Synthetic polypeptide representing artificial human antibody CDR-H2 region
IYTSGST

SEQ ID NO: 1178 - protein, 7 aa, Artificial Sequence
  Synthetic polypeptide representing artificial human antibody CDR-H2 region
VYYSGRT

SEQ ID NO: 1179 - protein, 8 aa, Artificial Sequence
  Synthetic polypeptide representing artificial human antibody CDR-H2 region
VSYDGTNK

SEQ ID NO: 1180 - protein, 8 aa, Artificial Sequence
  Synthetic polypeptide representing artificial human antibody CDR-H2 region
IYPVDSDT

SEQ ID NO: 1181 - protein, 8 aa, Artificial Sequence
  Synthetic polypeptide representing artificial human antibody CDR-H2 region
TGGSGYTK

SEQ ID NO: 1182 - protein, 8 aa, Artificial Sequence
  Synthetic polypeptide representing artificial human antibody CDR-H2 region
ISSSGSTI

SEQ ID NO: 1183 - protein, 8 aa, Artificial Sequence
  Synthetic polypeptide representing artificial human antibody CDR-H2 region
IKEDGSEK

SEQ ID NO: 1184 - protein, 7 aa, Artificial Sequence
  Synthetic polypeptide representing artificial human antibody CDR-H2 region
IYYSGST

SEQ ID NO: 1185 - protein, 8 aa, Artificial Sequence
  Synthetic polypeptide representing artificial human antibody CDR-H2 region
ISYDGSNK

SEQ ID NO: 1186 - protein, 8 aa, Artificial Sequence
  Synthetic polypeptide representing artificial human antibody CDR-H2 region
IGSSTTAI

SEQ ID NO: 1187 - protein, 7 aa, Artificial Sequence
  Synthetic polypeptide representing artificial human antibody CDR-H2 region
ISYSGST

SEQ ID NO: 1188 - protein, 7 aa, Artificial Sequence
  Synthetic polypeptide representing artificial human antibody CDR-H2 region
IYYSGST

SEQ ID NO: 1189 - protein, 7 aa, Artificial Sequence
  Synthetic polypeptide representing artificial human antibody CDR-H2 region
ISYSGST

SEQ ID NO: 1190 - protein, 8 aa, Artificial Sequence
  Synthetic polypeptide representing artificial human antibody CDR-H2 region
IKQDGSEK

SEQ ID NO: 1191 - protein, 8 aa, Artificial Sequence
  Synthetic polypeptide representing artificial human antibody CDR-H2 region
ISWNSGSI

SEQ ID NO: 1192 - protein, 8 aa, Artificial Sequence
  Synthetic polypeptide representing artificial human antibody CDR-H2 region
IYPGDSDT

SEQ ID NO: 1193 - protein, 9 aa, Artificial Sequence
  Synthetic polypeptide representing artificial human antibody CDR-H2 region
TYYRSQWMN

SEQ ID NO: 1194 - protein, 9 aa, Artificial Sequence
  Synthetic polypeptide representing artificial human antibody CDR-H2 region
TYYRSKWYN

SEQ ID NO: 1195 - protein, 7 aa, Artificial Sequence
  Synthetic polypeptide representing artificial human antibody CDR-H2 region
LFYSGST

SEQ ID NO: 1196 - protein, 8 aa, Artificial Sequence
  Synthetic polypeptide representing artificial human antibody CDR-H2 region
IYPGDSDT

SEQ ID NO: 1197 - protein, 8 aa, Artificial Sequence
  Synthetic polypeptide representing artificial human antibody CDR-H2 region
IWYDGSNK

SEQ ID NO: 1198 - protein, 8 aa, Artificial Sequence
  Synthetic polypeptide representing artificial human antibody CDR-H2 region
ISSSSRYV

SEQ ID NO: 1199 - protein, 8 aa, Artificial Sequence
  Synthetic polypeptide representing artificial human antibody CDR-H2 region
IIPILNIT

SEQ ID NO: 1200 - protein, 8 aa, Artificial Sequence
  Synthetic polypeptide representing artificial human antibody CDR-H2 region
ISSTSNYI

SEQ ID NO: 1201 - protein, 8 aa, Artificial Sequence
  Synthetic polypeptide representing artificial human antibody CDR-H2 region
ISYDGSDE

SEQ ID NO: 1202 - protein, 8 aa, Artificial Sequence
  Synthetic polypeptide representing artificial human antibody CDR-H2 region
IWHDGSHK

SEQ ID NO: 1203 - protein, 8 aa, Artificial Sequence
  Synthetic polypeptide representing artificial human antibody CDR-H2 region
ISGDGRST

SEQ ID NO: 1204 - protein, 8 aa, Artificial Sequence
  Synthetic polypeptide representing artificial human antibody CDR-H2 region
ISDDGKNK

SEQ ID NO: 1205 - protein, 8 aa, Artificial Sequence
  Synthetic polypeptide representing artificial human antibody CDR-H2 region
IKQDGSEK

SEQ ID NO: 1206 - protein, 8 aa, Artificial Sequence
  Synthetic polypeptide representing artificial human antibody CDR-H2 region
ISSDGSTT

SEQ ID NO: 1207 - protein, 10 aa, Artificial Sequence
  Synthetic polypeptide representing artificial human antibody CDR-H2 region
IRSKTDGGTT

SEQ ID NO: 1208 - protein, 7 aa, Artificial Sequence
  Synthetic polypeptide representing artificial human antibody CDR-H2 region
ISDIGDT

SEQ ID NO: 1209 - protein, 8 aa, Artificial Sequence
  Synthetic polypeptide representing artificial human antibody CDR-H2 region
IIPIFGTA

SEQ ID NO: 1210 - protein, 7 aa, Artificial Sequence
  Synthetic polypeptide representing artificial human antibody CDR-H2 region
IYFSGKT

SEQ ID NO: 1211 - protein, 8 aa, Artificial Sequence
  Synthetic polypeptide representing artificial human antibody CDR-H2 region
INRDGSYT

SEQ ID NO: 1212 - protein, 7 aa, Artificial Sequence
  Synthetic polypeptide representing artificial human antibody CDR-H2 region
VYYSGST

SEQ ID NO: 1213 - protein, 7 aa, Artificial Sequence
  Synthetic polypeptide representing artificial human antibody CDR-H2 region
VSPSGTN

SEQ ID NO: 1214 - protein, 8 aa, Artificial Sequence
  Synthetic polypeptide representing artificial human antibody CDR-H2 region
IIPIVGEA

SEQ ID NO: 1215 - protein, 8 aa, Artificial Sequence
  Synthetic polypeptide representing artificial human antibody CDR-H2 region
INSDGSST

SEQ ID NO: 1216 - protein, 7 aa, Artificial Sequence
  Synthetic polypeptide representing artificial human antibody CDR-H2 region
IYYNGST

SEQ ID NO: 1217 - protein, 8 aa, Artificial Sequence
  Synthetic polypeptide representing artificial human antibody CDR-H2 region
ISGSGGST

SEQ ID NO: 1218 - protein, 8 aa, Artificial Sequence
  Synthetic polypeptide representing artificial human antibody CDR-H2 region
ISASGRTT

SEQ ID NO: 1219 - protein, 8 aa, Artificial Sequence
  Synthetic polypeptide representing artificial human antibody CDR-H2 region
ITANGGST

SEQ ID NO: 1220 - protein, 7 aa, Artificial Sequence
  Synthetic polypeptide representing artificial human antibody CDR-H2 region
IYHRGTS

SEQ ID NO: 1221 - protein, 8 aa, Artificial Sequence
  Synthetic polypeptide representing artificial human antibody CDR-H2 region
ISFDGSNQ

SEQ ID NO: 1222 - protein, 8 aa, Artificial Sequence
  Synthetic polypeptide representing artificial human antibody CDR-H2 region
IDPSGGSR

SEQ ID NO: 1223 - protein, 8 aa, Artificial Sequence
  Synthetic polypeptide representing artificial human antibody CDR-H2 region
INTDGSST

SEQ ID NO: 1224 - protein, 8 aa, Artificial Sequence
  Synthetic polypeptide representing artificial human antibody CDR-H2 region
FDPEGGET

SEQ ID NO: 1225 - protein, 7 aa, Artificial Sequence
  Synthetic polypeptide representing artificial human antibody CDR-H2 region
IYYNGDT

SEQ ID NO: 1226 - protein, 8 aa, Artificial Sequence
  Synthetic polypeptide representing artificial human antibody CDR-H2 region
ISAYTGNT

SEQ ID NO: 1227 - protein, 8 aa, Artificial Sequence
  Synthetic polypeptide representing artificial human antibody CDR-H2 region
IIWNSGTT

SEQ ID NO: 1228 - protein, 8 aa, Artificial Sequence
  Synthetic polypeptide representing artificial human antibody CDR-H2 region
INTDGSRG

SEQ ID NO: 1229 - protein, 7 aa, Artificial Sequence
  Synthetic polypeptide representing artificial human antibody CDR-H2 region
IYHSGST

SEQ ID NO: 1230 - protein, 10 aa, Artificial Sequence
  Synthetic polypeptide representing artificial human antibody CDR-H2 region
IKSKSDGGST

SEQ ID NO: 1231 - protein, 7 aa, Artificial Sequence
  Synthetic polypeptide representing artificial human antibody CDR-H2 region
IYSGGTT

SEQ ID NO: 1232 - protein, 10 aa, Artificial Sequence
  Synthetic polypeptide representing artificial human antibody CDR-H2 region
IKNRANSYNT

SEQ ID NO: 1233 - protein, 8 aa, Artificial Sequence
  Synthetic polypeptide representing artificial human antibody CDR-H2 region
ISFDGSDK

SEQ ID NO: 1234 - protein, 8 aa, Artificial Sequence
  Synthetic polypeptide representing artificial human antibody CDR-H2 region
ITAGGSFI

SEQ ID NO: 1235 - protein, 8 aa, Artificial Sequence
  Synthetic polypeptide representing artificial human antibody CDR-H2 region
INPNSGGT

SEQ ID NO: 1236 - protein, 8 aa, Artificial Sequence
  Synthetic polypeptide representing artificial human antibody CDR-H2 region
ISYSGGST

SEQ ID NO: 1237 - protein, 8 aa, Artificial Sequence
  Synthetic polypeptide representing artificial human antibody CDR-H2 region
ISSSGGDI

SEQ ID NO: 1238 - protein, 8 aa, Artificial Sequence
  Synthetic polypeptide representing artificial human antibody CDR-H2 region
ISWNSGDI

SEQ ID NO: 1239 - protein, 2 aa, Artificial Sequence
  Synthetic polypeptide representing artificial human antibody CDR-H2 region
MA

SEQ ID NO: 1240 - protein, 8 aa, Artificial Sequence
  Synthetic polypeptide representing artificial human antibody CDR-H2 region
IGGSGGYT

SEQ ID NO: 1241 - protein, 7 aa, Artificial Sequence
  Synthetic polypeptide representing artificial human antibody CDR-H2 region
IFHSGSA

SEQ ID NO: 1242 - protein, 8 aa, Artificial Sequence
  Synthetic polypeptide representing artificial human antibody CDR-H2 region
MITTFGKA

SEQ ID NO: 1243 - protein, 7 aa, Artificial Sequence
  Synthetic polypeptide representing artificial human antibody CDR-H2 region
IYYSGST

SEQ ID NO: 1244 - protein, 8 aa, Artificial Sequence
  Synthetic polypeptide representing artificial human antibody CDR-H2 region
ISAYNGNT

SEQ ID NO: 1245 - protein, 8 aa, Artificial Sequence
  Synthetic polypeptide representing artificial human antibody CDR-H2 region
INTVTGIP

SEQ ID NO: 1246 - protein, 7 aa, Artificial Sequence
  Synthetic polypeptide representing artificial human antibody CDR-H2 region
VYYSGST

SEQ ID NO: 1247 - protein, 8 aa, Artificial Sequence
  Synthetic polypeptide representing artificial human antibody CDR-H2 region
IAYDGSQK

SEQ ID NO: 1248 - protein, 8 aa, Artificial Sequence
  Synthetic polypeptide representing artificial human antibody CDR-H2 region
IIPVFGTT

SEQ ID NO: 1249 - protein, 8 aa, Artificial Sequence
  Synthetic polypeptide representing artificial human antibody CDR-H2 region
INAGNGDT

SEQ ID NO: 1250 - protein, 7 aa, Artificial Sequence
  Synthetic polypeptide representing artificial human antibody CDR-H2 region
IYHSGST

SEQ ID NO: 1251 - protein, 8 aa, Artificial Sequence
  Synthetic polypeptide representing artificial human antibody CDR-H2 region
VEGYRSEE

SEQ ID NO: 1252 - protein, 8 aa, Artificial Sequence
  Synthetic polypeptide representing artificial human antibody CDR-H2 region
ISASGGGT

SEQ ID NO: 1253 - protein, 7 aa, Artificial Sequence
  Synthetic polypeptide representing artificial human antibody CDR-H2 region
IYYSGTS

SEQ ID NO: 1254 - protein, 8 aa, Artificial Sequence
  Synthetic polypeptide representing artificial human antibody CDR-H2 region
INPKTGDT

SEQ ID NO: 1255 - protein, 8 aa, Artificial Sequence
  Synthetic polypeptide representing artificial human antibody CDR-H2 region
ISYDGSNK

SEQ ID NO: 1256 - protein, 8 aa, Artificial Sequence
  Synthetic polypeptide representing artificial human antibody CDR-H2 region
ISSSSSYI

SEQ ID NO: 1257 - protein, 7 aa, Artificial Sequence
  Synthetic polypeptide representing artificial human antibody CDR-H2 region
IYYSGST

SEQ ID NO: 1258 - protein, 10 aa, Artificial Sequence
  Synthetic polypeptide representing artificial human antibody CDR-H2 region
IKSKTDGGTT

SEQ ID NO: 1259 - protein, 8 aa, Artificial Sequence
  Synthetic polypeptide representing artificial human antibody CDR-H2 region
INPSFGST

SEQ ID NO: 1260 - protein, 8 aa, Artificial Sequence
  Synthetic polypeptide representing artificial human antibody CDR-H2 region
IMPMFGRT

SEQ ID NO: 1261 - protein, 8 aa, Artificial Sequence
  Synthetic polypeptide representing artificial human antibody CDR-H2 region
ISSTGTTT

SEQ ID NO: 1262 - protein, 8 aa, Artificial Sequence
  Synthetic polypeptide representing artificial human antibody CDR-H2 region
ISNDGSNK

SEQ ID NO: 1263 - protein, 8 aa, Artificial Sequence
  Synthetic polypeptide representing artificial human antibody CDR-H2 region
IYPGDSDT

SEQ ID NO: 1264 - protein, 8 aa, Artificial Sequence
  Synthetic polypeptide representing artificial human antibody CDR-H2 region
ISRGSSVI

SEQ ID NO: 1265 - protein, 7 aa, Artificial Sequence
  Synthetic polypeptide representing artificial human antibody CDR-H2 region
IFSNDEK

SEQ ID NO: 1266 - protein, 8 aa, Artificial Sequence
  Synthetic polypeptide representing artificial human antibody CDR-H2 region
INPNSGGT

SEQ ID NO: 1267 - protein, 8 aa, Artificial Sequence
  Synthetic polypeptide representing artificial human antibody CDR-H2 region
ISAYNGNT

SEQ ID NO: 1268 - protein, 9 aa, Artificial Sequence
  Synthetic polypeptide representing artificial human antibody CDR-H2 region
TFYRTKWYS

SEQ ID NO: 1269 - protein, 7 aa, Artificial Sequence
  Synthetic polypeptide representing artificial human antibody CDR-H2 region
ICHSGST

SEQ ID NO: 1270 - protein, 7 aa, Artificial Sequence
  Synthetic polypeptide representing artificial human antibody CDR-H2 region
IYSGGST

SEQ ID NO: 1271 - protein, 8 aa, Artificial Sequence
  Synthetic polypeptide representing artificial human antibody CDR-H2 region
INPNGGTT

SEQ ID NO: 1272 - protein, 7 aa, Artificial Sequence
  Synthetic polypeptide representing artificial human antibody CDR-H2 region
IYYSGST

SEQ ID NO: 1273 - protein, 7 aa, Artificial Sequence
  Synthetic polypeptide representing artificial human antibody CDR-H2 region
IHYTGST

SEQ ID NO: 1274 - protein, 8 aa, Artificial Sequence
  Synthetic polypeptide representing artificial human antibody CDR-H2 region
ISYDGSNK

SEQ ID NO: 1275 - protein, 8 aa, Artificial Sequence
  Synthetic polypeptide representing artificial human antibody CDR-H2 region
ISGSGGST

SEQ ID NO: 1276 - protein, 7 aa, Artificial Sequence
  Synthetic polypeptide representing artificial human antibody CDR-H2 region
IYYSGST

SEQ ID NO: 1277 - protein, 8 aa, Artificial Sequence
  Synthetic polypeptide representing artificial human antibody CDR-H2 region
INPNSGGT

SEQ ID NO: 1278 - protein, 8 aa, Artificial Sequence
  Synthetic polypeptide representing artificial human antibody CDR-H2 region
INPADSDT

SEQ ID NO: 1279 - protein, 8 aa, Artificial Sequence
  Synthetic polypeptide representing artificial human antibody CDR-H2 region
IYPADSDT

SEQ ID NO: 1280 - protein, 8 aa, Artificial Sequence
  Synthetic polypeptide representing artificial human antibody CDR-H2 region
ISYSGNTT

SEQ ID NO: 1281 - protein, 8 aa, Artificial Sequence
  Synthetic polypeptide representing artificial human antibody CDR-H2 region
INPGGGST

SEQ ID NO: 1282 - protein, 8 aa, Artificial Sequence
  Synthetic polypeptide representing artificial human antibody CDR-H2 region
ITSPGGHT

SEQ ID NO: 1283 - protein, 8 aa, Artificial Sequence
  Synthetic polypeptide representing artificial human antibody CDR-H2 region
ISGSGGST

SEQ ID NO: 1284 - protein, 8 aa, Artificial Sequence
  Synthetic polypeptide representing artificial human antibody CDR-H2 region
INPVNGVT

SEQ ID NO: 1285 - protein, 8 aa, Artificial Sequence
  Synthetic polypeptide representing artificial human antibody CDR-H2 region
INTNTGNP

SEQ ID NO: 1286 - protein, 8 aa, Artificial Sequence
  Synthetic polypeptide representing artificial human antibody CDR-H2 region
ISSDGSNK

SEQ ID NO: 1287 - protein, 8 aa, Artificial Sequence
  Synthetic polypeptide representing artificial human antibody CDR-H2 region
VSGSGFTT

SEQ ID NO: 1288 - protein, 8 aa, Artificial Sequence
  Synthetic polypeptide representing artificial human antibody CDR-H2 region
ISSSSSYI

SEQ ID NO: 1289 - protein, 7 aa, Artificial Sequence
  Synthetic polypeptide representing artificial human antibody CDR-H2 region
INWDDDK

SEQ ID NO: 1290 - protein, 7 aa, Artificial Sequence
  Synthetic polypeptide representing artificial human antibody CDR-H2 region
IYWDDDT

SEQ ID NO: 1291 - protein, 7 aa, Artificial Sequence
  Synthetic polypeptide representing artificial human antibody CDR-H2 region
IYYIGTT

SEQ ID NO: 1292 - protein, 8 aa, Artificial Sequence
  Synthetic polypeptide representing artificial human antibody CDR-H2 region
INQDGGEK

SEQ ID NO: 1293 - protein, 8 aa, Artificial Sequence
  Synthetic polypeptide representing artificial human antibody CDR-H2 region
IIPVFGPP

SEQ ID NO: 1294 - protein, 8 aa, Artificial Sequence
  Synthetic polypeptide representing artificial human antibody CDR-H2 region
IVPIFDTT

SEQ ID NO: 1295 - protein, 8 aa, Artificial Sequence
  Synthetic polypeptide representing artificial human antibody CDR-H2 region
INAGNGNT

SEQ ID NO: 1296 - protein, 8 aa, Artificial Sequence
  Synthetic polypeptide representing artificial human antibody CDR-H2 region
ISPYNGNI

SEQ ID NO: 1297 - protein, 8 aa, Artificial Sequence
  Synthetic polypeptide representing artificial human antibody CDR-H2 region
ISGPGESS

SEQ ID NO: 1298 - protein, 8 aa, Artificial Sequence
  Synthetic polypeptide representing artificial human antibody CDR-H2 region
INPSGGYT

SEQ ID NO: 1299 - protein, 8 aa, Artificial Sequence
  Synthetic polypeptide representing artificial human antibody CDR-H2 region
VFPGDSDI

SEQ ID NO: 1300 - protein, 8 aa, Artificial Sequence
  Synthetic polypeptide representing artificial human antibody CDR-H2 region
IWYDGTNK

SEQ ID NO: 1301 - protein, 8 aa, Artificial Sequence
  Synthetic polypeptide representing artificial human antibody CDR-H2 region
IDPSDSYT

SEQ ID NO: 1302 - protein, 8 aa, Artificial Sequence
  Synthetic polypeptide representing artificial human antibody CDR-H2 region
ISGDGTRT

SEQ ID NO: 1303 - protein, 8 aa, Artificial Sequence
  Synthetic polypeptide representing artificial human antibody CDR-H2 region
TYHRTTTT

SEQ ID NO: 1304 - protein, 8 aa, Artificial Sequence
  Synthetic polypeptide representing artificial human antibody CDR-H2 region
ITPNSGTP

SEQ ID NO: 1305 - protein, 10 aa, Artificial Sequence
  Synthetic polypeptide representing artificial human antibody CDR-H2 region
IRSKAYGGTR

SEQ ID NO: 1306 - protein, 8 aa, Artificial Sequence
  Synthetic polypeptide representing artificial human antibody CDR-H2 region
ISGYNGRT

SEQ ID NO: 1307 - protein, 8 aa, Artificial Sequence
  Synthetic polypeptide representing artificial human antibody CDR-H2 region
MNADGSEK

SEQ ID NO: 1308 - protein, 8 aa, Artificial Sequence
  Synthetic polypeptide representing artificial human antibody CDR-H2 region
ISSSSSTI

SEQ ID NO: 1309 - protein, 7 aa, Artificial Sequence
  Synthetic polypeptide representing artificial human antibody CDR-H2 region
IYYSGST

SEQ ID NO: 1310 - protein, 7 aa, Artificial Sequence
  Synthetic polypeptide representing artificial human antibody CDR-H2 region
MFYGGST

SEQ ID NO: 1311 - protein, 8 aa, Artificial Sequence
  Synthetic polypeptide representing artificial human antibody CDR-H2 region
IWYDGSNE

SEQ ID NO: 1312 - protein, 8 aa, Artificial Sequence
  Synthetic polypeptide representing artificial human antibody CDR-H2 region
ISTDSGNT

SEQ ID NO: 1313 - protein, 8 aa, Artificial Sequence
  Synthetic polypeptide representing artificial human antibody CDR-H2 region
IHWNGGST

SEQ ID NO: 1314 - protein, 8 aa, Artificial Sequence
  Synthetic polypeptide representing artificial human antibody CDR-H2 region
MWYDGNNK

SEQ ID NO: 1315 - protein, 8 aa, Artificial Sequence
  Synthetic polypeptide representing artificial human antibody CDR-H2 region
ISGSGGRT

SEQ ID NO: 1316 - protein, 10 aa, Artificial Sequence
  Synthetic polypeptide representing artificial human antibody CDR-H2 region
IKTKTDGGTT

SEQ ID NO: 1317 - protein, 8 aa, Artificial Sequence
  Synthetic polypeptide representing artificial human antibody CDR-H2 region
IWHDGSKT

SEQ ID NO: 1318 - protein, 8 aa, Artificial Sequence
  Synthetic polypeptide representing artificial human antibody CDR-H2 region
ISPYTRQT

SEQ ID NO: 1319 - protein, 8 aa, Artificial Sequence
  Synthetic polypeptide representing artificial human antibody CDR-H2 region
TRFDGSEK

SEQ ID NO: 1320 - protein, 8 aa, Artificial Sequence
  Synthetic polypeptide representing artificial human antibody CDR-H2 region
ISHDGSNN

SEQ ID NO: 1321 - protein, 8 aa, Artificial Sequence
  Synthetic polypeptide representing artificial human antibody CDR-H2 region
IHVGNDHT

SEQ ID NO: 1322 - protein, 8 aa, Artificial Sequence
  Synthetic polypeptide representing artificial human antibody CDR-H2 region
FDPSDSYN

SEQ ID NO: 1323 - protein, 7 aa, Artificial Sequence
  Synthetic polypeptide representing artificial human antibody CDR-H2 region
IYWDDDK

SEQ ID NO: 1324 - protein, 8 aa, Artificial Sequence
  Synthetic polypeptide representing artificial human antibody CDR-H2 region
ISGDSRDI

SEQ ID NO: 1325 - protein, 8 aa, Artificial Sequence
  Synthetic polypeptide representing artificial human antibody CDR-H2 region
IIPVLGIP

SEQ ID NO: 1326 - protein, 7 aa, Artificial Sequence
  Synthetic polypeptide representing artificial human antibody CDR-H2 region
VYYSGNT

SEQ ID NO: 1327 - protein, 8 aa, Artificial Sequence
  Synthetic polypeptide representing artificial human antibody CDR-H2 region
ISSNGGST

SEQ ID NO: 1328 - protein, 8 aa, Artificial Sequence
  Synthetic polypeptide representing artificial human antibody CDR-H2 region
ISSSRSTI

SEQ ID NO: 1329 - protein, 7 aa, Artificial Sequence
  Synthetic polypeptide representing artificial human antibody CDR-H2 region
IIHTGTT

SEQ ID NO: 1330 - protein, 8 aa, Artificial Sequence
  Synthetic polypeptide representing artificial human antibody CDR-H2 region
INTDGTVT

SEQ ID NO: 1331 - protein, 7 aa, Artificial Sequence
  Synthetic polypeptide representing artificial human antibody CDR-H2 region
IYWDDDK

SEQ ID NO: 1332 - protein, 8 aa, Artificial Sequence
  Synthetic polypeptide representing artificial human antibody CDR-H2 region
ISYDGSNK

SEQ ID NO: 1333 - protein, 8 aa, Artificial Sequence
  Synthetic polypeptide representing artificial human antibody CDR-H2 region
ISSSGSTI

SEQ ID NO: 1334 - protein, 8 aa, Artificial Sequence
  Synthetic polypeptide representing artificial human antibody CDR-H2 region
ISSSSSTI

SEQ ID NO: 1335 - protein, 7 aa, Artificial Sequence
  Synthetic polypeptide representing artificial human antibody CDR-H2 region
IDWDDDK

SEQ ID NO: 1336 - protein, 8 aa, Artificial Sequence
  Synthetic polypeptide representing artificial human antibody CDR-H2 region
IKQDGSEK

SEQ ID NO: 1337 - protein, 8 aa, Artificial Sequence
  Synthetic polypeptide representing artificial human antibody CDR-H2 region
FVGSGDTT

SEQ ID NO: 1338 - protein, 8 aa, Artificial Sequence
  Synthetic polypeptide representing artificial human antibody CDR-H2 region
ISSSSSTK

SEQ ID NO: 1339 - protein, 8 aa, Artificial Sequence
  Synthetic polypeptide representing artificial human antibody CDR-H2 region
INPKTGAT

SEQ ID NO: 1340 - protein, 7 aa, Artificial Sequence
  Synthetic polypeptide representing artificial human antibody CDR-H2 region
IYASGST

SEQ ID NO: 1341 - protein, 8 aa, Artificial Sequence
  Synthetic polypeptide representing artificial human antibody CDR-H2 region
IYPGDSDT

SEQ ID NO: 1342 - protein, 10 aa, Artificial Sequence
  Synthetic polypeptide representing artificial human antibody CDR-H2 region
IKSKTDGGTT

SEQ ID NO: 1343 - protein, 8 aa, Artificial Sequence
  Synthetic polypeptide representing artificial human antibody CDR-H2 region
ISKDGNSK

SEQ ID NO: 1344 - protein, 10 aa, Artificial Sequence
  Synthetic polypeptide representing artificial human antibody CDR-H2 region
IRSKTKNYAT

SEQ ID NO: 1345 - protein, 7 aa, Artificial Sequence
  Synthetic polypeptide representing artificial human antibody CDR-H2 region
IYTSGST

SEQ ID NO: 1346 - protein, 10 aa, Artificial Sequence
  Synthetic polypeptide representing artificial human antibody CDR-H2 region
ISTKGYDETA

SEQ ID NO: 1347 - protein, 8 aa, Artificial Sequence
  Synthetic polypeptide representing artificial human antibody CDR-H2 region
IPYDGSNK

SEQ ID NO: 1348 - protein, 8 aa, Artificial Sequence
  Synthetic polypeptide representing artificial human antibody CDR-H2 region
ISTSTSTI

SEQ ID NO: 1349 - protein, 8 aa, Artificial Sequence
  Synthetic polypeptide representing artificial human antibody CDR-H2 region
ISSSGSTI

SEQ ID NO: 1350 - protein, 8 aa, Artificial Sequence
  Synthetic polypeptide representing artificial human antibody CDR-H2 region
ISSSSSTI

SEQ ID NO: 1351 - protein, 7 aa, Artificial Sequence
  Synthetic polypeptide representing artificial human antibody CDR-H2 region
MYSGGAT

SEQ ID NO: 1352 - protein, 8 aa, Artificial Sequence
  Synthetic polypeptide representing artificial human antibody CDR-H2 region
IYPGDSDT

SEQ ID NO: 1353 - protein, 10 aa, Artificial Sequence
  Synthetic polypeptide representing artificial human antibody CDR-H2 region
IRSKPNSYAT

SEQ ID NO: 1354 - protein, 8 aa, Artificial Sequence
  Synthetic polypeptide representing artificial human antibody CDR-H2 region
IWYDGSNE

SEQ ID NO: 1355 - protein, 8 aa, Artificial Sequence
  Synthetic polypeptide representing artificial human antibody CDR-H2 region
IWYDGSNK

SEQ ID NO: 1356 - protein, 3 aa, Artificial Sequence
  Synthetic polypeptide representing artificial human antibody CDR-L2 region
SAS

SEQ ID NO: 1357 - protein, 3 aa, Artificial Sequence
  Synthetic polypeptide representing artificial human antibody CDR-L2 region
AAS

SEQ ID NO: 1358 - protein, 3 aa, Artificial Sequence
  Synthetic polypeptide representing artificial human antibody CDR-L2 region
TAS

SEQ ID NO: 1359 - protein, 3 aa, Artificial Sequence
  Synthetic polypeptide representing artificial human antibody CDR-L2 region
RNN

SEQ ID NO: 1360 - protein, 3 aa, Artificial Sequence
  Synthetic polypeptide representing artificial human antibody CDR-L2 region
GKN

SEQ ID NO: 1361 - protein, 3 aa, Artificial Sequence
  Synthetic polypeptide representing artificial human antibody CDR-L2 region
YDS

SEQ ID NO: 1362 - protein, 3 aa, Artificial Sequence
  Synthetic polypeptide representing artificial human antibody CDR-L2 region
AAS

SEQ ID NO: 1363 - protein, 3 aa, Artificial Sequence
  Synthetic polypeptide representing artificial human antibody CDR-L2 region
DAS

SEQ ID NO: 1364 - protein, 3 aa, Artificial Sequence
  Synthetic polypeptide representing artificial human antibody CDR-L2 region
EDD

SEQ ID NO: 1365 - protein, 3 aa, Artificial Sequence
  Synthetic polypeptide representing artificial human antibody CDR-L2 region
GAS

SEQ ID NO: 1366 - protein, 3 aa, Artificial Sequence
  Synthetic polypeptide representing artificial human antibody CDR-L2 region
ENN

SEQ ID NO: 1367 - protein, 3 aa, Artificial Sequence
  Synthetic polypeptide representing artificial human antibody CDR-L2 region
MVS

SEQ ID NO: 1368 - protein, 3 aa, Artificial Sequence
  Synthetic polypeptide representing artificial human antibody CDR-L2 region
RDN

SEQ ID NO: 1369 - protein, 3 aa, Artificial Sequence
  Synthetic polypeptide representing artificial human antibody CDR-L2 region
SSS

SEQ ID NO: 1370 - protein, 3 aa, Artificial Sequence
  Synthetic polypeptide representing artificial human antibody CDR-L2 region
DAS

SEQ ID NO: 1371 - protein, 3 aa, Artificial Sequence
  Synthetic polypeptide representing artificial human antibody CDR-L2 region
GAS

SEQ ID NO: 1372 - protein, 3 aa, Artificial Sequence
  Synthetic polypeptide representing artificial human antibody CDR-L2 region
KDS

SEQ ID NO: 1373 - protein, 3 aa, Artificial Sequence
  Synthetic polypeptide representing artificial human antibody CDR-L2 region
DAS

SEQ ID NO: 1374 - protein, 3 aa, Artificial Sequence
  Synthetic polypeptide representing artificial human antibody CDR-L2 region
DAS

SEQ ID NO: 1375 - protein, 3 aa, Artificial Sequence
  Synthetic polypeptide representing artificial human antibody CDR-L2 region
AAS

SEQ ID NO: 1376 - protein, 3 aa, Artificial Sequence
  Synthetic polypeptide representing artificial human antibody CDR-L2 region
WAS

SEQ ID NO: 1377 - protein, 3 aa, Artificial Sequence
  Synthetic polypeptide representing artificial human antibody CDR-L2 region
GAS

SEQ ID NO: 1378 - protein, 3 aa, Artificial Sequence
  Synthetic polypeptide representing artificial human antibody CDR-L2 region
EVS

SEQ ID NO: 1379 - protein, 3 aa, Artificial Sequence
  Synthetic polypeptide representing artificial human antibody CDR-L2 region
RID

SEQ ID NO: 1380 - protein, 3 aa, Artificial Sequence
  Synthetic polypeptide representing artificial human antibody CDR-L2 region
AAS

SEQ ID NO: 1381 - protein, 3 aa, Artificial Sequence
  Synthetic polypeptide representing artificial human antibody CDR-L2 region
AAS

SEQ ID NO: 1382 - protein, 3 aa, Artificial Sequence
  Synthetic polypeptide representing artificial human antibody CDR-L2 region
GDS

SEQ ID NO: 1383 - protein, 3 aa, Artificial Sequence
  Synthetic polypeptide representing artificial human antibody CDR-L2 region
DDS

SEQ ID NO: 1384 - protein, 3 aa, Artificial Sequence
  Synthetic polypeptide representing artificial human antibody CDR-L2 region
AAS

SEQ ID NO: 1385 - protein, 3 aa, Artificial Sequence
  Synthetic polypeptide representing artificial human antibody CDR-L2 region
EDI

SEQ ID NO: 1386 - protein, 3 aa, Artificial Sequence
  Synthetic polypeptide representing artificial human antibody CDR-L2 region
EVS

SEQ ID NO: 1387 - protein, 3 aa, Artificial Sequence
  Synthetic polypeptide representing artificial human antibody CDR-L2 region
DNN

SEQ ID NO: 1388 - protein, 3 aa, Artificial Sequence
  Synthetic polypeptide representing artificial human antibody CDR-L2 region
KVS

SEQ ID NO: 1389 - protein, 3 aa, Artificial Sequence
  Synthetic polypeptide representing artificial human antibody CDR-L2 region
GAS

SEQ ID NO: 1390 - protein, 3 aa, Artificial Sequence
  Synthetic polypeptide representing artificial human antibody CDR-L2 region
GNI

SEQ ID NO: 1391 - protein, 3 aa, Artificial Sequence
  Synthetic polypeptide representing artificial human antibody CDR-L2 region
AAS

SEQ ID NO: 1392 - protein, 3 aa, Artificial Sequence
  Synthetic polypeptide representing artificial human antibody CDR-L2 region
WAS

SEQ ID NO: 1393 - protein, 3 aa, Artificial Sequence
  Synthetic polypeptide representing artificial human antibody CDR-L2 region
RNN

SEQ ID NO: 1394 - protein, 3 aa, Artificial Sequence
  Synthetic polypeptide representing artificial human antibody CDR-L2 region
EDK

SEQ ID NO: 1395 - protein, 3 aa, Artificial Sequence
  Synthetic polypeptide representing artificial human antibody CDR-L2 region
AAS

SEQ ID NO: 1396 - protein, 3 aa, Artificial Sequence
  Synthetic polypeptide representing artificial human antibody CDR-L2 region
YDS

SEQ ID NO: 1397 - protein, 3 aa, Artificial Sequence
  Synthetic polypeptide representing artificial human antibody CDR-L2 region
DVS

SEQ ID NO: 1398 - protein, 3 aa, Artificial Sequence
  Synthetic polypeptide representing artificial human antibody CDR-L2 region
AAS

SEQ ID NO: 1399 - protein, 3 aa, Artificial Sequence
  Synthetic polypeptide representing artificial human antibody CDR-L2 region
AAS

SEQ ID NO: 1400 - protein, 3 aa, Artificial Sequence
  Synthetic polypeptide representing artificial human antibody CDR-L2 region
GEN

SEQ ID NO: 1401 - protein, 3 aa, Artificial Sequence
  Synthetic polypeptide representing artificial human antibody CDR-L2 region
AAS

SEQ ID NO: 1402 - protein, 3 aa, Artificial Sequence
  Synthetic polypeptide representing artificial human antibody CDR-L2 region
AAS

SEQ ID NO: 1403 - protein, 3 aa, Artificial Sequence
  Synthetic polypeptide representing artificial human antibody CDR-L2 region
GAS

SEQ ID NO: 1404 - protein, 3 aa, Artificial Sequence
  Synthetic polypeptide representing artificial human antibody CDR-L2 region
GAS

SEQ ID NO: 1405 - protein, 3 aa, Artificial Sequence
  Synthetic polypeptide representing artificial human antibody CDR-L2 region
DSS

SEQ ID NO: 1406 - protein, 3 aa, Artificial Sequence
  Synthetic polypeptide representing artificial human antibody CDR-L2 region
KAS

SEQ ID NO: 1407 - protein, 3 aa, Artificial Sequence
  Synthetic polypeptide representing artificial human antibody CDR-L2 region
YDS

SEQ ID NO: 1408 - protein, 3 aa, Artificial Sequence
  Synthetic polypeptide representing artificial human antibody CDR-L2 region
DAS

SEQ ID NO: 1409 - protein, 3 aa, Artificial Sequence
  Synthetic polypeptide representing artificial human antibody CDR-L2 region
LGS

SEQ ID NO: 1410 - protein, 3 aa, Artificial Sequence
  Synthetic polypeptide representing artificial human antibody CDR-L2 region
KAS

SEQ ID NO: 1411 - protein, 3 aa, Artificial Sequence
  Synthetic polypeptide representing artificial human antibody CDR-L2 region
NIN

SEQ ID NO: 1412 - protein, 3 aa, Artificial Sequence
  Synthetic polypeptide representing artificial human antibody CDR-L2 region
GAS

SEQ ID NO: 1413 - protein, 3 aa, Artificial Sequence
  Synthetic polypeptide representing artificial human antibody CDR-L2 region
ADR

SEQ ID NO: 1414 - protein, 3 aa, Artificial Sequence
  Synthetic polypeptide representing artificial human antibody CDR-L2 region
KAS

SEQ ID NO: 1415 - protein, 3 aa, Artificial Sequence
  Synthetic polypeptide representing artificial human antibody CDR-L2 region
EAT

SEQ ID NO: 1416 - protein, 3 aa, Artificial Sequence
  Synthetic polypeptide representing artificial human antibody CDR-L2 region
GAS

SEQ ID NO: 1417 - protein, 3 aa, Artificial Sequence
  Synthetic polypeptide representing artificial human antibody CDR-L2 region
EDS

SEQ ID NO: 1418 - protein, 3 aa, Artificial Sequence
  Synthetic polypeptide representing artificial human antibody CDR-L2 region
LGS

SEQ ID NO: 1419 - protein, 3 aa, Artificial Sequence
  Synthetic polypeptide representing artificial human antibody CDR-L2 region
EVK

SEQ ID NO: 1420 - protein, 3 aa, Artificial Sequence
  Synthetic polypeptide representing artificial human antibody CDR-L2 region
DAS

SEQ ID NO: 1421 - protein, 3 aa, Artificial Sequence
  Synthetic polypeptide representing artificial human antibody CDR-L2 region
DVS

SEQ ID NO: 1422 - protein, 3 aa, Artificial Sequence
  Synthetic polypeptide representing artificial human antibody CDR-L2 region
EVS

SEQ ID NO: 1423 - protein, 3 aa, Artificial Sequence
  Synthetic polypeptide representing artificial human antibody CDR-L2 region
GAS

SEQ ID NO: 1424 - protein, 3 aa, Artificial Sequence
  Synthetic polypeptide representing artificial human antibody CDR-L2 region
AAS

SEQ ID NO: 1425 - protein, 3 aa, Artificial Sequence
  Synthetic polypeptide representing artificial human antibody CDR-L2 region
DNN

SEQ ID NO: 1426 - protein, 3 aa, Artificial Sequence
  Synthetic polypeptide representing artificial human antibody CDR-L2 region
DVS

SEQ ID NO: 1427 - protein, 3 aa, Artificial Sequence
  Synthetic polypeptide representing artificial human antibody CDR-L2 region
GAS

SEQ ID NO: 1428 - protein, 3 aa, Artificial Sequence
  Synthetic polypeptide representing artificial human antibody CDR-L2 region
KAS

SEQ ID NO: 1429 - protein, 3 aa, Artificial Sequence
  Synthetic polypeptide representing artificial human antibody CDR-L2 region
GKN

SEQ ID NO: 1430 - protein, 3 aa, Artificial Sequence
  Synthetic polypeptide representing artificial human antibody CDR-L2 region
AAS

SEQ ID NO: 1431 - protein, 3 aa, Artificial Sequence
  Synthetic polypeptide representing artificial human antibody CDR-L2 region
DAS

SEQ ID NO: 1432 - protein, 3 aa, Artificial Sequence
  Synthetic polypeptide representing artificial human antibody CDR-L2 region
ENN

SEQ ID NO: 1433 - protein, 3 aa, Artificial Sequence
  Synthetic polypeptide representing artificial human antibody CDR-L2 region
AAS

SEQ ID NO: 1434 - protein, 3 aa, Artificial Sequence
  Synthetic polypeptide representing artificial human antibody CDR-L2 region
WAS

SEQ ID NO: 1435 - protein, 3 aa, Artificial Sequence
  Synthetic polypeptide representing artificial human antibody CDR-L2 region
DAS

SEQ ID NO: 1436 - protein, 3 aa, Artificial Sequence
  Synthetic polypeptide representing artificial human antibody CDR-L2 region
AAS

SEQ ID NO: 1437 - protein, 3 aa, Artificial Sequence
  Synthetic polypeptide representing artificial human antibody CDR-L2 region
GNI

SEQ ID NO: 1438 - protein, 3 aa, Artificial Sequence
  Synthetic polypeptide representing artificial human antibody CDR-L2 region
GAS

SEQ ID NO: 1439 - protein, 3 aa, Artificial Sequence
  Synthetic polypeptide representing artificial human antibody CDR-L2 region
DAS

SEQ ID NO: 1440 - protein, 3 aa, Artificial Sequence
  Synthetic polypeptide representing artificial human antibody CDR-L2 region
NDH

SEQ ID NO: 1441 - protein, 3 aa, Artificial Sequence
  Synthetic polypeptide representing artificial human antibody CDR-L2 region
TVS

SEQ ID NO: 1442 - protein, 3 aa, Artificial Sequence
  Synthetic polypeptide representing artificial human antibody CDR-L2 region
QDS

SEQ ID NO: 1443 - protein, 3 aa, Artificial Sequence
  Synthetic polypeptide representing artificial human antibody CDR-L2 region
QHN

SEQ ID NO: 1444 - protein, 3 aa, Artificial Sequence
  Synthetic polypeptide representing artificial human antibody CDR-L2 region
WAS

SEQ ID NO: 1445 - protein, 3 aa, Artificial Sequence
  Synthetic polypeptide representing artificial human antibody CDR-L2 region
DAS

SEQ ID NO: 1446 - protein, 3 aa, Artificial Sequence
  Synthetic polypeptide representing artificial human antibody CDR-L2 region
DAS

SEQ ID NO: 1447 - protein, 3 aa, Artificial Sequence
  Synthetic polypeptide representing artificial human antibody CDR-L2 region
LGS

SEQ ID NO: 1448 - protein, 3 aa, Artificial Sequence
  Synthetic polypeptide representing artificial human antibody CDR-L2 region
LVS

SEQ ID NO: 1449 - protein, 3 aa, Artificial Sequence
  Synthetic polypeptide representing artificial human antibody CDR-L2 region
DND

SEQ ID NO: 1450 - protein, 3 aa, Artificial Sequence
  Synthetic polypeptide representing artificial human antibody CDR-L2 region
DAS

SEQ ID NO: 1451 - protein, 3 aa, Artificial Sequence
  Synthetic polypeptide representing artificial human antibody CDR-L2 region
LGS

SEQ ID NO: 1452 - protein, 3 aa, Artificial Sequence
  Synthetic polypeptide representing artificial human antibody CDR-L2 region
DVS

SEQ ID NO: 1453 - protein, 3 aa, Artificial Sequence
  Synthetic polypeptide representing artificial human antibody CDR-L2 region
KVS

SEQ ID NO: 1454 - protein, 3 aa, Artificial Sequence
  Synthetic polypeptide representing artificial human antibody CDR-L2 region
AAS

SEQ ID NO: 1455 - protein, 3 aa, Artificial Sequence
  Synthetic polypeptide representing artificial human antibody CDR-L2 region
DAS

SEQ ID NO: 1456 - protein, 3 aa, Artificial Sequence
  Synthetic polypeptide representing artificial human antibody CDR-L2 region
DDS

SEQ ID NO: 1457 - protein, 3 aa, Artificial Sequence
  Synthetic polypeptide representing artificial human antibody CDR-L2 region
AAS

SEQ ID NO: 1458 - protein, 3 aa, Artificial Sequence
  Synthetic polypeptide representing artificial human antibody CDR-L2 region
VAS

SEQ ID NO: 1459 - protein, 3 aa, Artificial Sequence
  Synthetic polypeptide representing artificial human antibody CDR-L2 region
KAS

SEQ ID NO: 1460 - protein, 3 aa, Artificial Sequence
  Synthetic polypeptide representing artificial human antibody CDR-L2 region
ELS

SEQ ID NO: 1461 - protein, 3 aa, Artificial Sequence
  Synthetic polypeptide representing artificial human antibody CDR-L2 region
AAS

SEQ ID NO: 1462 - protein, 3 aa, Artificial Sequence
  Synthetic polypeptide representing artificial human antibody CDR-L2 region
GNR

SEQ ID NO: 1463 - protein, 3 aa, Artificial Sequence
  Synthetic polypeptide representing artificial human antibody CDR-L2 region
YAS

SEQ ID NO: 1464 - protein, 3 aa, Artificial Sequence
  Synthetic polypeptide representing artificial human antibody CDR-L2 region
GAS

SEQ ID NO: 1465 - protein, 3 aa, Artificial Sequence
  Synthetic polypeptide representing artificial human antibody CDR-L2 region
SAS

SEQ ID NO: 1466 - protein, 3 aa, Artificial Sequence
  Synthetic polypeptide representing artificial human antibody CDR-L2 region
DAS

SEQ ID NO: 1467 - protein, 3 aa, Artificial Sequence
  Synthetic polypeptide representing artificial human antibody CDR-L2 region
DVS

SEQ ID NO: 1468 - protein, 3 aa, Artificial Sequence
  Synthetic polypeptide representing artificial human antibody CDR-L2 region
EDS

SEQ ID NO: 1469 - protein, 3 aa, Artificial Sequence
  Synthetic polypeptide representing artificial human antibody CDR-L2 region
GAS

SEQ ID NO: 1470 - protein, 3 aa, Artificial Sequence
  Synthetic polypeptide representing artificial human antibody CDR-L2 region
GAS

SEQ ID NO: 1471 - protein, 3 aa, Artificial Sequence
  Synthetic polypeptide representing artificial human antibody CDR-L2 region
DVN

SEQ ID NO: 1472 - protein, 3 aa, Artificial Sequence
  Synthetic polypeptide representing artificial human antibody CDR-L2 region
ADS

SEQ ID NO: 1473 - protein, 3 aa, Artificial Sequence
  Synthetic polypeptide representing artificial human antibody CDR-L2 region
AAS

SEQ ID NO: 1474 - protein, 3 aa, Artificial Sequence
  Synthetic polypeptide representing artificial human antibody CDR-L2 region
KNN

SEQ ID NO: 1475 - protein, 3 aa, Artificial Sequence
  Synthetic polypeptide representing artificial human antibody CDR-L2 region
EAT

SEQ ID NO: 1476 - protein, 3 aa, Artificial Sequence
  Synthetic polypeptide representing artificial human antibody CDR-L2 region
VAS

SEQ ID NO: 1477 - protein, 3 aa, Artificial Sequence
  Synthetic polypeptide representing artificial human antibody CDR-L2 region
AAS

SEQ ID NO: 1478 - protein, 3 aa, Artificial Sequence
  Synthetic polypeptide representing artificial human antibody CDR-L2 region
FRN

SEQ ID NO: 1479 - protein, 3 aa, Artificial Sequence
  Synthetic polypeptide representing artificial human antibody CDR-L2 region
DTS

SEQ ID NO: 1480 - protein, 3 aa, Artificial Sequence
  Synthetic polypeptide representing artificial human antibody CDR-L2 region
YDS

SEQ ID NO: 1481 - protein, 3 aa, Artificial Sequence
  Synthetic polypeptide representing artificial human antibody CDR-L2 region
EVI

SEQ ID NO: 1482 - protein, 3 aa, Artificial Sequence
  Synthetic polypeptide representing artificial human antibody CDR-L2 region
DAF

SEQ ID NO: 1483 - protein, 3 aa, Artificial Sequence
  Synthetic polypeptide representing artificial human antibody CDR-L2 region
DKD

SEQ ID NO: 1484 - protein, 3 aa, Artificial Sequence
  Synthetic polypeptide representing artificial human antibody CDR-L2 region
SAS

SEQ ID NO: 1485 - protein, 3 aa, Artificial Sequence
  Synthetic polypeptide representing artificial human antibody CDR-L2 region
RDD

SEQ ID NO: 1486 - protein, 3 aa, Artificial Sequence
  Synthetic polypeptide representing artificial human antibody CDR-L2 region
DDS

SEQ ID NO: 1487 - protein, 3 aa, Artificial Sequence
  Synthetic polypeptide representing artificial human antibody CDR-L2 region
KDT

SEQ ID NO: 1488 - protein, 3 aa, Artificial Sequence
  Synthetic polypeptide representing artificial human antibody CDR-L2 region
KDS

SEQ ID NO: 1489 - protein, 3 aa, Artificial Sequence
  Synthetic polypeptide representing artificial human antibody CDR-L2 region
EDT

SEQ ID NO: 1490 - protein, 3 aa, Artificial Sequence
  Synthetic polypeptide representing artificial human antibody CDR-L2 region
AAS

SEQ ID NO: 1491 - protein, 3 aa, Artificial Sequence
  Synthetic polypeptide representing artificial human antibody CDR-L2 region
DAS

SEQ ID NO: 1492 - protein, 3 aa, Artificial Sequence
  Synthetic polypeptide representing artificial human antibody CDR-L2 region
DES

SEQ ID NO: 1493 - protein, 3 aa, Artificial Sequence
  Synthetic polypeptide representing artificial human antibody CDR-L2 region
DVS

SEQ ID NO: 1494 - protein, 3 aa, Artificial Sequence
  Synthetic polypeptide representing artificial human antibody CDR-L2 region
QDT

SEQ ID NO: 1495 - protein, 3 aa, Artificial Sequence
  Synthetic polypeptide representing artificial human antibody CDR-L2 region
DND

SEQ ID NO: 1496 - protein, 3 aa, Artificial Sequence
  Synthetic polypeptide representing artificial human antibody CDR-L2 region
AAS

SEQ ID NO: 1497 - protein, 3 aa, Artificial Sequence
  Synthetic polypeptide representing artificial human antibody CDR-L2 region
GAS

SEQ ID NO: 1498 - protein, 3 aa, Artificial Sequence
  Synthetic polypeptide representing artificial human antibody CDR-L2 region
DVS

SEQ ID NO: 1499 - protein, 3 aa, Artificial Sequence
  Synthetic polypeptide representing artificial human antibody CDR-L2 region
TAS

SEQ ID NO: 1500 - protein, 3 aa, Artificial Sequence
  Synthetic polypeptide representing artificial human antibody CDR-L2 region
GAS

SEQ ID NO: 1501 - protein, 3 aa, Artificial Sequence
  Synthetic polypeptide representing artificial human antibody CDR-L2 region
KDN

SEQ ID NO: 1502 - protein, 3 aa, Artificial Sequence
  Synthetic polypeptide representing artificial human antibody CDR-L2 region
DVI

SEQ ID NO: 1503 - protein, 3 aa, Artificial Sequence
  Synthetic polypeptide representing artificial human antibody CDR-L2 region
GAS

SEQ ID NO: 1504 - protein, 3 aa, Artificial Sequence
  Synthetic polypeptide representing artificial human antibody CDR-L2 region
WAS

SEQ ID NO: 1505 - protein, 3 aa, Artificial Sequence
  Synthetic polypeptide representing artificial human antibody CDR-L2 region
RNT

SEQ ID NO: 1506 - protein, 3 aa, Artificial Sequence
  Synthetic polypeptide representing artificial human antibody CDR-L2 region
EVT

SEQ ID NO: 1507 - protein, 3 aa, Artificial Sequence
  Synthetic polypeptide representing artificial human antibody CDR-L2 region
KAS

SEQ ID NO: 1508 - protein, 3 aa, Artificial Sequence
  Synthetic polypeptide representing artificial human antibody CDR-L2 region
GAS

SEQ ID NO: 1509 - protein, 7 aa, Artificial Sequence
  Synthetic polypeptide representing artificial human antibody CDR-L2 region
LNSDGSH

SEQ ID NO: 1510 - protein, 3 aa, Artificial Sequence
  Synthetic polypeptide representing artificial human antibody CDR-L2 region
GAS

SEQ ID NO: 1511 - protein, 3 aa, Artificial Sequence
  Synthetic polypeptide representing artificial human antibody CDR-L2 region
ANS

SEQ ID NO: 1512 - protein, 3 aa, Artificial Sequence
  Synthetic polypeptide representing artificial human antibody CDR-L2 region
GNS

SEQ ID NO: 1513 - protein, 3 aa, Artificial Sequence
  Synthetic polypeptide representing artificial human antibody CDR-L2 region
LGS

SEQ ID NO: 1514 - protein, 3 aa, Artificial Sequence
  Synthetic polypeptide representing artificial human antibody CDR-L2 region
AAS

SEQ ID NO: 1515 - protein, 3 aa, Artificial Sequence
  Synthetic polypeptide representing artificial human antibody CDR-L2 region
SNN

SEQ ID NO: 1516 - protein, 3 aa, Artificial Sequence
  Synthetic polypeptide representing artificial human antibody CDR-L2 region
MGS

SEQ ID NO: 1517 - protein, 3 aa, Artificial Sequence
  Synthetic polypeptide representing artificial human antibody CDR-L2 region
GKN

SEQ ID NO: 1518 - protein, 3 aa, Artificial Sequence
  Synthetic polypeptide representing artificial human antibody CDR-L2 region
KAS

SEQ ID NO: 1519 - protein, 3 aa, Artificial Sequence
  Synthetic polypeptide representing artificial human antibody CDR-L2 region
WAS

SEQ ID NO: 1520 - protein, 3 aa, Artificial Sequence
  Synthetic polypeptide representing artificial human antibody CDR-L2 region
RNN

SEQ ID NO: 1521 - protein, 3 aa, Artificial Sequence
  Synthetic polypeptide representing artificial human antibody CDR-L2 region
AAS

SEQ ID NO: 1522 - protein, 3 aa, Artificial Sequence
  Synthetic polypeptide representing artificial human antibody CDR-L2 region
DDS

SEQ ID NO: 1523 - protein, 3 aa, Artificial Sequence
  Synthetic polypeptide representing artificial human antibody CDR-L2 region
ANN

SEQ ID NO: 1524 - protein, 3 aa, Artificial Sequence
  Synthetic polypeptide representing artificial human antibody CDR-L2 region
GEN

SEQ ID NO: 1525 - protein, 3 aa, Artificial Sequence
  Synthetic polypeptide representing artificial human antibody CDR-L2 region
DVT

SEQ ID NO: 1526 - protein, 3 aa, Artificial Sequence
  Synthetic polypeptide representing artificial human antibody CDR-L2 region
WAS

SEQ ID NO: 1527 - protein, 3 aa, Artificial Sequence
  Synthetic polypeptide representing artificial human antibody CDR-L2 region
EVS

SEQ ID NO: 1528 - protein, 3 aa, Artificial Sequence
  Synthetic polypeptide representing artificial human antibody CDR-L2 region
DAS

SEQ ID NO: 1529 - protein, 3 aa, Artificial Sequence
  Synthetic polypeptide representing artificial human antibody CDR-L2 region
DDS

SEQ ID NO: 1530 - protein, 3 aa, Artificial Sequence
  Synthetic polypeptide representing artificial human antibody CDR-L2 region
GAS

SEQ ID NO: 1531 - protein, 3 aa, Artificial Sequence
  Synthetic polypeptide representing artificial human antibody CDR-L2 region
ENN

SEQ ID NO: 1532 - protein, 3 aa, Artificial Sequence
  Synthetic polypeptide representing artificial human antibody CDR-L2 region
SDS

SEQ ID NO: 1533 - protein, 3 aa, Artificial Sequence
  Synthetic polypeptide representing artificial human antibody CDR-L2 region
GPS

SEQ ID NO: 1534 - protein, 3 aa, Artificial Sequence
  Synthetic polypeptide representing artificial human antibody CDR-L2 region
EGS

SEQ ID NO: 1535 - protein, 3 aa, Artificial Sequence
  Synthetic polypeptide representing artificial human antibody CDR-L2 region
MVS

SEQ ID NO: 1536 - protein, 3 aa, Artificial Sequence
  Synthetic polypeptide representing artificial human antibody CDR-L2 region
RNN

SEQ ID NO: 1537 - protein, 3 aa, Artificial Sequence
  Synthetic polypeptide representing artificial human antibody CDR-L2 region
GKN

SEQ ID NO: 1538 - protein, 3 aa, Artificial Sequence
  Synthetic polypeptide representing artificial human antibody CDR-L2 region
AAS

SEQ ID NO: 1539 - protein, 3 aa, Artificial Sequence
  Synthetic polypeptide representing artificial human antibody CDR-L2 region
DDS

SEQ ID NO: 1540 - protein, 3 aa, Artificial Sequence
  Synthetic polypeptide representing artificial human antibody CDR-L2 region
AAS

SEQ ID NO: 1541 - protein, 3 aa, Artificial Sequence
  Synthetic polypeptide representing artificial human antibody CDR-L2 region
DAS

SEQ ID NO: 1542 - protein, 3 aa, Artificial Sequence
  Synthetic polypeptide representing artificial human antibody CDR-L2 region
LGS

SEQ ID NO: 1543 - protein, 3 aa, Artificial Sequence
  Synthetic polypeptide representing artificial human antibody CDR-L2 region
QDS

SEQ ID NO: 1544 - protein, 3 aa, Artificial Sequence
  Synthetic polypeptide representing artificial human antibody CDR-L2 region
EDS

SEQ ID NO: 1545 - protein, 3 aa, Artificial Sequence
  Synthetic polypeptide representing artificial human antibody CDR-L2 region
GKN

SEQ ID NO: 1546 - protein, 3 aa, Artificial Sequence
  Synthetic polypeptide representing artificial human antibody CDR-L2 region
WAS

SEQ ID NO: 1547 - protein, 3 aa, Artificial Sequence
  Synthetic polypeptide representing artificial human antibody CDR-L2 region
LGS

SEQ ID NO: 1548 - protein, 3 aa, Artificial Sequence
  Synthetic polypeptide representing artificial human antibody CDR-L2 region
DVS

SEQ ID NO: 1549 - protein, 3 aa, Artificial Sequence
  Synthetic polypeptide representing artificial human antibody CDR-L2 region
WAS

SEQ ID NO: 1550 - protein, 3 aa, Artificial Sequence
  Synthetic polypeptide representing artificial human antibody CDR-L2 region
EGS

SEQ ID NO: 1551 - protein, 3 aa, Artificial Sequence
  Synthetic polypeptide representing artificial human antibody CDR-L2 region
EDS

SEQ ID NO: 1552 - protein, 3 aa, Artificial Sequence
  Synthetic polypeptide representing artificial human antibody CDR-L2 region
GAS

SEQ ID NO: 1553 - protein, 3 aa, Artificial Sequence
  Synthetic polypeptide representing artificial human antibody CDR-L2 region
GAS

SEQ ID NO: 1554 - protein, 3 aa, Artificial Sequence
  Synthetic polypeptide representing artificial human antibody CDR-L2 region
YDS

SEQ ID NO: 1555 - protein, 3 aa, Artificial Sequence
  Synthetic polypeptide representing artificial human antibody CDR-L2 region
DVI

SEQ ID NO: 1556 - protein, 3 aa, Artificial Sequence
  Synthetic polypeptide representing artificial human antibody CDR-L2 region
WAS

SEQ ID NO: 1557 - protein, 3 aa, Artificial Sequence
  Synthetic polypeptide representing artificial human antibody CDR-L2 region
DDS

SEQ ID NO: 1558 - protein, 3 aa, Artificial Sequence
  Synthetic polypeptide representing artificial human antibody CDR-L2 region
SAS

SEQ ID NO: 1559 - protein, 3 aa, Artificial Sequence
  Synthetic polypeptide representing artificial human antibody CDR-L2 region
SNN

SEQ ID NO: 1560 - protein, 3 aa, Artificial Sequence
  Synthetic polypeptide representing artificial human antibody CDR-L2 region
EDH

SEQ ID NO: 1561 - protein, 3 aa, Artificial Sequence
  Synthetic polypeptide representing artificial human antibody CDR-L2 region
GNS

SEQ ID NO: 1562 - protein, 3 aa, Artificial Sequence
  Synthetic polypeptide representing artificial human antibody CDR-L2 region
AAS

SEQ ID NO: 1563 - protein, 3 aa, Artificial Sequence
  Synthetic polypeptide representing artificial human antibody CDR-L2 region
AAS

SEQ ID NO: 1564 - protein, 3 aa, Artificial Sequence
  Synthetic polypeptide representing artificial human antibody CDR-L2 region
GAS

SEQ ID NO: 1565 - protein, 3 aa, Artificial Sequence
  Synthetic polypeptide representing artificial human antibody CDR-L2 region
EVT

SEQ ID NO: 1566 - protein, 3 aa, Artificial Sequence
  Synthetic polypeptide representing artificial human antibody CDR-L2 region
GAS

SEQ ID NO: 1567 - protein, 3 aa, Artificial Sequence
  Synthetic polypeptide representing artificial human antibody CDR-L2 region
GAS

SEQ ID NO: 1568 - protein, 3 aa, Artificial Sequence
  Synthetic polypeptide representing artificial human antibody CDR-L2 region
NTN

SEQ ID NO: 1569 - protein, 3 aa, Artificial Sequence
  Synthetic polypeptide representing artificial human antibody CDR-L2 region
GND

SEQ ID NO: 1570 - protein, 3 aa, Artificial Sequence
  Synthetic polypeptide representing artificial human antibody CDR-L2 region
ANT

SEQ ID NO: 1571 - protein, 3 aa, Artificial Sequence
  Synthetic polypeptide representing artificial human antibody CDR-L2 region
ETS

SEQ ID NO: 1572 - protein, 3 aa, Artificial Sequence
  Synthetic polypeptide representing artificial human antibody CDR-L2 region
DVS

SEQ ID NO: 1573 - protein, 3 aa, Artificial Sequence
  Synthetic polypeptide representing artificial human antibody CDR-L2 region
EGS

SEQ ID NO: 1574 - protein, 3 aa, Artificial Sequence
  Synthetic polypeptide representing artificial human antibody CDR-L2 region
WAS

SEQ ID NO: 1575 - protein, 3 aa, Artificial Sequence
  Synthetic polypeptide representing artificial human antibody CDR-L2 region
SNN

SEQ ID NO: 1576 - protein, 3 aa, Artificial Sequence
  Synthetic polypeptide representing artificial human antibody CDR-L2 region
DTS

SEQ ID NO: 1577 - protein, 3 aa, Artificial Sequence
  Synthetic polypeptide representing artificial human antibody CDR-L2 region
SNN

SEQ ID NO: 1578 - protein, 3 aa, Artificial Sequence
  Synthetic polypeptide representing artificial human antibody CDR-L2 region
DAS

SEQ ID NO: 1579 - protein, 3 aa, Artificial Sequence
  Synthetic polypeptide representing artificial human antibody CDR-L2 region
AAS

SEQ ID NO: 1580 - protein, 3 aa, Artificial Sequence
  Synthetic polypeptide representing artificial human antibody CDR-L2 region
GED

SEQ ID NO: 1581 - protein, 3 aa, Artificial Sequence
  Synthetic polypeptide representing artificial human antibody CDR-L2 region
WAS

SEQ ID NO: 1582 - protein, 3 aa, Artificial Sequence
  Synthetic polypeptide representing artificial human antibody CDR-L2 region
KVS

SEQ ID NO: 1583 - protein, 3 aa, Artificial Sequence
  Synthetic polypeptide representing artificial human antibody CDR-L2 region
EDS

SEQ ID NO: 1584 - protein, 3 aa, Artificial Sequence
  Synthetic polypeptide representing artificial human antibody CDR-L2 region
DDS

SEQ ID NO: 1585 - protein, 3 aa, Artificial Sequence
  Synthetic polypeptide representing artificial human antibody CDR-L2 region
AAS

SEQ ID NO: 1586 - protein, 3 aa, Artificial Sequence
  Synthetic polypeptide representing artificial human antibody CDR-L2 region
DAS

SEQ ID NO: 1587 - protein, 3 aa, Artificial Sequence
  Synthetic polypeptide representing artificial human antibody CDR-L2 region
WAS

SEQ ID NO: 1588 - protein, 3 aa, Artificial Sequence
  Synthetic polypeptide representing artificial human antibody CDR-L2 region
KDT

SEQ ID NO: 1589 - protein, 3 aa, Artificial Sequence
  Synthetic polypeptide representing artificial human antibody CDR-L2 region
RAS

SEQ ID NO: 1590 - protein, 3 aa, Artificial Sequence
  Synthetic polypeptide representing artificial human antibody CDR-L2 region
WAS

SEQ ID NO: 1591 - protein, 3 aa, Artificial Sequence
  Synthetic polypeptide representing artificial human antibody CDR-L2 region
QDT

SEQ ID NO: 1592 - protein, 3 aa, Artificial Sequence
  Synthetic polypeptide representing artificial human antibody CDR-L2 region
SNT

SEQ ID NO: 1593 - protein, 3 aa, Artificial Sequence
  Synthetic polypeptide representing artificial human antibody CDR-L2 region
DTD

SEQ ID NO: 1594 - protein, 3 aa, Artificial Sequence
  Synthetic polypeptide representing artificial human antibody CDR-L2 region
KAS

SEQ ID NO: 1595 - protein, 3 aa, Artificial Sequence
  Synthetic polypeptide representing artificial human antibody CDR-L2 region
WAS

SEQ ID NO: 1596 - protein, 3 aa, Artificial Sequence
  Synthetic polypeptide representing artificial human antibody CDR-L2 region
WAS

SEQ ID NO: 1597 - protein, 3 aa, Artificial Sequence
  Synthetic polypeptide representing artificial human antibody CDR-L2 region
EVN

SEQ ID NO: 1598 - protein, 3 aa, Artificial Sequence
  Synthetic polypeptide representing artificial human antibody CDR-L2 region
KVS

SEQ ID NO: 1599 - protein, 3 aa, Artificial Sequence
  Synthetic polypeptide representing artificial human antibody CDR-L2 region
QDS

SEQ ID NO: 1600 - protein, 3 aa, Artificial Sequence
  Synthetic polypeptide representing artificial human antibody CDR-L2 region
GAS

SEQ ID NO: 1601 - protein, 3 aa, Artificial Sequence
  Synthetic polypeptide representing artificial human antibody CDR-L2 region
KDN

SEQ ID NO: 1602 - protein, 3 aa, Artificial Sequence
  Synthetic polypeptide representing artificial human antibody CDR-L2 region
LGS

SEQ ID NO: 1603 - protein, 3 aa, Artificial Sequence
  Synthetic polypeptide representing artificial human antibody CDR-L2 region
DNN

SEQ ID NO: 1604 - protein, 3 aa, Artificial Sequence
  Synthetic polypeptide representing artificial human antibody CDR-L2 region
KAS

SEQ ID NO: 1605 - protein, 3 aa, Artificial Sequence
  Synthetic polypeptide representing artificial human antibody CDR-L2 region
KAS

SEQ ID NO: 1606 - protein, 3 aa, Artificial Sequence
  Synthetic polypeptide representing artificial human antibody CDR-L2 region
GNS

SEQ ID NO: 1607 - protein, 3 aa, Artificial Sequence
  Synthetic polypeptide representing artificial human antibody CDR-L2 region
KDS

SEQ ID NO: 1608 - protein, 3 aa, Artificial Sequence
  Synthetic polypeptide representing artificial human antibody CDR-L2 region
SAS

SEQ ID NO: 1609 - protein, 3 aa, Artificial Sequence
  Synthetic polypeptide representing artificial human antibody CDR-L2 region
GAS

SEQ ID NO: 1610 - protein, 3 aa, Artificial Sequence
  Synthetic polypeptide representing artificial human antibody CDR-L2 region
AAS

SEQ ID NO: 1611 - protein, 3 aa, Artificial Sequence
  Synthetic polypeptide representing artificial human antibody CDR-L2 region
AAS

SEQ ID NO: 1612 - protein, 3 aa, Artificial Sequence
  Synthetic polypeptide representing artificial human antibody CDR-L2 region
GAS

SEQ ID NO: 1613 - protein, 3 aa, Artificial Sequence
  Synthetic polypeptide representing artificial human antibody CDR-L2 region
YDR

SEQ ID NO: 1614 - protein, 3 aa, Artificial Sequence
  Synthetic polypeptide representing artificial human antibody CDR-L2 region
EDK

SEQ ID NO: 1615 - protein, 3 aa, Artificial Sequence
  Synthetic polypeptide representing artificial human antibody CDR-L2 region
LGS

SEQ ID NO: 1616 - protein, 3 aa, Artificial Sequence
  Synthetic polypeptide representing artificial human antibody CDR-L2 region
KAS

SEQ ID NO: 1617 - protein, 3 aa, Artificial Sequence
  Synthetic polypeptide representing artificial human antibody CDR-L2 region
SGS

SEQ ID NO: 1618 - protein, 3 aa, Artificial Sequence
  Synthetic polypeptide representing artificial human antibody CDR-L2 region
AAS

SEQ ID NO: 1619 - protein, 3 aa, Artificial Sequence
  Synthetic polypeptide representing artificial human antibody CDR-L2 region
WAS

SEQ ID NO: 1620 - protein, 3 aa, Artificial Sequence
  Synthetic polypeptide representing artificial human antibody CDR-L2 region
RNN

SEQ ID NO: 1621 - protein, 3 aa, Artificial Sequence
  Synthetic polypeptide representing artificial human antibody CDR-L2 region
EVS

SEQ ID NO: 1622 - protein, 3 aa, Artificial Sequence
  Synthetic polypeptide representing artificial human antibody CDR-L2 region
GNG

SEQ ID NO: 1623 - protein, 7 aa, Artificial Sequence
  Synthetic polypeptide representing artificial human antibody CDR-L2 region
QYSDSDK

SEQ ID NO: 1624 - protein, 3 aa, Artificial Sequence
  Synthetic polypeptide representing artificial human antibody CDR-L2 region
LGS

SEQ ID NO: 1625 - protein, 3 aa, Artificial Sequence
  Synthetic polypeptide representing artificial human antibody CDR-L2 region
AAS

SEQ ID NO: 1626 - protein, 3 aa, Artificial Sequence
  Synthetic polypeptide representing artificial human antibody CDR-L2 region
EVS

SEQ ID NO: 1627 - protein, 14 aa, Artificial Sequence
  Synthetic polypeptide representing artificial human antibody CDR-H3 region
ARVTLGSYFYGMDV

SEQ ID NO: 1628 - protein, 15 aa, Artificial Sequence
  Synthetic polypeptide representing artificial human antibody CDR-H3 region
ARDGGSGSYFDCFDY

SEQ ID NO: 1629 - protein, 18 aa, Artificial Sequence
  Synthetic polypeptide representing artificial human antibody CDR-H3 region
AKDINFFGLGTGGGAMDV

SEQ ID NO: 1630 - protein, 11 aa, Artificial Sequence
  Synthetic polypeptide representing artificial human antibody CDR-H3 region
AHRAIVGLFDY

SEQ ID NO: 1631 - protein, 14 aa, Artificial Sequence
  Synthetic polypeptide representing artificial human antibody CDR-H3 region
ARGGDGGPQDAFDI

SEQ ID NO: 1632 - protein, 17 aa, Artificial Sequence
  Synthetic polypeptide representing artificial human antibody CDR-H3 region
VKSFSAEYYYYYYGMDV

SEQ ID NO: 1633 - protein, 15 aa, Artificial Sequence
  Synthetic polypeptide representing artificial human antibody CDR-H3 region
ARVVPGDSVYGAFDI

SEQ ID NO: 1634 - protein, 13 aa, Artificial Sequence
  Synthetic polypeptide representing artificial human antibody CDR-H3 region
AKRTPFGEWAFDY

SEQ ID NO: 1635 - protein, 17 aa, Artificial Sequence
  Synthetic polypeptide representing artificial human antibody CDR-H3 region
AKDPGTFRDHLWSGVDY

SEQ ID NO: 1636 - protein, 16 aa, Artificial Sequence
  Synthetic polypeptide representing artificial human antibody CDR-H3 region
AKAAATLPYFRFAMDV

SEQ ID NO: 1637 - protein, 17 aa, Artificial Sequence
  Synthetic polypeptide representing artificial human antibody CDR-H3 region
ARVGVFKGLAPFGGFDP

SEQ ID NO: 1638 - protein, 11 aa, Artificial Sequence
  Synthetic polypeptide representing artificial human antibody CDR-H3 region
ARDSGGTPGPY

SEQ ID NO: 1639 - protein, 16 aa, Artificial Sequence
  Synthetic polypeptide representing artificial human antibody CDR-H3 region
VRSFVGAVPAYPNFDF

SEQ ID NO: 1640 - protein, 11 aa, Artificial Sequence
  Synthetic polypeptide representing artificial human antibody CDR-H3 region
VRGVVGATLDN

SEQ ID NO: 1641 - protein, 17 aa, Artificial Sequence
  Synthetic polypeptide representing artificial human antibody CDR-H3 region
VKDSRVTGQSSGYIFDS

SEQ ID NO: 1642 - protein, 11 aa, Artificial Sequence
  Synthetic polypeptide representing artificial human antibody CDR-H3 region
ARPRLGWYFDL

SEQ ID NO: 1643 - protein, 13 aa, Artificial Sequence
  Synthetic polypeptide representing artificial human antibody CDR-H3 region
ARETAGQLIPFDY

SEQ ID NO: 1644 - protein, 17 aa, Artificial Sequence
  Synthetic polypeptide representing artificial human antibody CDR-H3 region
ARDYMGVDFYYYYGMDV

SEQ ID NO: 1645 - protein, 14 aa, Artificial Sequence
  Synthetic polypeptide representing artificial human antibody CDR-H3 region
ARDIAVAITNYFGS

SEQ ID NO: 1646 - protein, 11 aa, Artificial Sequence
  Synthetic polypeptide representing artificial human antibody CDR-H3 region
AREHRSGYQRY

SEQ ID NO: 1647 - protein, 11 aa, Artificial Sequence
  Synthetic polypeptide representing artificial human antibody CDR-H3 region
AHFSTVINFGH

SEQ ID NO: 1648 - protein, 11 aa, Artificial Sequence
  Synthetic polypeptide representing artificial human antibody CDR-H3 region
ACRRIYQGFDP

SEQ ID NO: 1649 - protein, 10 aa, Artificial Sequence
  Synthetic polypeptide representing artificial human antibody CDR-H3 region
ARDRATSFDY

SEQ ID NO: 1650 - protein, 9 aa, Artificial Sequence
  Synthetic polypeptide representing artificial human antibody CDR-H3 region
ARGRGEMDV

SEQ ID NO: 1651 - protein, 14 aa, Artificial Sequence
  Synthetic polypeptide representing artificial human antibody CDR-H3 region
ATTPSSSWYWYFDP

SEQ ID NO: 1652 - protein, 16 aa, Artificial Sequence
  Synthetic polypeptide representing artificial human antibody CDR-H3 region
ARDLELIIAAGAPLDH

SEQ ID NO: 1653 - protein, 16 aa, Artificial Sequence
  Synthetic polypeptide representing artificial human antibody CDR-H3 region
ARLVTSPEEGGPWFDP

SEQ ID NO: 1654 - protein, 12 aa, Artificial Sequence
  Synthetic polypeptide representing artificial human antibody CDR-H3 region
ARDTEVGHHFDY

SEQ ID NO: 1655 - protein, 11 aa, Artificial Sequence
  Synthetic polypeptide representing artificial human antibody CDR-H3 region
AKPWRSDGFDV

SEQ ID NO: 1656 - protein, 11 aa, Artificial Sequence
  Synthetic polypeptide representing artificial human antibody CDR-H3 region
AVGMVTDGFEI

SEQ ID NO: 1657 - protein, 12 aa, Artificial Sequence
  Synthetic polypeptide representing artificial human antibody CDR-H3 region
ARLDLRTVRFDP

SEQ ID NO: 1658 - protein, 14 aa, Artificial Sequence
  Synthetic polypeptide representing artificial human antibody CDR-H3 region
ARHSSGPPRLAFDI

SEQ ID NO: 1659 - protein, 13 aa, Artificial Sequence
  Synthetic polypeptide representing artificial human antibody CDR-H3 region
AKDFAMPTVTTDY

SEQ ID NO: 1660 - protein, 13 aa, Artificial Sequence
  Synthetic polypeptide representing artificial human antibody CDR-H3 region
VHRPSLAYWYFDV

SEQ ID NO: 1661 - protein, 14 aa, Artificial Sequence
  Synthetic polypeptide representing artificial human antibody CDR-H3 region
VREGDSRKYYSLDY

SEQ ID NO: 1662 - protein, 13 aa, Artificial Sequence
  Synthetic polypeptide representing artificial human antibody CDR-H3 region
ARDPMWVSYAFDI

SEQ ID NO: 1663 - protein, 9 aa, Artificial Sequence
  Synthetic polypeptide representing artificial human antibody CDR-H3 region
ASGYVSFDL

SEQ ID NO: 1664 - protein, 16 aa, Artificial Sequence
  Synthetic polypeptide representing artificial human antibody CDR-H3 region
AREGAYESSGPDPFDI

SEQ ID NO: 1665 - protein, 15 aa, Artificial Sequence
  Synthetic polypeptide representing artificial human antibody CDR-H3 region
ASLFLTYYGSGTYYR

SEQ ID NO: 1666 - protein, 11 aa, Artificial Sequence
  Synthetic polypeptide representing artificial human antibody CDR-H3 region
AKSTLGGGFDF

SEQ ID NO: 1667 - protein, 18 aa, Artificial Sequence
  Synthetic polypeptide representing artificial human antibody CDR-H3 region
ARVGSSSWYSSGRSPFDY

SEQ ID NO: 1668 - protein, 16 aa, Artificial Sequence
  Synthetic polypeptide representing artificial human antibody CDR-H3 region
AKDQIVLEMATSPFDY

SEQ ID NO: 1669 - protein, 17 aa, Artificial Sequence
  Synthetic polypeptide representing artificial human antibody CDR-H3 region
ARDLSCSSTSCHDAFDI

SEQ ID NO: 1670 - protein, 16 aa, Artificial Sequence
  Synthetic polypeptide representing artificial human antibody CDR-H3 region
ARGPNFHESIRDGFDI

SEQ ID NO: 1671 - protein, 12 aa, Artificial Sequence
  Synthetic polypeptide representing artificial human antibody CDR-H3 region
ARVNWNSDTFDS

SEQ ID NO: 1672 - protein, 20 aa, Artificial Sequence
  Synthetic polypeptide representing artificial human antibody CDR-H3 region
ARDPGRDPYLDLDYHYGMDV

SEQ ID NO: 1673 - protein, 16 aa, Artificial Sequence
  Synthetic polypeptide representing artificial human antibody CDR-H3 region
ARDKRSGMTSDRRIDY

SEQ ID NO: 1674 - protein, 12 aa, Artificial Sequence
  Synthetic polypeptide representing artificial human antibody CDR-H3 region
SGGYYSSSHMDV

SEQ ID NO: 1675 - protein, 13 aa, Artificial Sequence
  Synthetic polypeptide representing artificial human antibody CDR-H3 region
ARVNIAAAGTLDY

SEQ ID NO: 1676 - protein, 21 aa, Artificial Sequence
  Synthetic polypeptide representing artificial human antibody CDR-H3 region
VKDMGPAGTASAYHYHNGMDV

SEQ ID NO: 1677 - protein, 12 aa, Artificial Sequence
  Synthetic polypeptide representing artificial human antibody CDR-H3 region
ARLTTSTSALSY

SEQ ID NO: 1678 - protein, 16 aa, Artificial Sequence
  Synthetic polypeptide representing artificial human antibody CDR-H3 region
ARENWNSAGTTEWFDP

SEQ ID NO: 1679 - protein, 10 aa, Artificial Sequence
  Synthetic polypeptide representing artificial human antibody CDR-H3 region
ARDTLQKGDY

SEQ ID NO: 1680 - protein, 19 aa, Artificial Sequence
  Synthetic polypeptide representing artificial human antibody CDR-H3 region
ARASRVLESKSWHGDAFDV

SEQ ID NO: 1681 - protein, 13 aa, Artificial Sequence
  Synthetic polypeptide representing artificial human antibody CDR-H3 region
ARGLGGSGYYFDY

SEQ ID NO: 1682 - protein, 17 aa, Artificial Sequence
  Synthetic polypeptide representing artificial human antibody CDR-H3 region
ARQAFCGANCWSGAYDI

SEQ ID NO: 1683 - protein, 19 aa, Artificial Sequence
  Synthetic polypeptide representing artificial human antibody CDR-H3 region
VRRGATVFQGKIIKGYMDV

SEQ ID NO: 1684 - protein, 10 aa, Artificial Sequence
  Synthetic polypeptide representing artificial human antibody CDR-H3 region
AKVKGGSNDY

SEQ ID NO: 1685 - protein, 13 aa, Artificial Sequence
  Synthetic polypeptide representing artificial human antibody CDR-H3 region
ARHLYGDFYYLDY

SEQ ID NO: 1686 - protein, 13 aa, Artificial Sequence
  Synthetic polypeptide representing artificial human antibody CDR-H3 region
ARDHRTGSYYPDY

SEQ ID NO: 1687 - protein, 15 aa, Artificial Sequence
  Synthetic polypeptide representing artificial human antibody CDR-H3 region
ARGVRQQQVRKWFDP

SEQ ID NO: 1688 - protein, 12 aa, Artificial Sequence
  Synthetic polypeptide representing artificial human antibody CDR-H3 region
AMDNSGSGGVDY

SEQ ID NO: 1689 - protein, 12 aa, Artificial Sequence
  Synthetic polypeptide representing artificial human antibody CDR-H3 region
ARDSYHYYGMDV

SEQ ID NO: 1690 - protein, 16 aa, Artificial Sequence
  Synthetic polypeptide representing artificial human antibody CDR-H3 region
ARETVYISTYYYGLDV

SEQ ID NO: 1691 - protein, 13 aa, Artificial Sequence
  Synthetic polypeptide representing artificial human antibody CDR-H3 region
ATDGPLHTSGLDY

SEQ ID NO: 1692 - protein, 13 aa, Artificial Sequence
  Synthetic polypeptide representing artificial human antibody CDR-H3 region
ACLGAEANDAFDI

SEQ ID NO: 1693 - protein, 7 aa, Artificial Sequence
  Synthetic polypeptide representing artificial human antibody CDR-H3 region
AKVPGDY

SEQ ID NO: 1694 - protein, 15 aa, Artificial Sequence
  Synthetic polypeptide representing artificial human antibody CDR-H3 region
ARAGLSTSWPSWFDP

SEQ ID NO: 1695 - protein, 14 aa, Artificial Sequence
  Synthetic polypeptide representing artificial human antibody CDR-H3 region
ARNDISFKQSAIDV

SEQ ID NO: 1696 - protein, 17 aa, Artificial Sequence
  Synthetic polypeptide representing artificial human antibody CDR-H3 region
AKTKTMGVGGEYFGLDV

SEQ ID NO: 1697 - protein, 16 aa, Artificial Sequence
  Synthetic polypeptide representing artificial human antibody CDR-H3 region
ARHKALWFGEAGAFDI

SEQ ID NO: 1698 - protein, 18 aa, Artificial Sequence
  Synthetic polypeptide representing artificial human antibody CDR-H3 region
AKDLLGFRDQRNYYGMDV

SEQ ID NO: 1699 - protein, 13 aa, Artificial Sequence
  Synthetic polypeptide representing artificial human antibody CDR-H3 region
ARSFYDTLFYFEN

SEQ ID NO: 1700 - protein, 12 aa, Artificial Sequence
  Synthetic polypeptide representing artificial human antibody CDR-H3 region
ARVYSTKWDFDY

SEQ ID NO: 1701 - protein, 11 aa, Artificial Sequence
  Synthetic polypeptide representing artificial human antibody CDR-H3 region
AKGGPLRPFDI

SEQ ID NO: 1702 - protein, 15 aa, Artificial Sequence
  Synthetic polypeptide representing artificial human antibody CDR-H3 region
ARLSRDGYTIEHFDY

SEQ ID NO: 1703 - protein, 19 aa, Artificial Sequence
  Synthetic polypeptide representing artificial human antibody CDR-H3 region
ARRGVSGGSAWTYYNFFDP

SEQ ID NO: 1704 - protein, 14 aa, Artificial Sequence
  Synthetic polypeptide representing artificial human antibody CDR-H3 region
ARELPVIGRRTFDI

SEQ ID NO: 1705 - protein, 22 aa, Artificial Sequence
  Synthetic polypeptide representing artificial human antibody CDR-H3 region
ARDSEVEKSDGYMASTAEYFQL

SEQ ID NO: 1706 - protein, 15 aa, Artificial Sequence
  Synthetic polypeptide representing artificial human antibody CDR-H3 region
VKAGVPWEVQRWFDP

SEQ ID NO: 1707 - protein, 12 aa, Artificial Sequence
  Synthetic polypeptide representing artificial human antibody CDR-H3 region
ARDRQGLGRMDV

SEQ ID NO: 1708 - protein, 12 aa, Artificial Sequence
  Synthetic polypeptide representing artificial human antibody CDR-H3 region
ARELGANYYFAY

SEQ ID NO: 1709 - protein, 15 aa, Artificial Sequence
  Synthetic polypeptide representing artificial human antibody CDR-H3 region
AREVDIRGDSDAFDI

SEQ ID NO: 1710 - protein, 10 aa, Artificial Sequence
  Synthetic polypeptide representing artificial human antibody CDR-H3 region
ATTRNSAFLN

SEQ ID NO: 1711 - protein, 14 aa, Artificial Sequence
  Synthetic polypeptide representing artificial human antibody CDR-H3 region
AKSAFGGVPDGFDI

SEQ ID NO: 1712 - protein, 7 aa, Artificial Sequence
  Synthetic polypeptide representing artificial human antibody CDR-H3 region
ARDGFDY

SEQ ID NO: 1713 - protein, 13 aa, Artificial Sequence
  Synthetic polypeptide representing artificial human antibody CDR-H3 region
AKAGYSFTTAPDY

SEQ ID NO: 1714 - protein, 14 aa, Artificial Sequence
  Synthetic polypeptide representing artificial human antibody CDR-H3 region
ARERGQVRSYGMDV

SEQ ID NO: 1715 - protein, 19 aa, Artificial Sequence
  Synthetic polypeptide representing artificial human antibody CDR-H3 region
VKIGGDGTAYAWTFRHFDS

SEQ ID NO: 1716 - protein, 13 aa, Artificial Sequence
  Synthetic polypeptide representing artificial human antibody CDR-H3 region
ARGLGGDWNYLAY

SEQ ID NO: 1717 - protein, 21 aa, Artificial Sequence
  Synthetic polypeptide representing artificial human antibody CDR-H3 region
AKEGGWGNTVTTSYYYYGMDV

SEQ ID NO: 1718 - protein, 14 aa, Artificial Sequence
  Synthetic polypeptide representing artificial human antibody CDR-H3 region
TRDGGYFATGEFDY

SEQ ID NO: 1719 - protein, 12 aa, Artificial Sequence
  Synthetic polypeptide representing artificial human antibody CDR-H3 region
ARERFGQGALDY

SEQ ID NO: 1720 - protein, 15 aa, Artificial Sequence
  Synthetic polypeptide representing artificial human antibody CDR-H3 region
ATIVAAYSYGFEFDP

SEQ ID NO: 1721 - protein, 21 aa, Artificial Sequence
  Synthetic polypeptide representing artificial human antibody CDR-H3 region
AKEGGWGNTVTTSYYYYGMDV

SEQ ID NO: 1722 - protein, 15 aa, Artificial Sequence
  Synthetic polypeptide representing artificial human antibody CDR-H3 region
ARQGFEALVIRGFDY

SEQ ID NO: 1723 - protein, 15 aa, Artificial Sequence
  Synthetic polypeptide representing artificial human antibody CDR-H3 region
ARRSTSSPSFSTLDV

SEQ ID NO: 1724 - protein, 10 aa, Artificial Sequence
  Synthetic polypeptide representing artificial human antibody CDR-H3 region
ARQMVTTRGY

SEQ ID NO: 1725 - protein, 16 aa, Artificial Sequence
  Synthetic polypeptide representing artificial human antibody CDR-H3 region
ARVPSRYGRSRGAFDI

SEQ ID NO: 1726 - protein, 12 aa, Artificial Sequence
  Synthetic polypeptide representing artificial human antibody CDR-H3 region
ARNLYRLGWFDP

SEQ ID NO: 1727 - protein, 13 aa, Artificial Sequence
  Synthetic polypeptide representing artificial human antibody CDR-H3 region
AKSKGNYRDAMDV

SEQ ID NO: 1728 - protein, 14 aa, Artificial Sequence
  Synthetic polypeptide representing artificial human antibody CDR-H3 region
ATSYTVTTFYGMDV

SEQ ID NO: 1729 - protein, 12 aa, Artificial Sequence
  Synthetic polypeptide representing artificial human antibody CDR-H3 region
ARGAAFYYGMDV

SEQ ID NO: 1730 - protein, 15 aa, Artificial Sequence
  Synthetic polypeptide representing artificial human antibody CDR-H3 region
ARDTYGDPRGDYFDY

SEQ ID NO: 1731 - protein, 17 aa, Artificial Sequence
  Synthetic polypeptide representing artificial human antibody CDR-H3 region
ARLWGSGDWWPSLYFDS

SEQ ID NO: 1732 - protein, 13 aa, Artificial Sequence
  Synthetic polypeptide representing artificial human antibody CDR-H3 region
ARIRRIAATSFDY

SEQ ID NO: 1733 - protein, 16 aa, Artificial Sequence
  Synthetic polypeptide representing artificial human antibody CDR-H3 region
AKIARRPPSFYDYMDV

SEQ ID NO: 1734 - protein, 16 aa, Artificial Sequence
  Synthetic polypeptide representing artificial human antibody CDR-H3 region
ARSTSSSTSDFHYMDV

SEQ ID NO: 1735 - protein, 10 aa, Artificial Sequence
  Synthetic polypeptide representing artificial human antibody CDR-H3 region
TRGWAFTSSD

SEQ ID NO: 1736 - protein, 8 aa, Artificial Sequence
  Synthetic polypeptide representing artificial human antibody CDR-H3 region
AGGWALGY

SEQ ID NO: 1737 - protein, 10 aa, Artificial Sequence
  Synthetic polypeptide representing artificial human antibody CDR-H3 region
ARHRIFGLDV

SEQ ID NO: 1738 - protein, 19 aa, Artificial Sequence
  Synthetic polypeptide representing artificial human antibody CDR-H3 region
ARRGPTDTWSGEVGYYFDY

SEQ ID NO: 1739 - protein, 16 aa, Artificial Sequence
  Synthetic polypeptide representing artificial human antibody CDR-H3 region
ARDGKTLGYGGNSVDY

SEQ ID NO: 1740 - protein, 15 aa, Artificial Sequence
  Synthetic polypeptide representing artificial human antibody CDR-H3 region
ARTETKWEDRGLWDY

SEQ ID NO: 1741 - protein, 10 aa, Artificial Sequence
  Synthetic polypeptide representing artificial human antibody CDR-H3 region
ARSFYGSGLQ

SEQ ID NO: 1742 - protein, 13 aa, Artificial Sequence
  Synthetic polypeptide representing artificial human antibody CDR-H3 region
ARAMGGYTYYLDD

SEQ ID NO: 1743 - protein, 17 aa, Artificial Sequence
  Synthetic polypeptide representing artificial human antibody CDR-H3 region
ARAGKDGYNFFYYGMDV

SEQ ID NO: 1744 - protein, 15 aa, Artificial Sequence
  Synthetic polypeptide representing artificial human antibody CDR-H3 region
ARGIMTTAISYYFDY

SEQ ID NO: 1745 - protein, 18 aa, Artificial Sequence
  Synthetic polypeptide representing artificial human antibody CDR-H3 region
AKGERDLTDYGDPEYFQH

SEQ ID NO: 1746 - protein, 18 aa, Artificial Sequence
  Synthetic polypeptide representing artificial human antibody CDR-H3 region
AKDLRYCSARSSCFGIDF

SEQ ID NO: 1747 - protein, 9 aa, Artificial Sequence
  Synthetic polypeptide representing artificial human antibody CDR-H3 region
ARRAYSFDY

SEQ ID NO: 1748 - protein, 18 aa, Artificial Sequence
  Synthetic polypeptide representing artificial human antibody CDR-H3 region
AREGAPDDYGDSGTAFDI

SEQ ID NO: 1749 - protein, 12 aa, Artificial Sequence
  Synthetic polypeptide representing artificial human antibody CDR-H3 region
TTDHPYGDYSDN

SEQ ID NO: 1750 - protein, 10 aa, Artificial Sequence
  Synthetic polypeptide representing artificial human antibody CDR-H3 region
AKELLGGFDY

SEQ ID NO: 1751 - protein, 13 aa, Artificial Sequence
  Synthetic polypeptide representing artificial human antibody CDR-H3 region
ARVFGSAAGAFDI

SEQ ID NO: 1752 - protein, 12 aa, Artificial Sequence
  Synthetic polypeptide representing artificial human antibody CDR-H3 region
ARHDWRLYAFDY

SEQ ID NO: 1753 - protein, 9 aa, Artificial Sequence
  Synthetic polypeptide representing artificial human antibody CDR-H3 region
AGGETSPDY

SEQ ID NO: 1754 - protein, 15 aa, Artificial Sequence
  Synthetic polypeptide representing artificial human antibody CDR-H3 region
VSRGPLGGAAAGPDY

SEQ ID NO: 1755 - protein, 10 aa, Artificial Sequence
  Synthetic polypeptide representing artificial human antibody CDR-H3 region
ARDVRGWFVP

SEQ ID NO: 1756 - protein, 19 aa, Artificial Sequence
  Synthetic polypeptide representing artificial human antibody CDR-H3 region
VRDRNIVSVPGAIPYGMDV

SEQ ID NO: 1757 - protein, 9 aa, Artificial Sequence
  Synthetic polypeptide representing artificial human antibody CDR-H3 region
ARGSDTLDY

SEQ ID NO: 1758 - protein, 12 aa, Artificial Sequence
  Synthetic polypeptide representing artificial human antibody CDR-H3 region
ARVGLTFALFDP

SEQ ID NO: 1759 - protein, 17 aa, Artificial Sequence
  Synthetic polypeptide representing artificial human antibody CDR-H3 region
ANSAGIQLWSSDNWFDP

SEQ ID NO: 1760 - protein, 10 aa, Artificial Sequence
  Synthetic polypeptide representing artificial human antibody CDR-H3 region
AKEGIELMIL

SEQ ID NO: 1761 - protein, 14 aa, Artificial Sequence
  Synthetic polypeptide representing artificial human antibody CDR-H3 region
ARGITLTRGVSFDY

SEQ ID NO: 1762 - protein, 9 aa, Artificial Sequence
  Synthetic polypeptide representing artificial human antibody CDR-H3 region
ARDGGAFDI

SEQ ID NO: 1763 - protein, 16 aa, Artificial Sequence
  Synthetic polypeptide representing artificial human antibody CDR-H3 region
ARDRLFTAINSGYFDY

SEQ ID NO: 1764 - protein, 11 aa, Artificial Sequence
  Synthetic polypeptide representing artificial human antibody CDR-H3 region
AREGSYYGIGY

SEQ ID NO: 1765 - protein, 14 aa, Artificial Sequence
  Synthetic polypeptide representing artificial human antibody CDR-H3 region
ARDTDSGWLDSFDY

SEQ ID NO: 1766 - protein, 21 aa, Artificial Sequence
  Synthetic polypeptide representing artificial human antibody CDR-H3 region
ATDQGCDDGSCYVGHYYGMDV

SEQ ID NO: 1767 - protein, 10 aa, Artificial Sequence
  Synthetic polypeptide representing artificial human antibody CDR-H3 region
GRIMTPSIDL

SEQ ID NO: 1768 - protein, 13 aa, Artificial Sequence
  Synthetic polypeptide representing artificial human antibody CDR-H3 region
AREGRGGGDFFDY

SEQ ID NO: 1769 - protein, 15 aa, Artificial Sequence
  Synthetic polypeptide representing artificial human antibody CDR-H3 region
AKDGDSLGDFSTFDI

SEQ ID NO: 1770 - protein, 12 aa, Artificial Sequence
  Synthetic polypeptide representing artificial human antibody CDR-H3 region
ARDGYDFRAFDH

SEQ ID NO: 1771 - protein, 20 aa, Artificial Sequence
  Synthetic polypeptide representing artificial human antibody CDR-H3 region
ARARGGGFCSNMDCPAMFDY

SEQ ID NO: 1772 - protein, 9 aa, Artificial Sequence
  Synthetic polypeptide representing artificial human antibody CDR-H3 region
TTIHDYGDH

SEQ ID NO: 1773 - protein, 10 aa, Artificial Sequence
  Synthetic polypeptide representing artificial human antibody CDR-H3 region
ARGLLRSLDV

SEQ ID NO: 1774 - protein, 14 aa, Artificial Sequence
  Synthetic polypeptide representing artificial human antibody CDR-H3 region
ARVKLGASSRVFDV

SEQ ID NO: 1775 - protein, 13 aa, Artificial Sequence
  Synthetic polypeptide representing artificial human antibody CDR-H3 region
ATTVTPKVTSFAS

SEQ ID NO: 1776 - protein, 15 aa, Artificial Sequence
  Synthetic polypeptide representing artificial human antibody CDR-H3 region
AREQSPLYFGPSLDV

SEQ ID NO: 1777 - protein, 12 aa, Artificial Sequence
  Synthetic polypeptide representing artificial human antibody CDR-H3 region
AREPYSSYAMDV

SEQ ID NO: 1778 - protein, 12 aa, Artificial Sequence
  Synthetic polypeptide representing artificial human antibody CDR-H3 region
AKDGSEMLLCDY

SEQ ID NO: 1779 - protein, 11 aa, Artificial Sequence
  Synthetic polypeptide representing artificial human antibody CDR-H3 region
ARDTRWRGLDS

SEQ ID NO: 1780 - protein, 13 aa, Artificial Sequence
  Synthetic polypeptide representing artificial human antibody CDR-H3 region
AKDLLAVPGLLDD

SEQ ID NO: 1781 - protein, 14 aa, Artificial Sequence
  Synthetic polypeptide representing artificial human antibody CDR-H3 region
ASRGGSSRRYGMGV

SEQ ID NO: 1782 - protein, 16 aa, Artificial Sequence
  Synthetic polypeptide representing artificial human antibody CDR-H3 region
VKLKGIGAMWTYAMDV

SEQ ID NO: 1783 - protein, 18 aa, Artificial Sequence
  Synthetic polypeptide representing artificial human antibody CDR-H3 region
ARDQGYGDYDYPRDWIEP

SEQ ID NO: 1784 - protein, 16 aa, Artificial Sequence
  Synthetic polypeptide representing artificial human antibody CDR-H3 region
ASVRDLVSGTTYYYHY

SEQ ID NO: 1785 - protein, 10 aa, Artificial Sequence
  Synthetic polypeptide representing artificial human antibody CDR-H3 region
ARYGDYSFDP

SEQ ID NO: 1786 - protein, 13 aa, Artificial Sequence
  Synthetic polypeptide representing artificial human antibody CDR-H3 region
ARVVDTVLADFDY

SEQ ID NO: 1787 - protein, 14 aa, Artificial Sequence
  Synthetic polypeptide representing artificial human antibody CDR-H3 region
ARSGGFGWSRDLDY

SEQ ID NO: 1788 - protein, 16 aa, Artificial Sequence
  Synthetic polypeptide representing artificial human antibody CDR-H3 region
ARHGFWSGPIPDAFDI

SEQ ID NO: 1789 - protein, 12 aa, Artificial Sequence
  Synthetic polypeptide representing artificial human antibody CDR-H3 region
AHEDYGSGNGNY

SEQ ID NO: 1790 - protein, 15 aa, Artificial Sequence
  Synthetic polypeptide representing artificial human antibody CDR-H3 region
ARDRDSGYERNCLDP

SEQ ID NO: 1791 - protein, 22 aa, Artificial Sequence
  Synthetic polypeptide representing artificial human antibody CDR-H3 region
ARGAPYGSRIYYDYDSYHGMDV

SEQ ID NO: 1792 - protein, 16 aa, Artificial Sequence
  Synthetic polypeptide representing artificial human antibody CDR-H3 region
ARGKFDWFPRVSSFDY

SEQ ID NO: 1793 - protein, 13 aa, Artificial Sequence
  Synthetic polypeptide representing artificial human antibody CDR-H3 region
AAAYYIDTSGFDY

SEQ ID NO: 1794 - protein, 18 aa, Artificial Sequence
  Synthetic polypeptide representing artificial human antibody CDR-H3 region
AKGRTYSNNWLFHWYFDL

SEQ ID NO: 1795 - protein, 13 aa, Artificial Sequence
  Synthetic polypeptide representing artificial human antibody CDR-H3 region
ARVFSTIFHGVDP

SEQ ID NO: 1796 - protein, 15 aa, Artificial Sequence
  Synthetic polypeptide representing artificial human antibody CDR-H3 region
ARHLSSGEYHYGLDV

SEQ ID NO: 1797 - protein, 13 aa, Artificial Sequence
  Synthetic polypeptide representing artificial human antibody CDR-H3 region
AKGKGIVGATFDY

SEQ ID NO: 1798 - protein, 18 aa, Artificial Sequence
  Synthetic polypeptide representing artificial human antibody CDR-H3 region
ARDALDFDWLLSAGGFDY

SEQ ID NO: 1799 - protein, 11 aa, Artificial Sequence
  Synthetic polypeptide representing artificial human antibody CDR-H3 region
ARLLVGGAFDI

SEQ ID NO: 1800 - protein, 18 aa, Artificial Sequence
  Synthetic polypeptide representing artificial human antibody CDR-H3 region
TPGSCSGGSCYSGDAFDI

SEQ ID NO: 1801 - protein, 15 aa, Artificial Sequence
  Synthetic polypeptide representing artificial human antibody CDR-H3 region
ARESLDSASYSTIAH

SEQ ID NO: 1802 - protein, 15 aa, Artificial Sequence
  Synthetic polypeptide representing artificial human antibody CDR-H3 region
ARDRGGNSWLDVFDM

SEQ ID NO: 1803 - protein, 15 aa, Artificial Sequence
  Synthetic polypeptide representing artificial human antibody CDR-H3 region
ARSPAAFGSESYFDS

SEQ ID NO: 1804 - protein, 17 aa, Artificial Sequence
  Synthetic polypeptide representing artificial human antibody CDR-H3 region
AKDLLEDPYFGDLLFDY

SEQ ID NO: 1805 - protein, 12 aa, Artificial Sequence
  Synthetic polypeptide representing artificial human antibody CDR-H3 region
VRTPAVGTDPDY

SEQ ID NO: 1806 - protein, 12 aa, Artificial Sequence
  Synthetic polypeptide representing artificial human antibody CDR-H3 region
SSGGSTSMVGRY

SEQ ID NO: 1807 - protein, 14 aa, Artificial Sequence
  Synthetic polypeptide representing artificial human antibody CDR-H3 region
ARMTPFKFGLCPDY

SEQ ID NO: 1808 - protein, 14 aa, Artificial Sequence
  Synthetic polypeptide representing artificial human antibody CDR-H3 region
ARVVVVGTDYGMDV

SEQ ID NO: 1809 - protein, 14 aa, Artificial Sequence
  Synthetic polypeptide representing artificial human antibody CDR-H3 region
ARDQGLERANWFDP

SEQ ID NO: 1810 - protein, 9 aa, Artificial Sequence
  Synthetic polypeptide representing artificial human antibody CDR-H3 region
ARGVRHFDY

SEQ ID NO: 1811 - protein, 12 aa, Artificial Sequence
  Synthetic polypeptide representing artificial human antibody CDR-H3 region
ARESPLTVVFDY

SEQ ID NO: 1812 - protein, 11 aa, Artificial Sequence
  Synthetic polypeptide representing artificial human antibody CDR-H3 region
ARESSAAGYDY

SEQ ID NO: 1813 - protein, 16 aa, Artificial Sequence
  Synthetic polypeptide representing artificial human antibody CDR-H3 region
ARKLMSGIVSRGWFDP

SEQ ID NO: 1814 - protein, 14 aa, Artificial Sequence
  Synthetic polypeptide representing artificial human antibody CDR-H3 region
ARDRGDYVTHWFDP

SEQ ID NO: 1815 - protein, 13 aa, Artificial Sequence
  Synthetic polypeptide representing artificial human antibody CDR-H3 region
ARHRVGDSPGLHY

SEQ ID NO: 1816 - protein, 12 aa, Artificial Sequence
  Synthetic polypeptide representing artificial human antibody CDR-H3 region
ASPIAVAAPFAY

SEQ ID NO: 1817 - protein, 17 aa, Artificial Sequence
  Synthetic polypeptide representing artificial human antibody CDR-H3 region
VKDYLAVGGTYYDYFDY

SEQ ID NO: 1818 - protein, 11 aa, Artificial Sequence
  Synthetic polypeptide representing artificial human antibody CDR-H3 region
ARHDYRNYFDY

SEQ ID NO: 1819 - protein, 15 aa, Artificial Sequence
  Synthetic polypeptide representing artificial human antibody CDR-H3 region
ATPPSRYGGNYYADY

SEQ ID NO: 1820 - protein, 11 aa, Artificial Sequence
  Synthetic polypeptide representing artificial human antibody CDR-H3 region
ARQGPTVAIDF

SEQ ID NO: 1821 - protein, 9 aa, Artificial Sequence
  Synthetic polypeptide representing artificial human antibody CDR-H3 region
ARRGREFDY

SEQ ID NO: 1822 - protein, 17 aa, Artificial Sequence
  Synthetic polypeptide representing artificial human antibody CDR-H3 region
AIQEKRELQLRRELDNY

SEQ ID NO: 1823 - protein, 10 aa, Artificial Sequence
  Synthetic polypeptide representing artificial human antibody CDR-H3 region
ARVFRYGMDV

SEQ ID NO: 1824 - protein, 10 aa, Artificial Sequence
  Synthetic polypeptide representing artificial human antibody CDR-H3 region
AIKEGYGLSD

SEQ ID NO: 1825 - protein, 12 aa, Artificial Sequence
  Synthetic polypeptide representing artificial human antibody CDR-H3 region
AKEDGYTQNFDY

SEQ ID NO: 1826 - protein, 14 aa, Artificial Sequence
  Synthetic polypeptide representing artificial human antibody CDR-H3 region
ARVLDFYGSSVLDY

SEQ ID NO: 1827 - protein, 8 aa, Artificial Sequence
  Synthetic polypeptide representing artificial human antibody CDR-H3 region
ARDRPGDY

SEQ ID NO: 1828 - protein, 11 aa, Artificial Sequence
  Synthetic polypeptide representing artificial human antibody CDR-H3 region
ARDLGVGSTTY

SEQ ID NO: 1829 - protein, 14 aa, Artificial Sequence
  Synthetic polypeptide representing artificial human antibody CDR-H3 region
VKDLEVSIGHNFDF

SEQ ID NO: 1830 - protein, 20 aa, Artificial Sequence
  Synthetic polypeptide representing artificial human antibody CDR-H3 region
ARDRGVVVVAATPYYYGMDV

SEQ ID NO: 1831 - protein, 17 aa, Artificial Sequence
  Synthetic polypeptide representing artificial human antibody CDR-H3 region
VHARDDYGDSAWSTGPV

SEQ ID NO: 1832 - protein, 17 aa, Artificial Sequence
  Synthetic polypeptide representing artificial human antibody CDR-H3 region
GHRRLLRGVTTTVYFDP

SEQ ID NO: 1833 - protein, 17 aa, Artificial Sequence
  Synthetic polypeptide representing artificial human antibody CDR-H3 region
ARGGELLGGFGYSGMDV

SEQ ID NO: 1834 - protein, 19 aa, Artificial Sequence
  Synthetic polypeptide representing artificial human antibody CDR-H3 region
AHYYYDSSGYYQNAEYFQY

SEQ ID NO: 1835 - protein, 21 aa, Artificial Sequence
  Synthetic polypeptide representing artificial human antibody CDR-H3 region
ARTQWGTDVEATNPYYYFMDV

SEQ ID NO: 1836 - protein, 12 aa, Artificial Sequence
  Synthetic polypeptide representing artificial human antibody CDR-H3 region
ARDQSGADRFDS

SEQ ID NO: 1837 - protein, 13 aa, Artificial Sequence
  Synthetic polypeptide representing artificial human antibody CDR-H3 region
ARSSKWTDWHFDY

SEQ ID NO: 1838 - protein, 14 aa, Artificial Sequence
  Synthetic polypeptide representing artificial human antibody CDR-H3 region
ARDLDEINSSWLDP

SEQ ID NO: 1839 - protein, 17 aa, Artificial Sequence
  Synthetic polypeptide representing artificial human antibody CDR-H3 region
AKRPTAGNSYGGYYFDH

SEQ ID NO: 1840 - protein, 19 aa, Artificial Sequence
  Synthetic polypeptide representing artificial human antibody CDR-H3 region
ARRGEVGTMVRVFRKPFDY

SEQ ID NO: 1841 - protein, 18 aa, Artificial Sequence
  Synthetic polypeptide representing artificial human antibody CDR-H3 region
ATTSTMPMPTRGRDWFDP

SEQ ID NO: 1842 - protein, 11 aa, Artificial Sequence
  Synthetic polypeptide representing artificial human antibody CDR-H3 region
AGAHGDYGLDY

SEQ ID NO: 1843 - protein, 15 aa, Artificial Sequence
  Synthetic polypeptide representing artificial human antibody CDR-H3 region
ARHQQKYSPISPLDY

SEQ ID NO: 1844 - protein, 13 aa, Artificial Sequence
  Synthetic polypeptide representing artificial human antibody CDR-H3 region
AKDARLAYYGMDV

SEQ ID NO: 1845 - protein, 12 aa, Artificial Sequence
  Synthetic polypeptide representing artificial human antibody CDR-H3 region
ARHSSGYSELAY

SEQ ID NO: 1846 - protein, 14 aa, Artificial Sequence
  Synthetic polypeptide representing artificial human antibody CDR-H3 region
ARVHNWDFYYGMDV

SEQ ID NO: 1847 - protein, 15 aa, Artificial Sequence
  Synthetic polypeptide representing artificial human antibody CDR-H3 region
TRERPPNCGSSCPET

SEQ ID NO: 1848 - protein, 12 aa, Artificial Sequence
  Synthetic polypeptide representing artificial human antibody CDR-H3 region
ARVGTSHWYSDS

SEQ ID NO: 1849 - protein, 10 aa, Artificial Sequence
  Synthetic polypeptide representing artificial human antibody CDR-H3 region
ARDEGRREGA

SEQ ID NO: 1850 - protein, 13 aa, Artificial Sequence
  Synthetic polypeptide representing artificial human antibody CDR-H3 region
ARDIALGRGGMDV

SEQ ID NO: 1851 - protein, 12 aa, Artificial Sequence
  Synthetic polypeptide representing artificial human antibody CDR-H3 region
ARHRTGQYYYNS

SEQ ID NO: 1852 - protein, 11 aa, Artificial Sequence
  Synthetic polypeptide representing artificial human antibody CDR-H3 region
AASGYGDHVAY

SEQ ID NO: 1853 - protein, 16 aa, Artificial Sequence
  Synthetic polypeptide representing artificial human antibody CDR-H3 region
ARGNGPKSGKYSDFDY

SEQ ID NO: 1854 - protein, 10 aa, Artificial Sequence
  Synthetic polypeptide representing artificial human antibody CDR-H3 region
ARDKSWYFDY

SEQ ID NO: 1855 - protein, 15 aa, Artificial Sequence
  Synthetic polypeptide representing artificial human antibody CDR-H3 region
ARSTASSGYYDAFDI

SEQ ID NO: 1856 - protein, 22 aa, Artificial Sequence
  Synthetic polypeptide representing artificial human antibody CDR-H3 region
ARDRREYSSSSRPSYHYYYMDV

SEQ ID NO: 1857 - protein, 13 aa, Artificial Sequence
  Synthetic polypeptide representing artificial human antibody CDR-H3 region
ASRYRSPSGAFDI

SEQ ID NO: 1858 - protein, 8 aa, Artificial Sequence
  Synthetic polypeptide representing artificial human antibody CDR-H3 region
TRGAVADY

SEQ ID NO: 1859 - protein, 14 aa, Artificial Sequence
  Synthetic polypeptide representing artificial human antibody CDR-H3 region
ATSHGGLVPGGENY

SEQ ID NO: 1860 - protein, 16 aa, Artificial Sequence
  Synthetic polypeptide representing artificial human antibody CDR-H3 region
VREEFGVVRGPNPFDV

SEQ ID NO: 1861 - protein, 19 aa, Artificial Sequence
  Synthetic polypeptide representing artificial human antibody CDR-H3 region
AKTRSYSSADTTRPNAPGY

SEQ ID NO: 1862 - protein, 15 aa, Artificial Sequence
  Synthetic polypeptide representing artificial human antibody CDR-H3 region
AKDGQTGTTTPYFDY

SEQ ID NO: 1863 - protein, 10 aa, Artificial Sequence
  Synthetic polypeptide representing artificial human antibody CDR-H3 region
ARAGAEGVDY

SEQ ID NO: 1864 - protein, 14 aa, Artificial Sequence
  Synthetic polypeptide representing artificial human antibody CDR-H3 region
ARRSDKAVPGTFDQ

SEQ ID NO: 1865 - protein, 15 aa, Artificial Sequence
  Synthetic polypeptide representing artificial human antibody CDR-H3 region
AHRGGKNPRYWYFDL

SEQ ID NO: 1866 - protein, 13 aa, Artificial Sequence
  Synthetic polypeptide representing artificial human antibody CDR-H3 region
ARGEGGELWAFDY

SEQ ID NO: 1867 - protein, 14 aa, Artificial Sequence
  Synthetic polypeptide representing artificial human antibody CDR-H3 region
AREGLRLARGWFHP

SEQ ID NO: 1868 - protein, 12 aa, Artificial Sequence
  Synthetic polypeptide representing artificial human antibody CDR-H3 region
ARDFDDGYDIRY

SEQ ID NO: 1869 - protein, 13 aa, Artificial Sequence
  Synthetic polypeptide representing artificial human antibody CDR-H3 region
VKSPVAANDAFDI

SEQ ID NO: 1870 - protein, 13 aa, Artificial Sequence
  Synthetic polypeptide representing artificial human antibody CDR-H3 region
ARVSVAAPTCLDY

SEQ ID NO: 1871 - protein, 15 aa, Artificial Sequence
  Synthetic polypeptide representing artificial human antibody CDR-H3 region
ARHSGHDQLPLDFDN

SEQ ID NO: 1872 - protein, 9 aa, Artificial Sequence
  Synthetic polypeptide representing artificial human antibody CDR-H3 region
AGGGSQVDF

SEQ ID NO: 1873 - protein, 17 aa, Artificial Sequence
  Synthetic polypeptide representing artificial human antibody CDR-H3 region
AHRFGRGVSYYYYGMDV

SEQ ID NO: 1874 - protein, 12 aa, Artificial Sequence
  Synthetic polypeptide representing artificial human antibody CDR-H3 region
AKDSGSNDDMDV

SEQ ID NO: 1875 - protein, 13 aa, Artificial Sequence
  Synthetic polypeptide representing artificial human antibody CDR-H3 region
ARRGFYYYYGMDV

SEQ ID NO: 1876 - protein, 10 aa, Artificial Sequence
  Synthetic polypeptide representing artificial human antibody CDR-H3 region
ASLLGGDPDY

SEQ ID NO: 1877 - protein, 20 aa, Artificial Sequence
  Synthetic polypeptide representing artificial human antibody CDR-H3 region
ARMQIVATTQTYYYYYGMDV

SEQ ID NO: 1878 - protein, 13 aa, Artificial Sequence
  Synthetic polypeptide representing artificial human antibody CDR-H3 region
ARAGYDLFGWFDP

SEQ ID NO: 1879 - protein, 19 aa, Artificial Sequence
  Synthetic polypeptide representing artificial human antibody CDR-H3 region
AKPNSPFTGSGSFHNYFDY

SEQ ID NO: 1880 - protein, 6 aa, Artificial Sequence
  Synthetic polypeptide representing artificial human antibody CDR-H3 region
ASPVRP

SEQ ID NO: 1881 - protein, 21 aa, Artificial Sequence
  Synthetic polypeptide representing artificial human antibody CDR-H3 region
ARGFCDLPACYPVPQYNWFDP

SEQ ID NO: 1882 - protein, 13 aa, Artificial Sequence
  Synthetic polypeptide representing artificial human antibody CDR-H3 region
ARYSGSYPLGFDY

SEQ ID NO: 1883 - protein, 9 aa, Artificial Sequence
  Synthetic polypeptide representing artificial human antibody CDR-H3 region
ARHEGAFDI

SEQ ID NO: 1884 - protein, 12 aa, Artificial Sequence
  Synthetic polypeptide representing artificial human antibody CDR-H3 region
TTDLAVTTRFDY

SEQ ID NO: 1885 - protein, 11 aa, Artificial Sequence
  Synthetic polypeptide representing artificial human antibody CDR-H3 region
ARSTRTDALDV

SEQ ID NO: 1886 - protein, 13 aa, Artificial Sequence
  Synthetic polypeptide representing artificial human antibody CDR-H3 region
AKNDEMDFKGYDY

SEQ ID NO: 1887 - protein, 9 aa, Artificial Sequence
  Synthetic polypeptide representing artificial human antibody CDR-H3 region
ARGELLFDH

SEQ ID NO: 1888 - protein, 10 aa, Artificial Sequence
  Synthetic polypeptide representing artificial human antibody CDR-H3 region
ARESTVVLDF

SEQ ID NO: 1889 - protein, 12 aa, Artificial Sequence
  Synthetic polypeptide representing artificial human antibody CDR-H3 region
AKRSTAVGDFDP

SEQ ID NO: 1890 - protein, 16 aa, Artificial Sequence
  Synthetic polypeptide representing artificial human antibody CDR-H3 region
ARGPSNWNGGPEHMDV

SEQ ID NO: 1891 - protein, 6 aa, Artificial Sequence
  Synthetic polypeptide representing artificial human antibody CDR-H3 region
ARDFDY

SEQ ID NO: 1892 - protein, 14 aa, Artificial Sequence
  Synthetic polypeptide representing artificial human antibody CDR-H3 region
ARDPYGSGTVWFDP

SEQ ID NO: 1893 - protein, 20 aa, Artificial Sequence
  Synthetic polypeptide representing artificial human antibody CDR-H3 region
AKTEYTFLSGSDYYQYGMDV

SEQ ID NO: 1894 - protein, 16 aa, Artificial Sequence
  Synthetic polypeptide representing artificial human antibody CDR-H3 region
ARRGLLRGSNEGRFDY

SEQ ID NO: 1895 - protein, 15 aa, Artificial Sequence
  Synthetic polypeptide representing artificial human antibody CDR-H3 region
TRRGSAWTDPYYTDV

SEQ ID NO: 1896 - protein, 11 aa, Artificial Sequence
  Synthetic polypeptide representing artificial human antibody CDR-H3 region
ARDDVPRGYDY

SEQ ID NO: 1897 - protein, 13 aa, Artificial Sequence
  Synthetic polypeptide representing artificial human antibody CDR-H3 region
AREYIVPFYGMDV

SEQ ID NO: 1898 - protein, 9 aa, Artificial Sequence
  Synthetic polypeptide representing artificial human antibody CDR-L3 region
QQTNTFPLT

SEQ ID NO: 1899 - protein, 9 aa, Artificial Sequence
  Synthetic polypeptide representing artificial human antibody CDR-L3 region
QQSYSTPPR

SEQ ID NO: 1900 - protein, 9 aa, Artificial Sequence
  Synthetic polypeptide representing artificial human antibody CDR-L3 region
QQSNSFPGT

SEQ ID NO: 1901 - protein, 11 aa, Artificial Sequence
  Synthetic polypeptide representing artificial human antibody CDR-L3 region
AAWEDSLSGPV

SEQ ID NO: 1902 - protein, 9 aa, Artificial Sequence
  Synthetic polypeptide representing artificial human antibody CDR-L3 region
NSRDRSGYV

SEQ ID NO: 1903 - protein, 11 aa, Artificial Sequence
  Synthetic polypeptide representing artificial human antibody CDR-L3 region
QVWDNGHSHWV

SEQ ID NO: 1904 - protein, 9 aa, Artificial Sequence
  Synthetic polypeptide representing artificial human antibody CDR-L3 region
QQSYRMPCS

SEQ ID NO: 1905 - protein, 10 aa, Artificial Sequence
  Synthetic polypeptide representing artificial human antibody CDR-L3 region
QQYGSSPPIT

SEQ ID NO: 1906 - protein, 9 aa, Artificial Sequence
  Synthetic polypeptide representing artificial human antibody CDR-L3 region
QSYDTTNVI

SEQ ID NO: 1907 - protein, 9 aa, Artificial Sequence
  Synthetic polypeptide representing artificial human antibody CDR-L3 region
QQYDSSPFT

SEQ ID NO: 1908 - protein, 10 aa, Artificial Sequence
  Synthetic polypeptide representing artificial human antibody CDR-L3 region
GTWDDNLSAV

SEQ ID NO: 1909 - protein, 9 aa, Artificial Sequence
  Synthetic polypeptide representing artificial human antibody CDR-L3 region
LQGTHWPPT

SEQ ID NO: 1910 - protein, 11 aa, Artificial Sequence
  Synthetic polypeptide representing artificial human antibody CDR-L3 region
AAWDDNVSGPG

SEQ ID NO: 1911 - protein, 11 aa, Artificial Sequence
  Synthetic polypeptide representing artificial human antibody CDR-L3 region
ATWDDSLNGPV

SEQ ID NO: 1912 - protein, 8 aa, Artificial Sequence
  Synthetic polypeptide representing artificial human antibody CDR-L3 region
QQYNNWWT

SEQ ID NO: 1913 - protein, 9 aa, Artificial Sequence
  Synthetic polypeptide representing artificial human antibody CDR-L3 region
QQYGSFRYT

SEQ ID NO: 1914 - protein, 10 aa, Artificial Sequence
  Synthetic polypeptide representing artificial human antibody CDR-L3 region
QSADSSDTYV

SEQ ID NO: 1915 - protein, 9 aa, Artificial Sequence
  Synthetic polypeptide representing artificial human antibody CDR-L3 region
QQRSNWPLT

SEQ ID NO: 1916 - protein, 10 aa, Artificial Sequence
  Synthetic polypeptide representing artificial human antibody CDR-L3 region
QQGSNWLALT

SEQ ID NO: 1917 - protein, 9 aa, Artificial Sequence
  Synthetic polypeptide representing artificial human antibody CDR-L3 region
QQYYINPRT

SEQ ID NO: 1918 - protein, 9 aa, Artificial Sequence
  Synthetic polypeptide representing artificial human antibody CDR-L3 region
QQYYSTPYT

SEQ ID NO: 1919 - protein, 9 aa, Artificial Sequence
  Synthetic polypeptide representing artificial human antibody CDR-L3 region
QQSFNTVLT

SEQ ID NO: 1920 - protein, 11 aa, Artificial Sequence
  Synthetic polypeptide representing artificial human antibody CDR-L3 region
SSYTITSTLWV

SEQ ID NO: 1921 - protein, 11 aa, Artificial Sequence
  Synthetic polypeptide representing artificial human antibody CDR-L3 region
AAWDDSLSGPV

SEQ ID NO: 1922 - protein, 9 aa, Artificial Sequence
  Synthetic polypeptide representing artificial human antibody CDR-L3 region
QQTYSNPWT

SEQ ID NO: 1923 - protein, 9 aa, Artificial Sequence
  Synthetic polypeptide representing artificial human antibody CDR-L3 region
QQTYSHPRT

SEQ ID NO: 1924 - protein, 11 aa, Artificial Sequence
  Synthetic polypeptide representing artificial human antibody CDR-L3 region
QSYDSSLSGYV

SEQ ID NO: 1925 - protein, 11 aa, Artificial Sequence
  Synthetic polypeptide representing artificial human antibody CDR-L3 region
QVWDSSSDHYV

SEQ ID NO: 1926 - protein, 9 aa, Artificial Sequence
  Synthetic polypeptide representing artificial human antibody CDR-L3 region
QQTSSFPRT

SEQ ID NO: 1927 - protein, 10 aa, Artificial Sequence
  Synthetic polypeptide representing artificial human antibody CDR-L3 region
QSVDITSTWV

SEQ ID NO: 1928 - protein, 11 aa, Artificial Sequence
  Synthetic polypeptide representing artificial human antibody CDR-L3 region
SSYISSLTYVL

SEQ ID NO: 1929 - protein, 11 aa, Artificial Sequence
  Synthetic polypeptide representing artificial human antibody CDR-L3 region
GTWDSSLSVGV

SEQ ID NO: 1930 - protein, 9 aa, Artificial Sequence
  Synthetic polypeptide representing artificial human antibody CDR-L3 region
MQGTHWPIT

SEQ ID NO: 1931 - protein, 9 aa, Artificial Sequence
  Synthetic polypeptide representing artificial human antibody CDR-L3 region
QQYDSSSWT

SEQ ID NO: 1932 - protein, 11 aa, Artificial Sequence
  Synthetic polypeptide representing artificial human antibody CDR-L3 region
QSYDSSLRGVV

SEQ ID NO: 1933 - protein, 9 aa, Artificial Sequence
  Synthetic polypeptide representing artificial human antibody CDR-L3 region
QQSYSTPRT

SEQ ID NO: 1934 - protein, 9 aa, Artificial Sequence
  Synthetic polypeptide representing artificial human antibody CDR-L3 region
QQYYSTPWT

SEQ ID NO: 1935 - protein, 13 aa, Artificial Sequence
  Synthetic polypeptide representing artificial human antibody CDR-L3 region
QSYDSGLSGSKVV

SEQ ID NO: 1936 - protein, 9 aa, Artificial Sequence
  Synthetic polypeptide representing artificial human antibody CDR-L3 region
QSYDLSTWV

SEQ ID NO: 1937 - protein, 9 aa, Artificial Sequence
  Synthetic polypeptide representing artificial human antibody CDR-L3 region
HQSYSTSLT

SEQ ID NO: 1938 - protein, 11 aa, Artificial Sequence
  Synthetic polypeptide representing artificial human antibody CDR-L3 region
QVWDSSSDHWV

SEQ ID NO: 1939 - protein, 10 aa, Artificial Sequence
  Synthetic polypeptide representing artificial human antibody CDR-L3 region
SSYTSSSTQV

SEQ ID NO: 1940 - protein, 9 aa, Artificial Sequence
  Synthetic polypeptide representing artificial human antibody CDR-L3 region
QQSYSTPKT

SEQ ID NO: 1941 - protein, 10 aa, Artificial Sequence
  Synthetic polypeptide representing artificial human antibody CDR-L3 region
QQFNTYPLYT

SEQ ID NO: 1942 - protein, 11 aa, Artificial Sequence
  Synthetic polypeptide representing artificial human antibody CDR-L3 region
DSRDSSGNLVV

SEQ ID NO: 1943 - protein, 9 aa, Artificial Sequence
  Synthetic polypeptide representing artificial human antibody CDR-L3 region
QQTNSFPRT

SEQ ID NO: 1944 - protein, 10 aa, Artificial Sequence
  Synthetic polypeptide representing artificial human antibody CDR-L3 region
QQSYSVPPWT

SEQ ID NO: 1945 - protein, 10 aa, Artificial Sequence
  Synthetic polypeptide representing artificial human antibody CDR-L3 region
QQYGSSPRYT

SEQ ID NO: 1946 - protein, 8 aa, Artificial Sequence
  Synthetic polypeptide representing artificial human antibody CDR-L3 region
QQYGSAWT

SEQ ID NO: 1947 - protein, 10 aa, Artificial Sequence
  Synthetic polypeptide representing artificial human antibody CDR-L3 region
QQRANWPPIT

SEQ ID NO: 1948 - protein, 9 aa, Artificial Sequence
  Synthetic polypeptide representing artificial human antibody CDR-L3 region
QQYNSYPWT

SEQ ID NO: 1949 - protein, 12 aa, Artificial Sequence
  Synthetic polypeptide representing artificial human antibody CDR-L3 region
QVWDSSSDHYVV

SEQ ID NO: 1950 - protein, 10 aa, Artificial Sequence
  Synthetic polypeptide representing artificial human antibody CDR-L3 region
QQRSNWPPLT

SEQ ID NO: 1951 - protein, 9 aa, Artificial Sequence
  Synthetic polypeptide representing artificial human antibody CDR-L3 region
MQALQTPYT

SEQ ID NO: 1952 - protein, 8 aa, Artificial Sequence
  Synthetic polypeptide representing artificial human antibody CDR-L3 region
QQYNSYST

SEQ ID NO: 1953 - protein, 10 aa, Artificial Sequence
  Synthetic polypeptide representing artificial human antibody CDR-L3 region
LLYMGSGISV

SEQ ID NO: 1954 - protein, 10 aa, Artificial Sequence
  Synthetic polypeptide representing artificial human antibody CDR-L3 region
QHYGASPPWT

SEQ ID NO: 1955 - protein, 12 aa, Artificial Sequence
  Synthetic polypeptide representing artificial human antibody CDR-L3 region
QVWDSNNDHREV

SEQ ID NO: 1956 - protein, 9 aa, Artificial Sequence
  Synthetic polypeptide representing artificial human antibody CDR-L3 region
QQYDSYPLS

SEQ ID NO: 1957 - protein, 9 aa, Artificial Sequence
  Synthetic polypeptide representing artificial human antibody CDR-L3 region
LQHDNFPYT

SEQ ID NO: 1958 - protein, 9 aa, Artificial Sequence
  Synthetic polypeptide representing artificial human antibody CDR-L3 region
QQYGSSPLT

SEQ ID NO: 1959 - protein, 11 aa, Artificial Sequence
  Synthetic polypeptide representing artificial human antibody CDR-L3 region
YSTDSSGNHGV

SEQ ID NO: 1960 - protein, 9 aa, Artificial Sequence
  Synthetic polypeptide representing artificial human antibody CDR-L3 region
MQALQTPNT

SEQ ID NO: 1961 - protein, 11 aa, Artificial Sequence
  Synthetic polypeptide representing artificial human antibody CDR-L3 region
NSYSSSSTLYV

SEQ ID NO: 1962 - protein, 10 aa, Artificial Sequence
  Synthetic polypeptide representing artificial human antibody CDR-L3 region
QQHSNWPELT

SEQ ID NO: 1963 - protein, 10 aa, Artificial Sequence
  Synthetic polypeptide representing artificial human antibody CDR-L3 region
SSYRSSGVYV

SEQ ID NO: 1964 - protein, 9 aa, Artificial Sequence
  Synthetic polypeptide representing artificial human antibody CDR-L3 region
MQSIHLPYT

SEQ ID NO: 1965 - protein, 10 aa, Artificial Sequence
  Synthetic polypeptide representing artificial human antibody CDR-L3 region
HQYGGSPPNT

SEQ ID NO: 1966 - protein, 10 aa, Artificial Sequence
  Synthetic polypeptide representing artificial human antibody CDR-L3 region
QQLNSYPPLT

SEQ ID NO: 1967 - protein, 11 aa, Artificial Sequence
  Synthetic polypeptide representing artificial human antibody CDR-L3 region
ATWDSSLTAGV

SEQ ID NO: 1968 - protein, 9 aa, Artificial Sequence
  Synthetic polypeptide representing artificial human antibody CDR-L3 region
QQRSAWPIT

SEQ ID NO: 1969 - protein, 10 aa, Artificial Sequence
  Synthetic polypeptide representing artificial human antibody CDR-L3 region
QQYGSSRKLT

SEQ ID NO: 1970 - protein, 9 aa, Artificial Sequence
  Synthetic polypeptide representing artificial human antibody CDR-L3 region
QHYDSYPWT

SEQ ID NO: 1971 - protein, 11 aa, Artificial Sequence
  Synthetic polypeptide representing artificial human antibody CDR-L3 region
CSRDSSGNPWV

SEQ ID NO: 1972 - protein, 9 aa, Artificial Sequence
  Synthetic polypeptide representing artificial human antibody CDR-L3 region
QQSYSTSLT

SEQ ID NO: 1973 - protein, 11 aa, Artificial Sequence
  Synthetic polypeptide representing artificial human antibody CDR-L3 region
QQYDSSPPMYT

SEQ ID NO: 1974 - protein, 12 aa, Artificial Sequence
  Synthetic polypeptide representing artificial human antibody CDR-L3 region
GTWDSSLSPGGV

SEQ ID NO: 1975 - protein, 8 aa, Artificial Sequence
  Synthetic polypeptide representing artificial human antibody CDR-L3 region
QQSYNART

SEQ ID NO: 1976 - protein, 10 aa, Artificial Sequence
  Synthetic polypeptide representing artificial human antibody CDR-L3 region
QQYYDTAPLT

SEQ ID NO: 1977 - protein, 9 aa, Artificial Sequence
  Synthetic polypeptide representing artificial human antibody CDR-L3 region
QQYSKWPIT

SEQ ID NO: 1978 - protein, 9 aa, Artificial Sequence
  Synthetic polypeptide representing artificial human antibody CDR-L3 region
QQTYTTPRT

SEQ ID NO: 1979 - protein, 11 aa, Artificial Sequence
  Synthetic polypeptide representing artificial human antibody CDR-L3 region
QSYDSRLSGVV

SEQ ID NO: 1980 - protein, 9 aa, Artificial Sequence
  Synthetic polypeptide representing artificial human antibody CDR-L3 region
QQYTTRPLT

SEQ ID NO: 1981 - protein, 9 aa, Artificial Sequence
  Synthetic polypeptide representing artificial human antibody CDR-L3 region
QQRSKWPLT

SEQ ID NO: 1982 - protein, 12 aa, Artificial Sequence
  Synthetic polypeptide representing artificial human antibody CDR-L3 region
ATWDDSLGGRVV

SEQ ID NO: 1983 - protein, 9 aa, Artificial Sequence
  Synthetic polypeptide representing artificial human antibody CDR-L3 region
MQRIEFPFT

SEQ ID NO: 1984 - protein, 9 aa, Artificial Sequence
  Synthetic polypeptide representing artificial human antibody CDR-L3 region
QAWDSSTAV

SEQ ID NO: 1985 - protein, 9 aa, Artificial Sequence
  Synthetic polypeptide representing artificial human antibody CDR-L3 region
QSWDSSSVL

SEQ ID NO: 1986 - protein, 9 aa, Artificial Sequence
  Synthetic polypeptide representing artificial human antibody CDR-L3 region
QQYYGRLFT

SEQ ID NO: 1987 - protein, 11 aa, Artificial Sequence
  Synthetic polypeptide representing artificial human antibody CDR-L3 region
QQRSNWPPRLP

SEQ ID NO: 1988 - protein, 10 aa, Artificial Sequence
  Synthetic polypeptide representing artificial human antibody CDR-L3 region
QQRSNWPPYT

SEQ ID NO: 1989 - protein, 9 aa, Artificial Sequence
  Synthetic polypeptide representing artificial human antibody CDR-L3 region
MQALQTPYT

SEQ ID NO: 1990 - protein, 9 aa, Artificial Sequence
  Synthetic polypeptide representing artificial human antibody CDR-L3 region
QHYDSYIGT

SEQ ID NO: 1991 - protein, 11 aa, Artificial Sequence
  Synthetic polypeptide representing artificial human antibody CDR-L3 region
GTWDSSLGGGV

SEQ ID NO: 1992 - protein, 10 aa, Artificial Sequence
  Synthetic polypeptide representing artificial human antibody CDR-L3 region
QQRSNWPPYT

SEQ ID NO: 1993 - protein, 9 aa, Artificial Sequence
  Synthetic polypeptide representing artificial human antibody CDR-L3 region
MEAEQTPGT

SEQ ID NO: 1994 - protein, 10 aa, Artificial Sequence
  Synthetic polypeptide representing artificial human antibody CDR-L3 region
SSYTSSTTVL

SEQ ID NO: 1995 - protein, 10 aa, Artificial Sequence
  Synthetic polypeptide representing artificial human antibody CDR-L3 region
MQGTHWPPIT

SEQ ID NO: 1996 - protein, 9 aa, Artificial Sequence
  Synthetic polypeptide representing artificial human antibody CDR-L3 region
HQTYSTRLT

SEQ ID NO: 1997 - protein, 9 aa, Artificial Sequence
  Synthetic polypeptide representing artificial human antibody CDR-L3 region
QQYDNLPLT

SEQ ID NO: 1998 - protein, 11 aa, Artificial Sequence
  Synthetic polypeptide representing artificial human antibody CDR-L3 region
QVWDSSSDPWV

SEQ ID NO: 1999 - protein, 10 aa, Artificial Sequence
  Synthetic polypeptide representing artificial human antibody CDR-L3 region
QQLNSYPPVT

SEQ ID NO: 2000 - protein, 9 aa, Artificial Sequence
  Synthetic polypeptide representing artificial human antibody CDR-L3 region
QQSYSTPYT

SEQ ID NO: 2001 - protein, 10 aa, Artificial Sequence
  Synthetic polypeptide representing artificial human antibody CDR-L3 region
QQYSSSSPRT

SEQ ID NO: 2002 - protein, 9 aa, Artificial Sequence
  Synthetic polypeptide representing artificial human antibody CDR-L3 region
MQSLQLPIT

SEQ ID NO: 2003 - protein, 10 aa, Artificial Sequence
  Synthetic polypeptide representing artificial human antibody CDR-L3 region
QQSYSTRLLT

SEQ ID NO: 2004 - protein, 11 aa, Artificial Sequence
  Synthetic polypeptide representing artificial human antibody CDR-L3 region
QSFDSSLRGYV

SEQ ID NO: 2005 - protein, 11 aa, Artificial Sequence
  Synthetic polypeptide representing artificial human antibody CDR-L3 region
QHRITWPPLIT

SEQ ID NO: 2006 - protein, 9 aa, Artificial Sequence
  Synthetic polypeptide representing artificial human antibody CDR-L3 region
QQYAYVPIT

SEQ ID NO: 2007 - protein, 9 aa, Artificial Sequence
  Synthetic polypeptide representing artificial human antibody CDR-L3 region
QQYYSIPLT

SEQ ID NO: 2008 - protein, 9 aa, Artificial Sequence
  Synthetic polypeptide representing artificial human antibody CDR-L3 region
QQYGSSPLW

SEQ ID NO: 2009 - protein, 10 aa, Artificial Sequence
  Synthetic polypeptide representing artificial human antibody CDR-L3 region
SSYTSSSTQV

SEQ ID NO: 2010 - protein, 11 aa, Artificial Sequence
  Synthetic polypeptide representing artificial human antibody CDR-L3 region
YSTDSSGNHRV

SEQ ID NO: 2011 - protein, 10 aa, Artificial Sequence
  Synthetic polypeptide representing artificial human antibody CDR-L3 region
QQYNNWPQYT

SEQ ID NO: 2012 - protein, 11 aa, Artificial Sequence
  Synthetic polypeptide representing artificial human antibody CDR-L3 region
QHFRSSPPTYT

SEQ ID NO: 2013 - protein, 10 aa, Artificial Sequence
  Synthetic polypeptide representing artificial human antibody CDR-L3 region
SSYSRTTTLV

SEQ ID NO: 2014 - protein, 12 aa, Artificial Sequence
  Synthetic polypeptide representing artificial human antibody CDR-L3 region
QSYDSGLSAPWV

SEQ ID NO: 2015 - protein, 9 aa, Artificial Sequence
  Synthetic polypeptide representing artificial human antibody CDR-L3 region
QQYGNSPPT

SEQ ID NO: 2016 - protein, 11 aa, Artificial Sequence
  Synthetic polypeptide representing artificial human antibody CDR-L3 region
ATWDDDLSGPV

SEQ ID NO: 2017 - protein, 9 aa, Artificial Sequence
  Synthetic polypeptide representing artificial human antibody CDR-L3 region
LQHDTFPLT

SEQ ID NO: 2018 - protein, 9 aa, Artificial Sequence
  Synthetic polypeptide representing artificial human antibody CDR-L3 region
QQYNSYSWT

SEQ ID NO: 2019 - protein, 9 aa, Artificial Sequence
  Synthetic polypeptide representing artificial human antibody CDR-L3 region
QHLTSFPYT

SEQ ID NO: 2020 - protein, 11 aa, Artificial Sequence
  Synthetic polypeptide representing artificial human antibody CDR-L3 region
GSRDSSGNPSV

SEQ ID NO: 2021 - protein, 9 aa, Artificial Sequence
  Synthetic polypeptide representing artificial human antibody CDR-L3 region
QQRSNWLYT

SEQ ID NO: 2022 - protein, 12 aa, Artificial Sequence
  Synthetic polypeptide representing artificial human antibody CDR-L3 region
QVWDSSSDHQEV

SEQ ID NO: 2023 - protein, 10 aa, Artificial Sequence
  Synthetic polypeptide representing artificial human antibody CDR-L3 region
CSYAPSNTYV

SEQ ID NO: 2024 - protein, 9 aa, Artificial Sequence
  Synthetic polypeptide representing artificial human antibody CDR-L3 region
QQRSNWPLT

SEQ ID NO: 2025 - protein, 12 aa, Artificial Sequence
  Synthetic polypeptide representing artificial human antibody CDR-L3 region
NSRDSSAHDHLL

SEQ ID NO: 2026 - protein, 10 aa, Artificial Sequence
  Synthetic polypeptide representing artificial human antibody CDR-L3 region
QHFGDSPLYI

SEQ ID NO: 2027 - protein, 9 aa, Artificial Sequence
  Synthetic polypeptide representing artificial human antibody CDR-L3 region
QVWDSSTAV

SEQ ID NO: 2028 - protein, 11 aa, Artificial Sequence
  Synthetic polypeptide representing artificial human antibody CDR-L3 region
QVWDSSSDHVV

SEQ ID NO: 2029 - protein, 11 aa, Artificial Sequence
  Synthetic polypeptide representing artificial human antibody CDR-L3 region
QSADSSGFYVV

SEQ ID NO: 2030 - protein, 9 aa, Artificial Sequence
  Synthetic polypeptide representing artificial human antibody CDR-L3 region
QSADSSSPV

SEQ ID NO: 2031 - protein, 10 aa, Artificial Sequence
  Synthetic polypeptide representing artificial human antibody CDR-L3 region
YSTDSRATGV

SEQ ID NO: 2032 - protein, 9 aa, Artificial Sequence
  Synthetic polypeptide representing artificial human antibody CDR-L3 region
QQSYSTPQT

SEQ ID NO: 2033 - protein, 9 aa, Artificial Sequence
  Synthetic polypeptide representing artificial human antibody CDR-L3 region
QQYENLPLT

SEQ ID NO: 2034 - protein, 9 aa, Artificial Sequence
  Synthetic polypeptide representing artificial human antibody CDR-L3 region
QQFDNLPLT

SEQ ID NO: 2035 - protein, 10 aa, Artificial Sequence
  Synthetic polypeptide representing artificial human antibody CDR-L3 region
SSYAGSYTWV

SEQ ID NO: 2036 - protein, 9 aa, Artificial Sequence
  Synthetic polypeptide representing artificial human antibody CDR-L3 region
QAWDSSTVV

SEQ ID NO: 2037 - protein, 11 aa, Artificial Sequence
  Synthetic polypeptide representing artificial human antibody CDR-L3 region
GTWDSSLGAYV

SEQ ID NO: 2038 - protein, 8 aa, Artificial Sequence
  Synthetic polypeptide representing artificial human antibody CDR-L3 region
QQYGSSLT

SEQ ID NO: 2039 - protein, 9 aa, Artificial Sequence
  Synthetic polypeptide representing artificial human antibody CDR-L3 region
QQYGSSPLT

SEQ ID NO: 2040 - protein, 10 aa, Artificial Sequence
  Synthetic polypeptide representing artificial human antibody CDR-L3 region
SSYTSSRSLV

SEQ ID NO: 2041 - protein, 9 aa, Artificial Sequence
  Synthetic polypeptide representing artificial human antibody CDR-L3 region
QQTYSTPWT

SEQ ID NO: 2042 - protein, 8 aa, Artificial Sequence
  Synthetic polypeptide representing artificial human antibody CDR-L3 region
QQYNNWLT

SEQ ID NO: 2043 - protein, 9 aa, Artificial Sequence
  Synthetic polypeptide representing artificial human antibody CDR-L3 region
YSTPDNNGV

SEQ ID NO: 2044 - protein, 10 aa, Artificial Sequence
  Synthetic polypeptide representing artificial human antibody CDR-L3 region
SSYTTSNSVV

SEQ ID NO: 2045 - protein, 9 aa, Artificial Sequence
  Synthetic polypeptide representing artificial human antibody CDR-L3 region
QQYDNSPLT

SEQ ID NO: 2046 - protein, 9 aa, Artificial Sequence
  Synthetic polypeptide representing artificial human antibody CDR-L3 region
QQYWGTPYT

SEQ ID NO: 2047 - protein, 10 aa, Artificial Sequence
  Synthetic polypeptide representing artificial human antibody CDR-L3 region
QSYDSGLGVV

SEQ ID NO: 2048 - protein, 10 aa, Artificial Sequence
  Synthetic polypeptide representing artificial human antibody CDR-L3 region
SSYAGINNLV

SEQ ID NO: 2049 - protein, 9 aa, Artificial Sequence
  Synthetic polypeptide representing artificial human antibody CDR-L3 region
QQYNSYSQT

SEQ ID NO: 2050 - protein, 9 aa, Artificial Sequence
  Synthetic polypeptide representing artificial human antibody CDR-L3 region
QQYTDWPYT

SEQ ID NO: 2051 - protein, 8 aa, Artificial Sequence
  Synthetic polypeptide representing artificial human antibody CDR-L3 region
QTWGTVGV

SEQ ID NO: 2052 - protein, 9 aa, Artificial Sequence
  Synthetic polypeptide representing artificial human antibody CDR-L3 region
QQYGSSPWT

SEQ ID NO: 2053 - protein, 11 aa, Artificial Sequence
  Synthetic polypeptide representing artificial human antibody CDR-L3 region
QSYDSSLSGYV

SEQ ID NO: 2054 - protein, 11 aa, Artificial Sequence
  Synthetic polypeptide representing artificial human antibody CDR-L3 region
QCFDTSLTAKV

SEQ ID NO: 2055 - protein, 9 aa, Artificial Sequence
  Synthetic polypeptide representing artificial human antibody CDR-L3 region
MQALQVPRT

SEQ ID NO: 2056 - protein, 9 aa, Artificial Sequence
  Synthetic polypeptide representing artificial human antibody CDR-L3 region
QQLNSYPLT

SEQ ID NO: 2057 - protein, 11 aa, Artificial Sequence
  Synthetic polypeptide representing artificial human antibody CDR-L3 region
AAWDDSLSGPV

SEQ ID NO: 2058 - protein, 9 aa, Artificial Sequence
  Synthetic polypeptide representing artificial human antibody CDR-L3 region
MQALQTPWT

SEQ ID NO: 2059 - protein, 12 aa, Artificial Sequence
  Synthetic polypeptide representing artificial human antibody CDR-L3 region
NSRDSSDDHLEV

SEQ ID NO: 2060 - protein, 9 aa, Artificial Sequence
  Synthetic polypeptide representing artificial human antibody CDR-L3 region
QQYNSYPRT

SEQ ID NO: 2061 - protein, 9 aa, Artificial Sequence
  Synthetic polypeptide representing artificial human antibody CDR-L3 region
QQYFTTPRT

SEQ ID NO: 2062 - protein, 12 aa, Artificial Sequence
  Synthetic polypeptide representing artificial human antibody CDR-L3 region
AAWDDGLGGLYV

SEQ ID NO: 2063 - protein, 8 aa, Artificial Sequence
  Synthetic polypeptide representing artificial human antibody CDR-L3 region
QQYNRGST

SEQ ID NO: 2064 - protein, 11 aa, Artificial Sequence
  Synthetic polypeptide representing artificial human antibody CDR-L3 region
QVWDRNSHRVI

SEQ ID NO: 2065 - protein, 11 aa, Artificial Sequence
  Synthetic polypeptide representing artificial human antibody CDR-L3 region
QSYDNSLSAWV

SEQ ID NO: 2066 - protein, 11 aa, Artificial Sequence
  Synthetic polypeptide representing artificial human antibody CDR-L3 region
NSRDSSGNHWV

SEQ ID NO: 2067 - protein, 11 aa, Artificial Sequence
  Synthetic polypeptide representing artificial human antibody CDR-L3 region
SSYIRSSTPVV

SEQ ID NO: 2068 - protein, 9 aa, Artificial Sequence
  Synthetic polypeptide representing artificial human antibody CDR-L3 region
QQYYDTPYT

SEQ ID NO: 2069 - protein, 10 aa, Artificial Sequence
  Synthetic polypeptide representing artificial human antibody CDR-L3 region
SSYTSSSTLV

SEQ ID NO: 2070 - protein, 8 aa, Artificial Sequence
  Synthetic polypeptide representing artificial human antibody CDR-L3 region
QQYDNLWT

SEQ ID NO: 2071 - protein, 12 aa, Artificial Sequence
  Synthetic polypeptide representing artificial human antibody CDR-L3 region
QVWDSSSDHLYV

SEQ ID NO: 2072 - protein, 9 aa, Artificial Sequence
  Synthetic polypeptide representing artificial human antibody CDR-L3 region
HQYGSSPRT

SEQ ID NO: 2073 - protein, 12 aa, Artificial Sequence
  Synthetic polypeptide representing artificial human antibody CDR-L3 region
GTWDSSLTGGFV

SEQ ID NO: 2074 - protein, 11 aa, Artificial Sequence
  Synthetic polypeptide representing artificial human antibody CDR-L3 region
QVWDTSNDVGV

SEQ ID NO: 2075 - protein, 9 aa, Artificial Sequence
  Synthetic polypeptide representing artificial human antibody CDR-L3 region
QQYGSSPPT

SEQ ID NO: 2076 - protein, 10 aa, Artificial Sequence
  Synthetic polypeptide representing artificial human antibody CDR-L3 region
CSYAGSSNWV

SEQ ID NO: 2077 - protein, 8 aa, Artificial Sequence
  Synthetic polypeptide representing artificial human antibody CDR-L3 region
MQGTHWSA

SEQ ID NO: 2078 - protein, 11 aa, Artificial Sequence
  Synthetic polypeptide representing artificial human antibody CDR-L3 region
AAWDDSLSGQV

SEQ ID NO: 2079 - protein, 10 aa, Artificial Sequence
  Synthetic polypeptide representing artificial human antibody CDR-L3 region
NSRDSSGNHV

SEQ ID NO: 2080 - protein, 8 aa, Artificial Sequence
  Synthetic polypeptide representing artificial human antibody CDR-L3 region
QQSYSTPT

SEQ ID NO: 2081 - protein, 11 aa, Artificial Sequence
  Synthetic polypeptide representing artificial human antibody CDR-L3 region
QVWESGGDHPV

SEQ ID NO: 2082 - protein, 9 aa, Artificial Sequence
  Synthetic polypeptide representing artificial human antibody CDR-L3 region
LQHNNYPLT

SEQ ID NO: 2083 - protein, 9 aa, Artificial Sequence
  Synthetic polypeptide representing artificial human antibody CDR-L3 region
QQYNSYPYT

SEQ ID NO: 2084 - protein, 9 aa, Artificial Sequence
  Synthetic polypeptide representing artificial human antibody CDR-L3 region
MQALQIPRT

SEQ ID NO: 2085 - protein, 9 aa, Artificial Sequence
  Synthetic polypeptide representing artificial human antibody CDR-L3 region
QAWDSNVHV

SEQ ID NO: 2086 - protein, 11 aa, Artificial Sequence
  Synthetic polypeptide representing artificial human antibody CDR-L3 region
YSTDSSGNVWV

SEQ ID NO: 2087 - protein, 11 aa, Artificial Sequence
  Synthetic polypeptide representing artificial human antibody CDR-L3 region
NSRDSSGNLYV

SEQ ID NO: 2088 - protein, 9 aa, Artificial Sequence
  Synthetic polypeptide representing artificial human antibody CDR-L3 region
QQYYSSPLT

SEQ ID NO: 2089 - protein, 10 aa, Artificial Sequence
  Synthetic polypeptide representing artificial human antibody CDR-L3 region
MQALQTPPYT

SEQ ID NO: 2090 - protein, 10 aa, Artificial Sequence
  Synthetic polypeptide representing artificial human antibody CDR-L3 region
SSYTSSSTWV

SEQ ID NO: 2091 - protein, 9 aa, Artificial Sequence
  Synthetic polypeptide representing artificial human antibody CDR-L3 region
QQSYSTPYT

SEQ ID NO: 2092 - protein, 11 aa, Artificial Sequence
  Synthetic polypeptide representing artificial human antibody CDR-L3 region
CSYAGSSTPWV

SEQ ID NO: 2093 - protein, 11 aa, Artificial Sequence
  Synthetic polypeptide representing artificial human antibody CDR-L3 region
YSPDSSGNVWV

SEQ ID NO: 2094 - protein, 5 aa, Artificial Sequence
  Synthetic polypeptide representing artificial human antibody CDR-L3 region
QSRGT

SEQ ID NO: 2095 - protein, 9 aa, Artificial Sequence
  Synthetic polypeptide representing artificial human antibody CDR-L3 region
QQYGSSHYT

SEQ ID NO: 2096 - protein, 12 aa, Artificial Sequence
  Synthetic polypeptide representing artificial human antibody CDR-L3 region
QVWDSSSDHPWV

SEQ ID NO: 2097 - protein, 11 aa, Artificial Sequence
  Synthetic polypeptide representing artificial human antibody CDR-L3 region
CSYRSSTAPVV

SEQ ID NO: 2098 - protein, 9 aa, Artificial Sequence
  Synthetic polypeptide representing artificial human antibody CDR-L3 region
QQYFSTPWT

SEQ ID NO: 2099 - protein, 11 aa, Artificial Sequence
  Synthetic polypeptide representing artificial human antibody CDR-L3 region
QVWDGYSDPLV

SEQ ID NO: 2100 - protein, 9 aa, Artificial Sequence
  Synthetic polypeptide representing artificial human antibody CDR-L3 region
QQSYYTPPT

SEQ ID NO: 2101 - protein, 12 aa, Artificial Sequence
  Synthetic polypeptide representing artificial human antibody CDR-L3 region
AAWDDSLNGLWV

SEQ ID NO: 2102 - protein, 10 aa, Artificial Sequence
  Synthetic polypeptide representing artificial human antibody CDR-L3 region
QSSDSNNHVV

SEQ ID NO: 2103 - protein, 11 aa, Artificial Sequence
  Synthetic polypeptide representing artificial human antibody CDR-L3 region
QSYDSSLSGVL

SEQ ID NO: 2104 - protein, 9 aa, Artificial Sequence
  Synthetic polypeptide representing artificial human antibody CDR-L3 region
QQSYSTPFT

SEQ ID NO: 2105 - protein, 9 aa, Artificial Sequence
  Synthetic polypeptide representing artificial human antibody CDR-L3 region
QQYDSLPLT

SEQ ID NO: 2106 - protein, 10 aa, Artificial Sequence
  Synthetic polypeptide representing artificial human antibody CDR-L3 region
QYYGGSPGFT

SEQ ID NO: 2107 - protein, 10 aa, Artificial Sequence
  Synthetic polypeptide representing artificial human antibody CDR-L3 region
CSYAGSSTYV

SEQ ID NO: 2108 - protein, 10 aa, Artificial Sequence
  Synthetic polypeptide representing artificial human antibody CDR-L3 region
QEYVKSPGFA

SEQ ID NO: 2109 - protein, 9 aa, Artificial Sequence
  Synthetic polypeptide representing artificial human antibody CDR-L3 region
QQYGTSPQT

SEQ ID NO: 2110 - protein, 10 aa, Artificial Sequence
  Synthetic polypeptide representing artificial human antibody CDR-L3 region
MLYMGSGISL

SEQ ID NO: 2111 - protein, 12 aa, Artificial Sequence
  Synthetic polypeptide representing artificial human antibody CDR-L3 region
QSNDISLSGSVV

SEQ ID NO: 2112 - protein, 11 aa, Artificial Sequence
  Synthetic polypeptide representing artificial human antibody CDR-L3 region
QSYDNSLSGGV

SEQ ID NO: 2113 - protein, 9 aa, Artificial Sequence
  Synthetic polypeptide representing artificial human antibody CDR-L3 region
QQFDISPFT

SEQ ID NO: 2114 - protein, 10 aa, Artificial Sequence
  Synthetic polypeptide representing artificial human antibody CDR-L3 region
SSYTSSSSLV

SEQ ID NO: 2115 - protein, 10 aa, Artificial Sequence
  Synthetic polypeptide representing artificial human antibody CDR-L3 region
CSFTGTSTFV

SEQ ID NO: 2116 - protein, 9 aa, Artificial Sequence
  Synthetic polypeptide representing artificial human antibody CDR-L3 region
QQYYSTPYT

SEQ ID NO: 2117 - protein, 11 aa, Artificial Sequence
  Synthetic polypeptide representing artificial human antibody CDR-L3 region
ATWDDSLNGGV

SEQ ID NO: 2118 - protein, 9 aa, Artificial Sequence
  Synthetic polypeptide representing artificial human antibody CDR-L3 region
WLISGGAPV

SEQ ID NO: 2119 - protein, 11 aa, Artificial Sequence
  Synthetic polypeptide representing artificial human antibody CDR-L3 region
QSFDSSLSRSV

SEQ ID NO: 2120 - protein, 9 aa, Artificial Sequence
  Synthetic polypeptide representing artificial human antibody CDR-L3 region
QQRNNWPIT

SEQ ID NO: 2121 - protein, 9 aa, Artificial Sequence
  Synthetic polypeptide representing artificial human antibody CDR-L3 region
LQDYNYPPT

SEQ ID NO: 2122 - protein, 11 aa, Artificial Sequence
  Synthetic polypeptide representing artificial human antibody CDR-L3 region
NSRDSSGHHWV

SEQ ID NO: 2123 - protein, 9 aa, Artificial Sequence
  Synthetic polypeptide representing artificial human antibody CDR-L3 region
QQYYSTPYT

SEQ ID NO: 2124 - protein, 10 aa, Artificial Sequence
  Synthetic polypeptide representing artificial human antibody CDR-L3 region
MQGAHWPPIT

SEQ ID NO: 2125 - protein, 10 aa, Artificial Sequence
  Synthetic polypeptide representing artificial human antibody CDR-L3 region
YSTDTIGNWV

SEQ ID NO: 2126 - protein, 11 aa, Artificial Sequence
  Synthetic polypeptide representing artificial human antibody CDR-L3 region
QVWDSSSDHWI

SEQ ID NO: 2127 - protein, 9 aa, Artificial Sequence
  Synthetic polypeptide representing artificial human antibody CDR-L3 region
QQSYSPPLT

SEQ ID NO: 2128 - protein, 10 aa, Artificial Sequence
  Synthetic polypeptide representing artificial human antibody CDR-L3 region
QHYSDWRALT

SEQ ID NO: 2129 - protein, 9 aa, Artificial Sequence
  Synthetic polypeptide representing artificial human antibody CDR-L3 region
QQYYGPLWT

SEQ ID NO: 2130 - protein, 11 aa, Artificial Sequence
  Synthetic polypeptide representing artificial human antibody CDR-L3 region
QSADSSLTYWL

SEQ ID NO: 2131 - protein, 8 aa, Artificial Sequence
  Synthetic polypeptide representing artificial human antibody CDR-L3 region
QQYSDYST

SEQ ID NO: 2132 - protein, 9 aa, Artificial Sequence
  Synthetic polypeptide representing artificial human antibody CDR-L3 region
HQYYTTPFT

SEQ ID NO: 2133 - protein, 9 aa, Artificial Sequence
  Synthetic polypeptide representing artificial human antibody CDR-L3 region
QAWDSSTAE

SEQ ID NO: 2134 - protein, 11 aa, Artificial Sequence
  Synthetic polypeptide representing artificial human antibody CDR-L3 region
VTWDDDLHGWV

SEQ ID NO: 2135 - protein, 13 aa, Artificial Sequence
  Synthetic polypeptide representing artificial human antibody CDR-L3 region
ATWDSSLRAGPVV

SEQ ID NO: 2136 - protein, 9 aa, Artificial Sequence
  Synthetic polypeptide representing artificial human antibody CDR-L3 region
QQYNAYPVT

SEQ ID NO: 2137 - protein, 9 aa, Artificial Sequence
  Synthetic polypeptide representing artificial human antibody CDR-L3 region
QQYYSTPWT

SEQ ID NO: 2138 - protein, 9 aa, Artificial Sequence
  Synthetic polypeptide representing artificial human antibody CDR-L3 region
QQYYSPPLT

SEQ ID NO: 2139 - protein, 10 aa, Artificial Sequence
  Synthetic polypeptide representing artificial human antibody CDR-L3 region
CSYTSSLTYV

SEQ ID NO: 2140 - protein, 9 aa, Artificial Sequence
  Synthetic polypeptide representing artificial human antibody CDR-L3 region
MQGTHWPYT

SEQ ID NO: 2141 - protein, 9 aa, Artificial Sequence
  Synthetic polypeptide representing artificial human antibody CDR-L3 region
QAWDSSTYV

SEQ ID NO: 2142 - protein, 10 aa, Artificial Sequence
  Synthetic polypeptide representing artificial human antibody CDR-L3 region
QQYGGSPLFT

SEQ ID NO: 2143 - protein, 9 aa, Artificial Sequence
  Synthetic polypeptide representing artificial human antibody CDR-L3 region
QTWDSSTVI

SEQ ID NO: 2144 - protein, 9 aa, Artificial Sequence
  Synthetic polypeptide representing artificial human antibody CDR-L3 region
MQALQTPYT

SEQ ID NO: 2145 - protein, 11 aa, Artificial Sequence
  Synthetic polypeptide representing artificial human antibody CDR-L3 region
GTWDSSLSAGV

SEQ ID NO: 2146 - protein, 8 aa, Artificial Sequence
  Synthetic polypeptide representing artificial human antibody CDR-L3 region
QQYNSYWT

SEQ ID NO: 2147 - protein, 9 aa, Artificial Sequence
  Synthetic polypeptide representing artificial human antibody CDR-L3 region
QQYNSYPWT

SEQ ID NO: 2148 - protein, 12 aa, Artificial Sequence
  Synthetic polypeptide representing artificial human antibody CDR-L3 region
QSYDSSLSGSGV

SEQ ID NO: 2149 - protein, 10 aa, Artificial Sequence
  Synthetic polypeptide representing artificial human antibody CDR-L3 region
QSADSSGTYV

SEQ ID NO: 2150 - protein, 9 aa, Artificial Sequence
  Synthetic polypeptide representing artificial human antibody CDR-L3 region
QQAHGFPIT

SEQ ID NO: 2151 - protein, 8 aa, Artificial Sequence
  Synthetic polypeptide representing artificial human antibody CDR-L3 region
QQYNSWPA

SEQ ID NO: 2152 - protein, 9 aa, Artificial Sequence
  Synthetic polypeptide representing artificial human antibody CDR-L3 region
QQSYNTPYT

SEQ ID NO: 2153 - protein, 9 aa, Artificial Sequence
  Synthetic polypeptide representing artificial human antibody CDR-L3 region
QQSYNTPLT

SEQ ID NO: 2154 - protein, 10 aa, Artificial Sequence
  Synthetic polypeptide representing artificial human antibody CDR-L3 region
QQYGSSPPNS

SEQ ID NO: 2155 - protein, 11 aa, Artificial Sequence
  Synthetic polypeptide representing artificial human antibody CDR-L3 region
QVWDSSSDHPV

SEQ ID NO: 2156 - protein, 10 aa, Artificial Sequence
  Synthetic polypeptide representing artificial human antibody CDR-L3 region
QSYDSNTHWV

SEQ ID NO: 2157 - protein, 9 aa, Artificial Sequence
  Synthetic polypeptide representing artificial human antibody CDR-L3 region
MQALETPRT

SEQ ID NO: 2158 - protein, 8 aa, Artificial Sequence
  Synthetic polypeptide representing artificial human antibody CDR-L3 region
QQYNSYST

SEQ ID NO: 2159 - protein, 9 aa, Artificial Sequence
  Synthetic polypeptide representing artificial human antibody CDR-L3 region
MQALQPPYT

SEQ ID NO: 2160 - protein, 10 aa, Artificial Sequence
  Synthetic polypeptide representing artificial human antibody CDR-L3 region
QQSYSTPPWT

SEQ ID NO: 2161 - protein, 9 aa, Artificial Sequence
  Synthetic polypeptide representing artificial human antibody CDR-L3 region
QQYYLVPVT

SEQ ID NO: 2162 - protein, 12 aa, Artificial Sequence
  Synthetic polypeptide representing artificial human antibody CDR-L3 region
AAWDDSLSGPYV

SEQ ID NO: 2163 - protein, 11 aa, Artificial Sequence
  Synthetic polypeptide representing artificial human antibody CDR-L3 region
SSYAGSNNFYV

SEQ ID NO: 2164 - protein, 12 aa, Artificial Sequence
  Synthetic polypeptide representing artificial human antibody CDR-L3 region
QSYDSSLSGSMI

SEQ ID NO: 2165 - protein, 8 aa, Artificial Sequence
  Synthetic polypeptide representing artificial human antibody CDR-L3 region
MIWSSLVV

SEQ ID NO: 2166 - protein, 9 aa, Artificial Sequence
  Synthetic polypeptide representing artificial human antibody CDR-L3 region
MQALQTPWT

SEQ ID NO: 2167 - protein, 9 aa, Artificial Sequence
  Synthetic polypeptide representing artificial human antibody CDR-L3 region
LQNYNYPWT

SEQ ID NO: 2168 - protein, 9 aa, Artificial Sequence
  Synthetic polypeptide representing artificial human antibody CDR-L3 region
MQGIHLPRT

SEQ ID NO: 2169 - DNA, 662 bp, Artificial Sequence
  Synthetic polynucleotide encoding artificial human antibody VH chain
gatgtgagatgcaactgttgcagtctgggggaggcctggtacagcctggggggtccctgagactctcctgtgtagcctctgaagtgacgttcaacacttatggcatgagctgggtccgccaggctccagggaaggggctggagtgggtctcatacatgagtgggggtggtggtagtatattctacgcagactccgtgaagggccggttcaccatctccagagacaattccaagaacacgctgtatctgcaaatgaacagcctgagaggcgaggacacggccgtttatttctgtgcgagggttacccttgggagttacttttacggcatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaggtg

SEQ ID NO: 2170 - DNA, 660 bp, Artificial Sequence
  Synthetic polynucleotide encoding artificial human antibody VH chain
gtggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaagtcactgtatctgcaaatgaacagcctgagagccgaggacacggctgtctattactgtgcgagagatgggggatcagggagttacttcgactgctttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagtgag

SEQ ID NO: 2171 - DNA, 669 bp, Artificial Sequence
  Synthetic polynucleotide encoding artificial human antibody VH chain
gaagtgcagttggtggagtctgggggaggcctgatacagcctggcaggtccctgagactctcctgtgcagcctctggattcacctttgaagattatgccatgcactgggtccggcaagctccagggaagggcctggagtgggtctcaggtattagttggaacagtgggaacataggctatgcggactctgtgaagggccgattcaccatctccagagacaacgccaagaactccctgtatctgcaaatgcacagtctgagacctgaggacacggccttatattactgtgcaaaagatataaacttttttgggttagggacagggggaggtgctatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagag

SEQ ID NO: 2172 - DNA, 360 bp, Artificial Sequence
  Synthetic polynucleotide encoding artificial human antibody VH chain
cccagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattgggatgatgataagcgctacagcccatctctgaagagcaggctcaccatcaccaaggacacctccaaaaaccaggtggtccttacaatgaccaacatggaccctgtggacacagccacatattactgtgcacacagagcaatagtaggactctttgactactggggccagggaaccctggtcaccgtctcctcag

SEQ ID NO: 2173 - DNA, 669 bp, Artificial Sequence
  Synthetic polynucleotide encoding artificial human antibody VH chain
caggtgcagctggtgcagtctggggctgaggttaagaagcctggggcctcagtgaagatttcctgcaagacatctggatataccttcaccacctactatatgcactgggtgcgacaggcccctggacaggggcttgagtggatgggaataatcaacactagtggtggaagcacaagctacgcacagaagttccagggcagagtcaccatgaccagggacacgtccacgaacacagtctacatggagctgagcagcctgagatatgaagacacggccatgtattactgtgcgcgaggaggggatgggggaccccaagatgcttttgatatctggggccaagggacaaaggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgccca

SEQ ID NO: 2174 - DNA, 666 bp, Artificial Sequence
  Synthetic polynucleotide encoding artificial human antibody VH chain
tgagtgcagctggtggactctgggggaggcttggtacagcctggcaggtccctgagactctcctgtgcagcctctggattcgtctttgatgattatgccatgcactgggtccggcaagttccagggaagggcctggagtgggtctcaggcattagttggaatagtgttagtataggctatgcggactctgtgaagggccgattcaccatctccagagacaacgccaagaattccctgtatctacaaatgaacagtctgagacctgaggacgcggccttgtattactgtgtgaagtcattttcggctgaatattactactattactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagtgag

SEQ ID NO: 2175 - DNA, 367 bp, Artificial Sequence
  Synthetic polynucleotide encoding artificial human antibody VH chain
caggttcaactggtgcagtctggagctgaggtgaagaagcctggggcctcagtgaaggtctcctgcaaggcttctggttacacctttaccaactatggtttcagctgggtgcgacaggccccaggacaagggcttgagtggatgggacggatcaccacttacaatcgtgacacaatctatgcacagaaattccagggcagagtcaccatgaccacagatacatccacgagcacagcctatatggaactgaggagcctgagatctgacgacacggccgtgtacttctgtgcgagagttgttccaggtgactccgtctatggtgcttttgatatctggggccaggggacaatggtcaccgtctcttcag

SEQ ID NO: 2176 - DNA, 668 bp, Artificial Sequence
  Synthetic polynucleotide encoding artificial human antibody VH chain
gtgaagtacaactggtggagtctgggggaggcgtggtacagcctggggggtccctgagactctcctgtacagcctctggattcacctttgatgattatgccatgcactgggtccgtcaagctccagggaagggtctggagtgggtctctcttattagtggggatggtggtggcacatactatgcagactctgtgaagggccgattcaccatctccagagacaacagcaaaaactccctgtatctgcaaatgaacagtctgagaactgaggacaccgccttgtattactgtgcaaagcggaccccgttcggggagtgggcatttgactactggggccagggaaccctggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccg

SEQ ID NO: 2177 - DNA, 373 bp, Artificial Sequence
  Synthetic polynucleotide encoding artificial human antibody VH chain
gaggtgcagctggtggagtctgggggaggcgtggtccagcctggggggtccctgagactctcctgtgcagcgtctggattcacttttagttactatggcatgtattgggtccgccaggctccaggcaaggggcttgagtgggtgacatttatacggtatgatggaagaaataaatactatgccgactccgtgaagggccgattcaccatctccagagacaattccaagaatacgctgtatctggaaatgaataccctgagaactgaggacacggctatgtatttctgtgcgaaagatccggggacctttagggaccatctttggagtggtgttgactactggggccagggaaccctggtcaccgtctcctccg

SEQ ID NO: 2178 - DNA, 663 bp, Artificial Sequence
  Synthetic polynucleotide encoding artificial human antibody VH chain
gaagtgcaactggtggagtctgggggaggcttggtacagcctggcaggtccctgagactttcttgtgcagcctctggattcccctttggtgattatgccatgcactgggtccggcaagctccagggaagggcctggagtgggtctcaggtattggatgggacagtggtggcatcggctatgcggactctgtgaagggccgattcaccatctccagagacatcgccaagaactcgctgtatctggaaataaacagtctgagacctgacgacacggccttgtattactgtgcaaaagcggcggctacactcccctacttccgcttcgctatggacgtctggggccaggggaccccggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaatgtg

SEQ ID NO: 2179 - DNA, 666 bp, Artificial Sequence
  Synthetic polynucleotide encoding artificial human antibody VH chain
ccaggtctcctggtgcagtctggaggtgaggtgaagaagcctggggcctcagtgagggtctcctgcaaggcctctggttacatcgatatcaacaacggcatcagctgggtgcgacaggccccaggacacggtcttgagtggatgggatggatcagcatttacagtggtaacacaaagtatgcacagaagttccagggcagagtcaccatgaccacagcgacatccacgagcacagtctacatggagctgaggagcctgacatctgacgacacggccgtgtattactgtgcgagagtgggagtctttaagggcctggctcctttcggggggttcgacccctggggccaggggaccctggtcaccgtctcttcagcctccaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagtt

SEQ ID NO: 2180 - DNA, 355 bp, Artificial Sequence
  Synthetic polynucleotide encoding artificial human antibody VH chain
ttgttgcagttggtggagtctgggggaggcgtggtccagcctgggaggtccctgagactctcctgtgcagcctctggattcaccttcactcgccatggtttccactgggtccgccaggctccaggcaaggggctggagtgggtggcagttatatcatctgatggaaggaagatacactacacagactcagtgaagggccgattcgtcatctccagagacgattccgacaacacagtgtatctccacatgaacagcctgagacttggggacacggctctgtattactgtgcgagagacagtggtggcactccggggccctactggggccagggaaccctggtcaccgtctcctcag

SEQ ID NO: 2181 - DNA, 667 bp, Artificial Sequence
  Synthetic polynucleotide encoding artificial human antibody VH chain
gtgtgaggtgcaactgttggagtctgggggaggcttggtacagcctggggggtccctgacactctcctgtgtaggctctcgattcacctttagcagctatgccatgaattgggtccgccagagtccagggaggggcctggagtgggtcgcatctatcagtgctactactggtagcacttactacacagactccgtggagggccggttcaccatctccagagacaattccagagacactctatatctgcaaatgaacagcctgagagccgatgacacggccttatattactgtgtgaggtcgttcgtcggcgcagttcccgcttatcccaactttgacttctggggcccggggaccctggtcaccgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccggctgtcctacagtcctcaggactctactccctcagcagcgtggtgaccgtgacctccagcaacttcggcacccagacctacacctgcaacgtagatcacaagcccagcaacaccaaggtggacaagacagtg

SEQ ID NO: 2182 - DNA, 677 bp, Artificial Sequence
  Synthetic polynucleotide encoding artificial human antibody VH chain
cacaggtacagctgcagcagtcaggtccgggactggtgaagccctcgcagaccctctcactcacctgtgccatctccggggacggtgtctctagcaacagtgctagttggaactgggtcaggcagtccccatcgagaggccttgagtggctgggaaggacatactacaggtccaagtggtataatgattatgcagtatctgtgaaaagtcgaatgaccatcaaatcagacacatccaagaaccaattctccctgcagttgaactctgtgactcccgaagacacggctgtttattactgtgtaagaggggtagtgggggctactctcgacaactggggccagggaaccctggtcaccgtctcctcagggagtgcatccgccccaacccttttccccctcgtctcctgtgagaattccccgtcggatacgagcagcgtggccgttggctgcctcgcacaggacttccttcccgactccatcactttctcctggaaatacaagaacaactctgacatcagcagcacccggggcttcccatcagtcctgagagggggcaagtacgcagccacctcacaggtgctgctgccttccaaggacgtcatgcagggcacagacgaacacgtggtgtgcaaagtccagcaccccaacggcaacaaagaaaagaacgtgcctcttccg

SEQ ID NO: 2183 - DNA, 666 bp, Artificial Sequence
  Synthetic polynucleotide encoding artificial human antibody VH chain
caggtgcaattggtggaatctgggggaggcgtggtccagcctggggggtccctgagactctcctgtggagcgtctggattcgccttcagtagtaatggcatgcactgggtccgccaggctccaggcaagggactggagtgggtggcttttattcactatgatggaaggaataaacactatacagattccgtgaagggccgattcgccatctccgtagacgattccaagaccacgttgtatctgcaaatgagcagcctgaaaactgaggacacggctgtttattactgtgtgaaagattcccgggttacggggcaaagcagtggttatatctttgactcttggggccagggaaccctggtcaccgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagactgag

SEQ ID NO: 2184 - DNA, 648 bp, Artificial Sequence
  Synthetic polynucleotide encoding artificial human antibody VH chain
gtggtgcagctggtggagtctgggggaggcctggtcaagcctggggggtccctgagactctcctgtgcagcctctggaatcaccttcagtagctatgacatgaactgggtccgccaggctccagggaaggggctggagtgggtctcatccattagtagtagtagtagttccatatacttcgcagactcagtgaagggccgattcaccatctccagagacaacgccaagaactcactgtatctgcacatgaacagcctgagagccgaggacacggctgtttattattgtgcgagaccccgtttaggctggtacttcgatctctggggccgtggcaccctagtcactgtcgcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagtt

SEQ ID NO: 2185 - DNA, 656 bp, Artificial Sequence
  Synthetic polynucleotide encoding artificial human antibody VH chain
cccaggttcagctggtgcagtctggaggtgaggtgaagaagcctggggcctcagtgaaggtctcctgcaaggcttctggttacaactttaccaactatggtatcagctgggtgcgacaggcccctggccaagggcttgagtggatgggatggatcagcgcttacaatggtaacacgaactatgcacagaagctccagggcagagtcaccatgaccacagacacacccacgagcacagcctacatggagctgaggagcctgagatctgacgacacggccgtgtattactgtgcgagagaaaccgccgggcagctcatcccctttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagtgag

SEQ ID NO: 2186 - DNA, 666 bp, Artificial Sequence
  Synthetic polynucleotide encoding artificial human antibody VH chain
gtggagcaactggtggagtctgggggaggcttggtacagcctggagggtccctgagactctcctgtgcagcctctggattcagcttcaggagttatgaaatgaactgggtccgccaggctccagggaaggggctggagtgggtttcatacattggtattggtggcaataccatatattatgcagactctgtgaagggccgattcaccatctccagagacaacgccaagaactcactgtatctgcaaatgaacagcctgagagccgaggacacggctgtttattactgtgcgagagattatatgggtgtggatttctactactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagtt

SEQ ID NO: 2187 - DNA, 657 bp, Artificial Sequence
  Synthetic polynucleotide encoding artificial human antibody VH chain
caggtccagcttgtgcagtctggggctgaggtgaagaagcctggggcctcagtgaaggtttcctgcaaggcttctggatacatcttcactagctatgctatacattgggtgcgccaggcccccggacaaaggcttgagtggatgggatggatcaacgctggcaatggtaacacaaagtattcacagaagttccagggcagagtcaccattacccgggacacatccgcgaatacagcctacatggagctgagcagcctgagatctgaagacacggctatatattactgtgcgagagatatagcagtggctattactaactactttggctcctggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaggtg

SEQ ID NO: 2188 - DNA, 648 bp, Artificial Sequence
  Synthetic polynucleotide encoding artificial human antibody VH chain
caggtgcagctgcaggagtcgggcccaggactggtgaggccctcggagaccctgtccctcacctgcgatgtctctggttacttaatcagtagtggctactactggggctgggtccggcagccccccggaaagggtctggagtggattgggagcgtctatcatagtgggaatgcctactacaatccgtccctcaagggtcgagtcacaatgtcagtagatacgtcgaaaaatcagttctccctgaagttgacctctgtggccgccgaagacacggccgtctattattgtgcgagagaacatcgtagtgggtatcagcgatactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagtg

SEQ ID NO: 2189 - DNA, 671 bp, Artificial Sequence
  Synthetic polynucleotide encoding artificial human antibody VH chain
cccagatcaccttgaaggagtctggtcctacgctggtgaaacccacacagaccctcacgctgacctgcaccttctctgggttctcactcaacactagtggagtgggtgtgggctggatccgtcagcccccgggaaaggccctggagtggcttgcactcatttattgggatgatgatgagcgctacaggccatctctgaagaacagactcaccatcaccagggacacctccaaaaaccaggtggtccttacgatgaccaacatggaccctgtggacacagccacatattactgtgcacacttctctacggtgattaactttggccactggggccagggaaccctggtcaccgtctcctcagggagtgcatccgccccaacccttttccccctcgtctcctgtgagaattccccgtcggatacgagcagcgtggccgttggctgcctcgcacaggacttccttcccgactccatcactttctcctggaaatacaagaacaactctgacatcagcagcacccggggcttcccatcagtcctgagagggggcaagtacgcagccacctcacaggtgctgctgccttccaaggacgtcatgcagggcacagacgaacacgtggtgtgcaaagtccagcaccccaacggcaacaaagaaaagaacgtgcctcttcca

SEQ ID NO: 2190 - DNA, 346 bp, Artificial Sequence
  Synthetic polynucleotide encoding artificial human antibody VH chain
gaggtgcagctggtggagtctgggggaggcctggtcaagccgggggggtccctcagactgtcctgtgtcggctctggattcaccttcagcaactatagcatgaactgggtccgccaggctccagggagggggcttgagtgggtctcttcaattagttggggtagttcttacataaactacgcagactcagtgaagggccgattcaccatctccagagacaacgccaagaactcactatatctgcagatgaccagcctgaccgccgaggacacggctgtctattactgtgcgtgccgacggatatatcaggggttcgacccctggggccagggaaccctggtcaccg

SEQ ID NO: 2191 - DNA, 645 bp, Artificial Sequence
  Synthetic polynucleotide encoding artificial human antibody VH chain
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatcgattagtagcagtagtaggtacatatactacgcagactcagtgaagggccgattcaccagctccagagacaacgccaagaactcactgtatctgcaaatgaacagcctgagagccgaggacacggctgtgtattactgtgcgagagatcgagctacctcgtttgattactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaggtg

SEQ ID NO: 2192 - DNA, 639 bp, Artificial Sequence
  Synthetic polynucleotide encoding artificial human antibody VH chain
ccggtgcttctgcaggagtcgggcccaggactggtgaagccttcggagaccctgtccctcacctgcactgtctctggtgactccatgagtttttactattggacctggatccggcagcccccagggaagggactggaatggattggatatatctattacagtgggaacaggaactacaatccctccctcaacagtcgagtcaccatatctgtagacacgtccaagaacgaggtctccctgaagctgacgtctgtgacagctgcggacacggccgcgtattactgtgcgagaggtcggggggaaatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagtt

SEQ ID NO: 2193 - DNA, 660 bp, Artificial Sequence
  Synthetic polynucleotide encoding artificial human antibody VH chain
caggtgcagctgcaggagtcgggcccaggactggtgaagcccacacagaccctgtccctcacctgcactgtctctggtggctccatcagcagtggtagttactactggaactggatccggcagcccgccgggaagggactggagtggattgggaacatctataccagtgggaataccgactacaacccctccctcaagagtcgagtcaccatatctctagacacgtccaagaaccaggtctccctgaatttgacttctgtgaccgccgcagacacggccgtgtattactgtgcgactacccctagcagcagctggtactggtacttcgacccctggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagtgag

SEQ ID NO: 2194 - DNA, 663 bp, Artificial Sequence
  Synthetic polynucleotide encoding artificial human antibody VH chain
gaggtgcagttggtggagtctgggggaggcctggtcaagccgggggggtccctgagactctcctgtgcaggctctggatttagtttcagtagttatagcatgaactgggtccggcaggctccagggaaggggctggagtgggtctcatccattagtagtaaaagtagttccaaaaactacatagactctgtgaagaaccgattcatcatctccagagacaacgccaagaactcgctgtatctgcagatgaacagcctgagagccgaggacacggctgtgtattactgtgcgagagatcttgaacttattattgcagcaggtgctccccttgaccactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagag

SEQ ID NO: 2195 - DNA, 666 bp, Artificial Sequence
  Synthetic polynucleotide encoding artificial human antibody VH chain
cccctgcagctgcaggagtcgggcccaggactggtgaagccttcggagaccctgtccctcacctgcactgtctctggtggctccatcagcagaagtccttacttctggggctggatccgccagcccccagggaggggcctggagtggatcgcgagtatctattatagagggaccacctcttacaacccgtccctcaagagtcgagtgaccatctcagtagacacgtctaagaaccagttctccctgaaactgaggtctgtgaccgccgcggacacggccgtgttttattgtgcgagactggtaacatcacctgaagaagggggtccctggttcgacccctggggccggggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagtg

SEQ ID NO: 2196 - DNA, 358 bp, Artificial Sequence
  Synthetic polynucleotide encoding artificial human antibody VH chain
caggtgcagctggtggagtctgggggaggcgtggtccagcctgggaggtccctgagactctcctgtgcagcgtctggattcaccttcactagttatggcatgcactgggtccgccaggctcctggcaaggggctggagtgggtggcacttatctggtatgatggaagtaataaatactatgcagactccgtgaagggccgattcaccatctccagagacaattccaagaacacgctgtatctacaaatgaacagcctgagagccgaggacacggctgtgtattactgtgcgagagatacggaagtggggcatcactttgactactggggccagggaaccctgatcaccgtctcctcag

SEQ ID NO: 2197 - DNA, 659 bp, Artificial Sequence
  Synthetic polynucleotide encoding artificial human antibody VH chain
cccaggtgcagctgcaggagtcgggcccaggactggtgaagccttcggagaccctgtccctcacctgcactgtctctagtggctccagtggtagttattacttgagctggatccggcagcccgccgggaagggactggagtggatcgggcgtatgtacaccagtgggagcacccactacaacccctccctcaagagtcgagtcaccatgtcagtagacacgtccaagaaccagttctccctgaagttgagttctgtgacggccgcggacacggccgtctattactgtgcgaagccctggagaagtgatggttttgatgtctggggccaagggacggtggtcaccgtctcttcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgccct

SEQ ID NO: 2198 - DNA, 650 bp, Artificial Sequence
  Synthetic polynucleotide encoding artificial human antibody VH chain
cccaggtgcagctggtgcagtctggggctgaggtgaagaagcctggggcctcagtgaaggtctcctgcaaggcttctggatacaacttcagggactactatatgcactgggtgcggcaggcccctggacaaggccttgagtggatgggatggatcaaccctaatagtggtggcacaatctctgcacagaactttcagggccgggtcaccatgaccagggacacctccatcagcacagcctacatggaggtaaacagcctgagatctgacgacacggccgtatattattgtgcagtgggcatggttacagatggttttgaaatctggggccaagggacattggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagtt

SEQ ID NO: 2199 - DNA, 668 bp, Artificial Sequence
  Synthetic polynucleotide encoding artificial human antibody VH chain
cccaggtgcagctgcaggagtcgggctcaggactggtgaggccttcacagaccctgtccctcacctgcactgtctctggtggctccatcaacagtggtgattaccactggagttggatccgccagccccccgggaaggacctggagtatattggatatatccatcacactgggagcgcctactacaacccgtccctcaagagtcgagttaccatatcagtagacacgtccaagaaccaacactctctgaggctgacttctgtgactgccgcagacacggccgtgtattattgtgccaggctggatttgcggaccgtgaggttcgacccctggggccaggggaccctggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgccca

SEQ ID NO: 2200 - DNA, 678 bp, Artificial Sequence
  Synthetic polynucleotide encoding artificial human antibody VH chain
cccctgcagctgcaggagtcgggcccaggactggcgaagccttcggagaccctgtccctcacctgcactgcctctggtggctccatcagcagtagtggttactactggggctggatccgccagcccccagggaaggggctggagtggattgggagtatctattatagtggggacacctactacaacccgtccctgaagagtcgagtcaacatagccgtagacacgtcccagaaccagttctccctgaagttgaactctgtgaccgccgctgatacggctgtatattactgtgcgagacatagcagtggccccccccggctcgcttttgatatctggggccaagggacaatggtcaccgtctcttcagggagtgcatccgccccaacccttttccccctcgtctcctgtgagaattccccgtcggatacgagcagcgtggccgttggctgcctcgcacaggacttccttcccgactccatcactttctcctggaaatacaagaacaactctgacatcagcagcacccggggcttcccatcagtcctgagagggggcaagtacgcagccacctcacaggtgctgctgccttccaaggacgtcatgcagggcacagacgaacacgtggtgtgcaaagtccagcaccccaacggcaacaaagaaaagaacgtgcctcttccg

SEQ ID NO: 2201 - DNA, 654 bp, Artificial Sequence
  Synthetic polynucleotide encoding artificial human antibody VH chain
caggtgcagctggtggagtctgggggaggcgtggtccagcctgggaggtccctgagactctcctgtgcagcctctggattcaccttcagtagctatggcatgcactgggtccgccaggttccaggcaaggggctggagggggtggcagttatatcacatgatggaagtaataaatattatgcagactccgtgaagggccgattcaccatctccagagacaattccaagaatacgctgtacctgcaaatgaacagcctgagagttgaggacacggctgtgtattattgtgcgaaagatttcgctatgcctacagtaactacggactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaatgag

SEQ ID NO: 2202 - DNA, 364 bp, Artificial Sequence
  Synthetic polynucleotide encoding artificial human antibody VH chain
cagatcaccttgaaggagtctggtcctacgctggtgaaacccacacagaccctcacgctgacctgcaccttctctgggttctcactcaccactagtggagtgggtgtgggctggatccgtcagcccccaggaaaggccctggagtggcttgcactcatttattgggatgatgataagcgctacagtccatctctgaggagtagactcaccatcaccaaggacacctccaaaaaccaggtggtccttacaatgaccaacatggaccctgtggacacagccacatattattgtgtacacagaccatccctggcctattggtacttcgatgtctggggccgtggcaccctgctcactgtctcctcag

SEQ ID NO: 2203 - DNA, 657 bp, Artificial Sequence
  Synthetic polynucleotide encoding artificial human antibody VH chain
gtggtacagttggtggagtctgggggaggcttggtccagcctggagggtccctgagactctcctgtgcagcctctggattcaccttcagtacatatgaactaaactgggtccggcaggctccagggaaggggctggagtggatttcatacattaatactactagtgatcccatatactacgcagactctgtgaagggccgattcaccatctccagagacaacgccaagaattcagtgtttctgcaaatgaacagcctgagagccgaggacacggctgtttactactgcgtgagagagggtgattcacggaaatattatagtcttgactattggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagtt

SEQ ID NO: 2204 - DNA, 654 bp, Artificial Sequence
  Synthetic polynucleotide encoding artificial human antibody VH chain
ccggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagagatccaatgtgggtctcttatgcttttgatatctggggccaagggacaatggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaatgag

SEQ ID NO: 2205 - DNA, 645 bp, Artificial Sequence
  Synthetic polynucleotide encoding artificial human antibody VH chain
cccgtgcagctgcaggagtcgggcccaggactggtgaagccttcggagaccctgtccctcacctgcactgtctctggtggctccatcagcagtgataattactactggagctggctccgccagcacccagggaagggcctggagtggattgggtacatctatttcagtgtgaccacctactacaacccgtccctcaagagtcgagttaccatatcactagacacgtctaagaaccagttctccctgaagctgagctctgtgactgccgcggacacggccgtgtattactgtgcgagtggttatgtttctttcgatctctggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagtt

SEQ ID NO: 2206 - DNA, 662 bp, Artificial Sequence
  Synthetic polynucleotide encoding artificial human antibody VH chain
cccaggtgcagctgcaggagtcgggcccaggactggtgaagccttcggagaccctgtccctcacctgcaatgtctctggtgcctccatcagtagttactactggagttggatccggcagcccccagggaagggactggagtggattggttatctctcttacagtgggaacaccaactccaaaccctccctcaagagtcgagtcaccatatcagtagacacgtccaagaaccagttctccctgaaactgagctctgtgaccgctgcggacacggccgtgtattactgtgcgagagagggggcctatgagagtagtggacctgatccttttgatatctggggccaagggacaatggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagtt

SEQ ID NO: 2207 - DNA, 662 bp, Artificial Sequence
  Synthetic polynucleotide encoding artificial human antibody VH chain
cccaggtccaggttgtgcagtctggggctgaggtgaagaagcctggggcctcagtgaagatttcctgcaaggcttctggaaacaccttcactacctatactatacagtgggtgcgccaggtccccggacaaaggcttgagtggatgggatggatcaacgctggcaatggtgacataaaatattcacagaagttccaagacagagtcaccattaccagggacacatccgcgaacacagcctacatggagctgagcagcctgagatatgaagacacggctgtatatttctgtgcgagcctctttctaacatactatggttcggggacttattatcgctggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagtgag

SEQ ID NO: 2208 - DNA, 648 bp, Artificial Sequence
  Synthetic polynucleotide encoding artificial human antibody VH chain
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcaactattagtggtagtggtcatagcacatactacgcagactccgtgaagggccggttcaccatctccagagacaattccaagaacacgctgtatctgcaaatgaacagcctgagagccgaggacacggccgtatattactgtgcgaaatcgaccctcggtggtggttttgacttctggggccagggaaccctggtcaccgtctcctcagcctccaccaagggcccatcggtcttccccctggcaccctcctccaagagcacctctgggggcacagcagccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagtt

SEQ ID NO: 2209 - DNA, 669 bp, Artificial Sequence
  Synthetic polynucleotide encoding artificial human antibody VH chain
gtggtgcagctggtggagtctgggggaggtgtggtacggcctggggggtccctgagactctcctgtgcagcctctggattcacctttgatgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccttgtatcactgtgcgagagttggtagcagcagctggtacagctccgggcgatccccttttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagtt

SEQ ID NO: 2210 - DNA, 663 bp, Artificial Sequence
  Synthetic polynucleotide encoding artificial human antibody VH chain
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaagatcaaatcgtcctagagatggctacaagcccctttgactactggggccagggaaccctggtcaccgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagtg

SEQ ID NO: 2211 - DNA, 671 bp, Artificial Sequence
  Synthetic polynucleotide encoding artificial human antibody VH chain
cccaggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagatctcagttgtagtagtaccagctgccatgatgcttttgatatctggggccaagggacaatggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagtgag

SEQ ID NO: 2212 - DNA, 370 bp, Artificial Sequence
  Synthetic polynucleotide encoding artificial human antibody VH chain
caggtgcagctggtgcagtctggggctgaggtgaagaagcctggggcctcagtgaaggtctcctgcaaggcttctggatacaccttcaccggctactatttacactgggtgcgacaggcccctggacaagggcttgagtggatgggacggatcaaccctaacagtggtggcacaaactatgcacagaactttcagggcagggtcaccatgaccagggacacgtccatcagcacagcctacatggagctgagcagtctaaaatctgacgacacggccgtgtttttttgtgcgagaggacccaatttccatgagagtatacgtgatggctttgatatctggggccaagggacaatggtcaccgtctcttcag

SEQ ID NO: 2213 - DNA, 355 bp, Artificial Sequence
  Synthetic polynucleotide encoding artificial human antibody VH chain
gaggtgcagctggtggagtctgggggaggcttggtacagcctggggggtccctgagactctcctgtgcagcctctggattcaccttcagtagctacgactttcactgggtccgccaacctacagggaaaggtctggagtgggtctcagctattggtactgctggtgacacactctatctagactccgtgaagggccgattcaccatctccagagaaaatgccaagaactccttgtatcttcaaatgaacagcctgagagccggggacacggctgtctattactgtgcaagagttaactggaattccgatacctttgactcctggggccagggaaccctggtcaccgtctcctcag

SEQ ID NO: 2214 - DNA, 687 bp, Artificial Sequence
  Synthetic polynucleotide encoding artificial human antibody VH chain
caggtgcagctggtggagtctgggggaggcgtggtccagcctgggaggtccctgagactctcctgtgcagcctctggattcaccttcaggagttatggcatgcactgggcccgccaggctccaggcagggggctggagtgggtggcagttatatcatatgatggaagtaatagttactatgcagactccgtgaagggccgattcaccatctccagagacaattccaagaacacgctgtatctagaaatgaacagcctgagagctgacgacacggctgtctattactgtgcgagagatccggggagagatccgtatttggacttggactatcactacggcatggacgtctggggccaagggaccacggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccg

SEQ ID NO: 2215 - DNA, 663 bp, Artificial Sequence
  Synthetic polynucleotide encoding artificial human antibody VH chain
caggtgcagttggtggaatctgggggaggcttggtcgagcctggagggtccctgagactctcctgtgcagcctctggattcaccttcagtgactactacatgagctggatccgccaggctccagggaagcggctggagtggatttcacacatgagtagtggcggtaatcgcagacactacgcagactctgtgaggggccgattcaccatttccagagacaacgccaagaactcactgtatctgcaaatgaacagcatgagagccgacgacacggctgtgtattattgtgcgagagataagaggagcggtatgacttccgacagacgaattgactactggggccagggcacccgggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagtt

SEQ ID NO: 2216 - DNA, 651 bp, Artificial Sequence
  Synthetic polynucleotide encoding artificial human antibody VH chain
gtggtgcaactgggggagtctgggggaggcctggtcaagccgggggggtccctgagactctcctgtgcagcctctggattcaccttcagtagttatcacatgaactgggtccgccagtctccagagaaggggctggagtgggtctcatacattagtagtagtggtacttacatagactatgcagactcagtgaggggccgattcaccatctccagagacaacgccaagaactcactgtatctgcaaatgaacatcctgagacccgacgacacggctgtttattactgttcggggggctattactcctcctcccacatggacgtctggggcaaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagtt

SEQ ID NO: 2217 - DNA, 654 bp, Artificial Sequence
  Synthetic polynucleotide encoding artificial human antibody VH chain
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagtgatatcatatgatggaagcaataaatactacgcagactccttgaagggccgattcaccatctccagagacaattccaaggacacgctgtatctgcaagtgaacagcctgagacctgaggacacggctgtgtattactgtgcgagagtgaatatagcagcagctggtactcttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaatgag

SEQ ID NO: 2218 - DNA, 678 bp, Artificial Sequence
  Synthetic polynucleotide encoding artificial human antibody VH chain
gaagtgcagctggtggaatctgggggaggcttggtagagcctggcaggtccctgagactctcctgtgcagcctctggattcacccttgaagagtttgccatgcactgggtccggcaagttccagggaagggcctggagtgggtctcagctatcagttggaatagtggttcgatagcctatgcggactctgtgaagggccgatttaccatctccagagacaacgccaagaactccctctatctgcaaatggacagtctgagagctgaggacacggccttgtattactgtgtaaaagatatggggcctgctggaactgcttcggcttatcactaccacaatggaatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagag

SEQ ID NO: 2219 - DNA, 650 bp, Artificial Sequence
  Synthetic polynucleotide encoding artificial human antibody VH chain
cccaggtgcagctgcaggagtcgggcccaggactggtgaagccttcggagaccctgtccctcacctgcactgtctctggtggctccatcagtgattactactggagctggatccggcagcccccagggaaggaactagagtggattgggtatatctattatagtgggagcaccaactacaacccctccctcaagagtcgagtcaccatctcagtagacacgtccaagaaccagttctccctgaaactgagctctgtgaccgccgcagacacggccgtatactactgtgcgagactaactactagtaccagcgcgctgagctactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagtgag

SEQ ID NO: 2220 - DNA, 663 bp, Artificial Sequence
  Synthetic polynucleotide encoding artificial human antibody VH chain
cccgtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagagagaactggaactccgctggaactacggagtggttcgacccctggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagtt

SEQ ID NO: 2221 - DNA, 354 bp, Artificial Sequence
  Synthetic polynucleotide encoding artificial human antibody VH chain
cccaggttcagctggtgcagtctggagctgaggtgaagaagcctggggcctcagtgaaggtctcctgcaaggcttctggttacacctttagcagctacggtatcagctgggtgcgacaggcccctggacaggggcttgagtggatgggatggatcaacggttacaatggtaacacaaactatgcacagaagctccagggcagagtcaccatgaccacagacacatccacgagcacagcctacatggacctgaggagcctgagatctgacgacacggccgtgtattactgtgcgagagatactctacaaaagggggactactggggccagggaaccctggtcaccgtctcctccg

SEQ ID NO: 2222 - DNA, 672 bp, Artificial Sequence
  Synthetic polynucleotide encoding artificial human antibody VH chain
gtggtgcagctggtggagtctgggggaggcttggtacagcctggagggtccctgagactctcctgtgcagcctctggattcaccttccggagttatgaaatgaactgggtccgccaggctccagggaaggggctggagtgggtttcatacattactagtagtggtgataccatataccacgcagactctgtgaagggccgattcaccatctccagagacaacactaagaactcactatatctgcaaatgaccggcctgagaaccgaggacacggctgtttattactgtgcgagagcctcccgcgttctagaaagtaagagctggcacggggatgcttttgatgtctggggccgagggacaagggtcatcgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagtg

SEQ ID NO: 2223 - DNA, 654 bp, Artificial Sequence
  Synthetic polynucleotide encoding artificial human antibody VH chain
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacaacaaactacgcacagaagttccagggcagagtcacgattaccgcggacgaatccacgagcacagcctacatggagctgagcagcctgagatctgaggacacggccgtgtattactgtgcgaggggtcttggcggtagtggttattattttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaatgag

SEQ ID NO: 2224 - DNA, 373 bp, Artificial Sequence
  Synthetic polynucleotide encoding artificial human antibody VH chain
gaggtgcagctggtgcagtctggagcagaggtgaaaaagcccggggagtctctgaagatctcctgtaggggttctggagacagcttcaacaagtactttatcggctgggtgcgccaggtgcccgggaaagccctggagtggatggggatcatctatcctggtgactctgataccagatacagtccgtctttccaaggccaggtcaccatctcagccgacaagtccatcaacatcgcctacctgcagtggaccagcctgaaggcctcggacaccgccatgtattactgtgcgagacaggcattttgtggtgctaattgctggtcgggcgcttatgatatctggggccaagggacaatggtcaccgtctcttcag

SEQ ID NO: 2225 - DNA, 672 bp, Artificial Sequence
  Synthetic polynucleotide encoding artificial human antibody VH chain
caggtacagcttgtggagtctgggggaggcgtggtccagcctgggaggtccctgagactctcctgtgcagcgtctggtttcacattcagtacctatggcatgaactgggtccgccaggctccaggcaaggggctggagtgggtggcagttacatggtatgaggggactaacgaagagtatgcagactccgtgaagggccgattcaccatctccagagacaactccaagaacacggtgtatttgcaaatgaatagtttgagagtcgacgatacggctgtgtattattgtgtgagaaggggggcgactgtatttcagggaaagataattaaaggctacatggacgtctggggcaaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagag

SEQ ID NO: 2226 - DNA, 645 bp, Artificial Sequence
  Synthetic polynucleotide encoding artificial human antibody VH chain
gtggtgcagttgttggagtctgggggaggcttggtacagcctggggggtccctgagactctcctgtacagcctctggattcgcctttagcagctatgccatgacctgggtccgccaggctccagggaaggggctggagtgggtctcagttatgagtggtagtggtgctggcacatactacgcagacgccgtgaagggccggttcaccatctccagagacaattccaagaacacgctgtatctgcaaatggaaagcctgagagtcgaagacacggccgtatattactgtgcgaaagtgaagggggggtccaatgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaatgag

SEQ ID NO: 2227 - DNA, 654 bp, Artificial Sequence
  Synthetic polynucleotide encoding artificial human antibody VH chain
caggtgcagctggtggagtctgggggaggcgtggtccagcctgggaggtccctgagactctcctgtgcagcctctggattcaccttcagtaatcatgctatgcactgggtccgccaggctccaggcaaagggctggagtgggtggcagttatatcatatgatggaggcactaaatactacgcagactccgtgaagggccgattcaccatctccagagacaagtccaagaacacactgtatctgcaaatgaacagcctgagacctgaggacacggctctatattactgtgcgagacacctctacggtgacttttactacttagactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagaggt

SEQ ID NO: 2228 - DNA, 654 bp, Artificial Sequence
  Synthetic polynucleotide encoding artificial human antibody VH chain
caggtgcagctggtggagtctgggggaggcgtggtccggcctgggaggtccctgagactctcctgtgcagcgtctggattcaccttcagtagtcatggcatgcactgggtccgccaggctccaggcaaggggctggagtgggtggcagttatatggtatgatggaagtactaaatactatacagactccgtgaagggccgattcaccatctccagagacaattccaagaacacgttgttcctgcaattgaacagcctgagagccgaggacacggctgtgtattactgtgcgagagaccatcgtacggggagttattatcccgactactggggccagggaaccctggtcaccgtctcctcaacctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagtt

SEQ ID NO: 2229 - DNA, 663 bp, Artificial Sequence
  Synthetic polynucleotide encoding artificial human antibody VH chain
caggtgcagctgcaggagtcgggcccaggactggtgaagccttcggagaccctgtccctcacctgcactgtctctggtggctccgtcgacaatgttgattcctactggagctggatccggcagcccccagggaagggactggagtggattgcatatatctatttcactgggagcaccaactacaacccctccctcaagagtcgagtcaccatatcaatagacacgtccaagaaccagttctccctgaaggtgaacgctgtgaccgctgcggacacggccgtgtattattgtgcgagaggggtgaggcagcagcaggttcggaagtggttcgacccctggggccggggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaatgag

SEQ ID NO: 2230 - DNA, 669 bp, Artificial Sequence
  Synthetic polynucleotide encoding artificial human antibody VH chain
ccggtgcagctggtgcagtctggagcagaggtgaaaaagccgggggagtctctgaagatctcctgtaagggttctggatacagctttaccacctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggaacagcctgaaggcctcggacaccgccatgtattactgtgcgatggataattcggggagcgggggcgttgactactggggccagggaaccctggtcaccgtctcctcagggagtgcatccgccccaacccttttccccctcgtctcctgtgagaattccccgtcggatacgagcagcgtggccgttggctgcctcgcacaggacttccttcccgactccatcactttctcctggaaatacaagaacaactctgacatcagcagcacccggggcttcccatcagtcctgagagggggcaagtacgcagccacctcacaggtgctgctgccttccaaggacgtcatgcagggcacagacgaacacgtggtgtgcaaagtccagcaccccaacggcaacaaagaaaagaacgtgcctcttcca

SEQ ID NO: 2231 - DNA, 654 bp, Artificial Sequence
  Synthetic polynucleotide encoding artificial human antibody VH chain
caggtgcagctgcaggagtcgggcccaggactggtgaagccttcacagaccctgcccctcacctgcactgtctctggtgactccatcagcagtgggagttactattggagctggatccggcagcccgccgggaagggactggagtggattgggcgtatctataccagtgggagcaccaagtacaacccctccctcaagagtcgagccaccatatcaatagacacgtccaagaaccagttctccctgaaactgagctctgtgaccgccgcagacacggccgtgtattactgtgcgagagatagttatcactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagtgag

SEQ ID NO: 2232 - DNA, 672 bp, Artificial Sequence
  Synthetic polynucleotide encoding artificial human antibody VH chain
caggtacaactgcagcagtcaggtccaggactggtgaagccctcgcagaccctctcactcacctgtgccatctccggggacagtgtctctagcaacagtgctgcttggcactggatcaggcagtccccatcgagaggccttgagtggctgggaaggacacactacaggtccaagtggtataatgagtatgcagtatctgtgaagagtcgaataaccatcaacccagacatatccaaaaaccagttctccctgcagttgagctctgtgactcccgaggacacggctgtgtattactgtgcaagagagaccgtttacatctctacttactactacggtttggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaggtg

SEQ ID NO: 2233 - DNA, 654 bp, Artificial Sequence
  Synthetic polynucleotide encoding artificial human antibody VH chain
cccgtccagctgatacagtctggggctgaggtgaggaagcctggggcctcagtgaaggtctcttgcaaggtctccggatacaccctcagtgaattatccctgcactgggtgcgacaggctcctggaaaagggcttgagtggatgggaacttttgatcctgaagatggtgaaacagtctacgcacagaagttccagggcagagtcaccgtgaccgaggacacatctacagacacagcctacattgacctgagcagcctgaaatctgaggacacggccgtctattactgtgcaacagatgggcccttacatacgtcgggacttgactactggggccagggaaccctggtcaccgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagtg

SEQ ID NO: 2234 - DNA, 654 bp, Artificial Sequence
  Synthetic polynucleotide encoding artificial human antibody VH chain
gtggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgtgcttgggggctgaggcgaacgatgcttttgatatctggggccaagggacaatggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagtg

SEQ ID NO: 2235 - DNA, 638 bp, Artificial Sequence
  Synthetic polynucleotide encoding artificial human antibody VH chain
gagaggtgcagctcttggagtctgggggaggcttggtacagcctggggggtccctgagactctcctgtgcagcctctggattcacctttagcaactatgccatgaactgggtccgccaggctccagggaaggggctggactgggtctcagctattagtggtagtggtggtagtacatactacgcagactccgtgaagggccgcttcaccatctccagagacatttccaagaacacgctgtatctgcaaatgaacagcctgagagccgaggacacggccgtctattactgtgcgaaagtccctggggactactggggccagggaaccctggtcaccgtctcctcagcctccaccaagggcccatcggtcttccccctggcaccctcctccaagagcacctctgggggcacagcagccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaatgag

SEQ ID NO: 2236 - DNA, 660 bp, Artificial Sequence
  Synthetic polynucleotide encoding artificial human antibody VH chain
caggtcaagctggtgcaatctggggctgaggtgaagaagcctgggtcctcggtaaaggtctcctgcaagacttctggaggccccttcagcagctatactatcacctgggtgcgacaggcccctggacaagggcctgagtggatgggaaggatcacccctatttttaatataacgaactacgcacagaacttccagggcagaatgacgatgaccgcggacaaatccacgaccacggcctacatggaattgagcggcctgaaatctgaggacacggccgtctattactgtgcgagagcgggccttagtaccagttggccgagctggttcgacccctggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagtg

SEQ ID NO: 2237 - DNA, 660 bp, Artificial Sequence
  Synthetic polynucleotide encoding artificial human antibody VH chain
caggtgcagctgcaggagtcgggcccaggactggtgaagccgtcacagaccctgtcgctcacctgcacggtgtctggtggctccgtcaacactggtacttcctactggacctgggtccgccagcgcccagggaagggcctggagtggattgggttcatctattatagtgggagcacctactacaatccagccctcgagagtcgacttaccatatcactagacacctctcagaatcagttctccctgaaattgacctctgtgactgccgcggacacggccgtgtatttctgtgcgagaaacgatatttccttcaaacagagtgctatcgacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagtg

SEQ ID NO: 2238 - DNA, 666 bp, Artificial Sequence
  Synthetic polynucleotide encoding artificial human antibody VH chain
caggtgcacctggcagagtcggggggaggcgtggtccagacgggggggtccctgagactctcctgtgcagtgtctggattccatttcggcagtcacggcatgacctgggtccgccaggccccaggcaagggcctggagtggctgtcatttataacttatgatggacaaatcaaatattatggagggtccgtgaagggccgattcaacatctccagagacaattccaagaacactctccacctgcacatgaacggcctgagagttgaggacacggctgtttactactgtgcgaaaacgaagactatgggtgtggggggagagtatttcggcttggacgtctggggcctagggacgacggtcatcgtctcctcagcctccaccaagggcccatcggtcttccccctggcaccctcctccaagagcacctctgggggcacagcggccctgggctgcctggtcaaggactacttccccgaatcggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagtg

SEQ ID NO: 2239 - DNA, 666 bp, Artificial Sequence
  Synthetic polynucleotide encoding artificial human antibody VH chain
cccctgcagctgcatgagtcgggcccaggactggcgaagccttcggagaccctgtccctcacctgcactctctctggtggctccatcaccactggtagttattactgggcctggatccgccaggctccagggaaggctctggagtggattgggaccatttattatagtgggaccacctactataattcgtccctcaacaatcgactcaccatttccgtggacacgtccaagaaccagctctccttgaagctggtttctgtggccgccgcagacacggctatatattactgtgcgagacacaaggccctctggttcggggaggcaggggcttttgatatctggggtcaagggacaatggtcacggtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaggtg

SEQ ID NO: 2240 - DNA, 669 bp, Artificial Sequence
  Synthetic polynucleotide encoding artificial human antibody VH chain
gaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagatttgttagggttcagggaccaaaggaactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagtt

SEQ ID NO: 2241 - DNA, 358 bp, Artificial Sequence
  Synthetic polynucleotide encoding artificial human antibody VH chain
caggtgcaactgcaggagtcgggcccaggactggtgaagccttcggagaccctgtccctcagttgcactgtctcaggtgcctccatgaataattactactggagttggatcaggcagtccgccgggaagggtctggaatggattgggcgtatatatagtagtggagacaccgactacaacccctccctgaagactcgagtcaccatgtcaatagacacgtccaagaaccagttctccctgaacctagactctgtgaccgccgcggacacggccacatattactgtgcgagaagcttctacgacacccttttctactttgagaactggggccagggaaccctcgtcaccgtctcctcag

SEQ ID NO: 2242 - DNA, 656 bp, Artificial Sequence
  Synthetic polynucleotide encoding artificial human antibody VH chain
cccagatcaccttgaaggagtctggtcctacgctggtgaaacccacacagaccctcacgctgacctgcaccttctctgggttctcactcaccactactgacgtgggtgtgggctggatccgtcagcccccaggaaaggccctggaatggcttacaatcatttattgggatgatgatgagcgctacagtccatccctgaagagcaggctcaccatcaccaaggacacctccaaaaaccaggtggtcctctcaatgaccaacatggaccctgtggacacagccacatattactgtgcacgcgtttatagtaccaagtgggactttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagtg

SEQ ID NO: 2243 - DNA, 648 bp, Artificial Sequence
  Synthetic polynucleotide encoding artificial human antibody VH chain
gtggtgcagctggtggagtctgggggaggcttggttcagcctggggggtccctgagactctcctgtgcagcctctggattcaccttcagtagctattccatgaactgggtccgccaggctccagggaagggtctggagtggctttcatacgttagcagtagtggtagtaccatgtactatgcagactctgtgaagggccgattcaccatctccagagacactgccaagaactcactgtttctgcaaatgaacagcctgagagccgaggacacggctgtttattactgtgcgaaagggggccctttacgtccttttgatatctggggccaagggacactggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagtg

SEQ ID NO: 2244 - DNA, 678 bp, Artificial Sequence
  Synthetic polynucleotide encoding artificial human antibody VH chain
gccgtgcagctggtgcagtctggagcagaggtgaaaaagcccggggagtctctgaagatctcctgtaggggttctggatacaactttatcagccactggatcagctgggtgcgccagatgcccgggaaaggcctggagtggcagtggctggggaggattgatcctagtgactcttataccaattacagcccgtccttccgaggccacgtcaccatctcagttgacaagtccgtcaacactgcctacctgcaatggaacagcctgaaggcctcggacaccgccatgtattactgtgcgagacttagtagagacggctacaccattgagcactttgactactggggccagggaaccctggtcaccgtctcctcagcatccccgaccagccccaaggtcttcccgctgagcctcgacagcaccccccaagatgggaacgtggtcgtcgcatgcctggtccagggcttcttcccccaggagccactcagtgtgacctggagcgaaagcggacagaacgtgaccgccagaaacttcccacctagccaggatgcctccggggacctgtacaccacgagcagccagctgaccctgccggccacacagtgcccagacggcaagtccgtgacatgccacgtgaagcactacacgaatcccagccaggatgtgactgtgccctgcccg

SEQ ID NO: 2245 - DNA, 674 bp, Artificial Sequence
  Synthetic polynucleotide encoding artificial human antibody VH chain
ccgaggtgcagctggtgcagtctggagcagaggtgaaaaagcccggggagtctctgaagatctcctgtaagggttctggatacagctttaccagcttctggatcggctgggtgcgccagatgcccgggaaaggcctggagtggatggggatcatctttcctgctgactctgataccagatacagcccgtcattccaaggccaggtcatcatctcagtcgacaagtccatcagcaccgcctacctgcagtggagcagcctgaaggcctcggacaccgccatgtattactgtgcgagacgcggggttagtggtgggagcgcctggacgtattacaactttttcgacccctggggccagggaaccctggtcaccgtcgcctcagcctccaccaagggcccatcggtcttccccctggcaccctcctccaagagcacctctgggggcacagcagccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaggtg

SEQ ID NO: 2246 - DNA, 666 bp, Artificial Sequence
  Synthetic polynucleotide encoding artificial human antibody VH chain
cccgtgcagctgcaggagtcgggcccaggactggtgaagccttcggagaccctgtccctcacctgcactgtctctggtggctccatcgatagttattactggagctggctccggcagcccccagggaggggactagagtggattgggtatatcttttacagtggaattaccaactacagcccttccctcaagagtcgagtcaccatatcggtcgacacgtccaagaaccagttctccctgaaactgaactctgtgaccgctgcggacacggccgtgtattactgtgcgagagaacttcccgtgattggtagacgtacttttgatatctggggccaagggacaatggtcaccgtctcttcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccg

SEQ ID NO: 2247 - DNA, 681 bp, Artificial Sequence
  Synthetic polynucleotide encoding artificial human antibody VH chain
cccgtgcatctggtgcagtctggggctgaggtgaagaagcctgggtcctcggtgaaggtctcctgcaaactttctggaggcatcttcagttactttgctatcatctgggtgcgacaggcccctggacaaggccttgagtggatgggaacgatcatccctatttttggaacatcaaactacgcagagaaattccaggacagagtcgcgattgtcgcggacgaggccacgagtacagtttacatggaggtgaacagcctgagatctgaggacacggccatatatttctgtgcgagagattccgaggtggaaaagagtgatgggtacatggcctcgaccgctgaatacttccaactctggggccagggcaccctggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaggtg

SEQ ID NO: 2248 - DNA, 665 bp, Artificial Sequence
  Synthetic polynucleotide encoding artificial human antibody VH chain
gaagtgcgatgcacctggtggagtctgggggagccgtggtccagccgggggagtccctgaggctctcctgttcagcctttgaattcagctttcaatatttttccatgttctgggtccgtcaagctccgacgaagggtcttgagttggtcgctcaaatcacttgggatggttctataataaactacgcagactctgtgaagggccgattcaccatctccagagacaacagcaaaaactccctgtatcttcaaatgaccagtctaagaagtgacgacaccgccgtgtattactgtgtaaaagcaggtgtcccgtgggaggtccagcgatggttcgacccctggggccagggaaccccggtcaccgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagtg

SEQ ID NO: 2249 - DNA, 666 bp, Artificial Sequence
  Synthetic polynucleotide encoding artificial human antibody VH chain
caggttcacctggtgcagtctggagctgaagtgaagaggcctggggcctcagtgaaggtctcctgcaagggttctggttacacccttaacaatgatgtcgctttcagttgggtgcgacaggcccctggacaagggcctgagtggctgggatggatcaatgcttaccagggcgtcacaaatatttccccgaatttccgggccagagtcaccatgaccacagacacatccacgaacacaatttacatggacctccagaacctgaggtccgacgacacggccatctattactgtgcgagagatcgtcagggcctaggccgtatggacgtctggggccaggggaccacggtcatcgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccg

SEQ ID NO: 2250 - DNA, 651 bp, Artificial Sequence
  Synthetic polynucleotide encoding artificial human antibody VH chain
gtggtgcagctggtggagtctgggggaggcttggtccagcctggggggtccctcagactctcctgtgcagcctctggattcaggtttaattactattggatgagctgggtccgccaggctccagggaaaggcctggagtgggtggccaacataaaggaagatggaagtgagaaatactatgtggactctgtgaagggccgattcaccatctccagagacaacgccaagaactcactgtatctggaaatgaacagcctgagagtcgaggacacggctgtctattactgtgcgagggaactgggtgcgaactactactttgcctattggggccagggagccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagtg

SEQ ID NO: 2251 - DNA, 665 bp, Artificial Sequence
  Synthetic polynucleotide encoding artificial human antibody VH chain
cccaggtgcagctgcaggagtcgggcccaggactggtgaagccttcacagaccctgtccctcacctgcattgtctctggtggctccatcagtggtgataaaaacttctggagttgggtccgccagcacccagagaagggcctggagtggcttgggtacatctcttacaatgggaacacctactacaatccgtcgctcatcagtcgaattatcatatcactagacaccccaaagaacctgttctccctgaggttgagctctgtgactgtcgcggacacggccatttattactgtgcgagggaagtcgatatacgtggagacagcgatgcttttgatatttggggccgagggacagtggtcaccgtttcttcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccggctgtcctacagtcctcaggactctactccctcagcagcgtggtgaccgtgacctccagcaacttcggcacccagacctacacctgcaacgtagatcacaagcccagcaacaccaaggtggacaagacagtg

SEQ ID NO: 2252 - DNA, 654 bp, Artificial Sequence
  Synthetic polynucleotide encoding artificial human antibody VH chain
caggtgcggctggtggagtctgggggaggcttggtacagcctggagggttcctaagactctcctgtgcagcctctggattcacattcagtgattatgaaatgaactgggtccgccaggctccagggaaggggctggagtggatttcacacattggtagtagtgggacatacgcagactctgtgaagggccgattcaccatctccagagacaacgccaagaactcactctatctgcaaatgagcagcctgcgagccgaggacgcgggcgtttattactgtgcgactacccgaaactcagctttcctcaactggggccagggaaccctggtcaccgtctcctcagggagtgcatccgccccaacccttttccccctcgtctcctgtgagaattccccgtcggatacgagcagcgtggccgttggctgcctcgcacaggacttccttcccgactccatcactttctcctggaaatacaagaacaactctgacatcagcagcacccggggcttcccatcagtcctgagagggggcaagtacgcagccacctcacaggtgctgctgccttccaaggacgtcatgcagggcacagacgaacacgtggtgtgcaaagtccagcaccccaacggcaacaaagaaaagaacgtgcctcttcca

SEQ ID NO: 2253 - DNA, 657 bp, Artificial Sequence
  Synthetic polynucleotide encoding artificial human antibody VH chain
gaggtgcagctggtggagtctgggggaggcttggtacagccgggggggtccctgagactctcctgtgcagcctctggattcccccctaggagttttgccatgagttgggtccgccaggctccagggaaggggctggagtgggtctcaagtattagtggtcttggaaatagtatatattatgcggagtccgtgaagggccgattcatcacctccagagacaattccaagagcacagtgtttctgctaatgaacagcctgagagccgaggacacggccgtatattattgtgcgaagtccgcatttgggggagttcctgatggttttgatatctggggccaagggacaatggtcaccgtctcttcagcctccaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtagatcacaagcccagcaacaccaaggtggacaagacagtg

SEQ ID NO: 2254 - DNA, 636 bp, Artificial Sequence
  Synthetic polynucleotide encoding artificial human antibody VH chain
ccggtgcagctggtggagtctgggggaggcgtggtccagcctgggaggtccctgagactctcctgtgcagcctctggattcaccttcagcaactatgggatgcactgggtccgccaggctccaggcaaggggctggagtgggtggcagttatatcagatgatgggaatgataaagacaacgcagactccgtgaagggccgattcaccatctccagagacaattccaagaatacgctgtatctgcgaatgaacagcctgagacgagaggacacggctgtgtattattgtgcgagagatgggtttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaatgtg

SEQ ID NO: 2255 - DNA, 361 bp, Artificial Sequence
  Synthetic polynucleotide encoding artificial human antibody VH chain
gaagtgcagctggtggagtctgggggagtcgtggtacagccgggggggtccctgagactctcctgtgcagcctctggattcacctttgatgattataccatgcactgggtccgtcaagctccggggaagggtctggaatgggtctctcttattagttgggatggtggtagcacatactatgcagactctgtgaagggccgattcaccatctccagagacaacagcaaaaactccctgtatctgcaaatgaacagtctgagaactgaagacaccgccttgtattactgtgcaaaagcgggatacagctttactaccgctcctgactactggggccagggaaccctggtcaccgtctcctcag

SEQ ID NO: 2256 - DNA, 657 bp, Artificial Sequence
  Synthetic polynucleotide encoding artificial human antibody VH chain
cccgttcaattggtgcagtctggagctgaggtgaagaagcctggggcctcagtgaaggtctcctgcaaggcctctggtgacacctttcccaactatgttatcagctgggtgcgacaggcccctggacaagggcttgagtgggtgggatgtatcaacacgaacaatggtaaaacaaattatgtgcagaagctccagggcagagtcatcttgaccacagacacatccacaaacacagccaacatggagctgaggagtctgagatttgacgacacggccgtttattactgtgcgcgagagagaggccaggtccgttcctacggcatggacgtctggggccaagggaccgcggtcaccgtctcctcagcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagtg

SEQ ID NO: 2257 - DNA, 684 bp, Artificial Sequence
  Synthetic polynucleotide encoding artificial human antibody VH chain
gaggttcagttggtggagtctgggggaggcttggtacagcctggcaggtccctgagactctcctgtgcagcctctggattcacatttgatgattatgccatgcactgggtccgacaacctccagggaggggcctggagtgggtctcaggtatcgattggagtggaaagaccacagagtatgcacagtctgtgaagggccgattcaccatctccagagacaacgccaagaactccctatatctgcaaatgaacagtctgagagttgaagacacggccttgtatttctgtgtaaaaattggcggggatgggacagcctacgcttggacctttaggcactttgactcctggggccagggtacccgggtcaccgtctcgtcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgccca

SEQ ID NO: 2258 - DNA, 654 bp, Artificial Sequence
  Synthetic polynucleotide encoding artificial human antibody VH chain
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgagagggttgggtggagattggaactaccttgcctactggggccagggaaccctggtcaccgtctcctcagcttccaccaagggcccatcggtcttccccctggcgccctgctccaggagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacacctgcaacgtgaatcacaagcccagcaacaccaaggtggacaagagagtt

SEQ ID NO: 2259 - DNA, 678 bp, Artificial Sequence
  Synthetic polynucleotide encoding artificial human antibody VH chain
caggtgcagctggtggagtctgggggaggcgtggtccagcctgggaggtccctgagactctcctgtgcagcctctggattcaccttcagtaactatgacatgcactgggtccgccaggctccaggcaaggggctggagtgggtgacagttgtatcatatgatggaactaataaatattatgcagagtccgtgcagggccgattcaccatctccagagacaattccaagaacacgctgtatctgcaaatgaacagcctgagaactgaggacacggctgtgtattactgtgcgaaagaaggtggatgggggaatacagtaactacgtcctactactactacggtatggatgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagtc

SEQ ID NO: 2260 - DNA, 657 bp, Artificial Sequence
  Synthetic polynucleotide encoding artificial human antibody VH chain
gaggtgcagttggtggagtctgggggaggcctggtcaggccgggggggtccctgagactctcctgtgttggctctggattcaccttcagtccctatagtataaactgggtccgccaggctccagggaaggggctggagtgggtctcatcgattactagtaccagtagttacttagactacgcagactcagtaaagggccgattcaccatctccagagacaacgccaagaactcagtgtatctgcaaatgaacagcctgagagtcgaggacacggctgtctattactgtacgagggatgggggatacttcgcaactggcgagtttgactactggggccagggaaccatggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagct

SEQ ID NO: 2261 - DNA, 666 bp, Artificial Sequence
  Synthetic polynucleotide encoding artificial human antibody VH chain
ccggtgcagctgcaggagtcgggcccaggactggtgaagccttcacagaccctgtccctcacctgcactgtctctggtggctccatcaccagtggtagttacttctggagttggatccggcagcccgccggggaggggctggagtggattgggcgtatatataccagtgggagcaccaactacaacccctccctcaagagtcgagtcaccatatcagcagacacgtccaagaaccacttctccctggagctgagctctgtgaccgccgcagacacggccatgtatttctgtgcgagagagcgctttggccaaggtgcccttgactactggggccagggaaccctggtcaccgtctcctcagcatccccgaccagccccaaggtcttcccgctgagcctcgacagcaccccccaagatgggaacgtggtcgtcgcatgcctggtccagggcttcttcccccaggagccactcagtgtgacctggagcgaaagcggacagaacgtgaccgccagaaacttcccacctagccaggatgcctccggggacctgtacaccacgagcagccagctgaccctgccggccacacagtgcccagacggcaagtccgtgacatgccacgtgaagcactacacgaattccagccaggatgtgactgtgccctgcccc

SEQ ID NO: 2262 - DNA, 663 bp, Artificial Sequence
  Synthetic polynucleotide encoding artificial human antibody VH chain
cagctgcatctgcaggagtcgggcccaggactggtgaagccttcggagacactgtccctcacctgcactgtctctggtggctccgtcagcagtagtagttactactggggctgggtccgccagcccccagggaaggggctggagtggattggccatgtctattacagtgggaggacctactacaacccgtccctcaagagtcgagccaccatatccttagatacgtccaagaatcagttttccctgaagctgagctctctcaccgccacagacacggctgtctattactgtgcgaccatcgtcgctgcctacagctatggtttcgagttcgacccctggggccagggaatcctggtcatcgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagcc

SEQ ID NO: 2263 - DNA, 678 bp, Artificial Sequence
  Synthetic polynucleotide encoding artificial human antibody VH chain
caggtgcagctggtggagtctgggggaggcgtggtccagcctgggaggtccctgagactctcctgtgcagcctctggattcaccttcagtaactatgacatgcactgggtccgccaggctccaggcaaggggctggagtgggtgacagttgtatcatatgatggaactaataaatattatgcagagtccgtgcagggccgattcaccatctccagagacaattccaagaacacgctgtatctgcaaatgaacagcctgagaactgaggacacggctgtgtattactgtgcgaaagaaggtggatgggggaatacagtaactacgtcctactactactacggtatggatgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagtt

SEQ ID NO: 2264 - DNA, 365 bp, Artificial Sequence
  Synthetic polynucleotide encoding artificial human antibody VH chain
ggttcagctggtgcagtctggagcagaggtgagaaagccgggggagtctctgacgatctcctgtaagacttctggctacgcctttatcggtaactggatcggctgggtgcgccagaggcccgggaaaggcctggagtggatcggaatgatttatcctgttgactctgataccagatatagtccgtccttccaaggccaggtcaccatctcagtcgacaagtccatcaggaccgcctatctgcagtggaacagtctgcgggcctcagacaccgccacctattattgtgcgcgacagggatttgaggctctggttattcgaggctttgactactggggccagggaaccgttgtcactgtctcctcag

SEQ ID NO: 2265 - DNA, 668 bp, Artificial Sequence
  Synthetic polynucleotide encoding artificial human antibody VH chain
gtgaggggcagctgttggagtctgggggaggcttggttcagccgggggggtccctgagactctcctgtgaagcctctggattcaccttttcctttagcagttatgccatgagttgggtccgccaggctccagggaggggactggagtgggtctcagttaccggtggtagtggttataccaaatactacgcagactccgtgaagggccggttcaccgtctccagagacaattccaagaacaccctctatctgcaaatgaacagcctgcgagccgaggacacggccctatattactgtgcgaggagatctaccagtagcccctctttcagcactctggacgtctggggccgaggggccacggtcatcgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagtgag

SEQ ID NO: 2266 - DNA, 645 bp, Artificial Sequence
  Synthetic polynucleotide encoding artificial human antibody VH chain
gtggtgcagctggtggagtctgggggaggcttggtacagcctggagggtccctgagactctcctgtgcagcctctggattcaccttcaataattatgaaatgaactgggtccgccaggctccagggaaggggctggagtgggtttcatacattagtagtagtggtagtaccatatactatgcagactctgtgaagggccgattcaccatctccagagacaacgccaagaactcactgtatctgcaaatgaacagcctgagagccgaggacacggctgtttattactgtgcgagacaaatggtgactacgaggggctactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaatgtg

SEQ ID NO: 2267 - DNA, 663 bp, Artificial Sequence
  Synthetic polynucleotide encoding artificial human antibody VH chain
gaggtgcagctggtggagtctgggggaggcttggtccagcctggggggtccctgagactctcctgtgcagcctctggattcacctttagtagcaattggatgagctgggtccgccaggctccagggaaggggctggagtgggtggccaacataaaggaagatggaagtgagaaatactacgtggactctgtgaagggccgattcaccatttttagagacaacgccaagaactcactgtatctgcaaatgaacagcctgagagccgaggacacggctgtgtattactgtgcgagagtcccatctcgctatggccgttccaggggcgcttttgatatctggggccaagggacaatggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagtg

SEQ ID NO: 2268 - DNA, 656 bp, Artificial Sequence
  Synthetic polynucleotide encoding artificial human antibody VH chain
cccaggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcaagagtctagttaccatatcagtagacacgtctaagaaccagttctccctgaagctgagctctgtgactgccgcggacacggccgtgtattactgtgcgagaaatctttatcgtctgggctggttcgacccctggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagtg

SEQ ID NO: 2269 - DNA, 654 bp, Artificial Sequence
  Synthetic polynucleotide encoding artificial human antibody VH chain
caggtgcagctggtggagtctgggggaggcgtggtccagcctgggaggtccctgagactctcctgtgcagcctctggattcacgttcagtagctatggcatgcactgggtccgtcaggctccaggcaaggggctggagtgggtggcaattatatcatatgatggaagtaataaatattatgcagactccgtgaagggccgattcaccatctccagagacaaatccaagaacacgctgtatctgcaaatgaacagcctgagagctgaggacacggctgtgtattactgtgcgaaatcgaaaggtaactaccgggacgctatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagtt

SEQ ID NO: 2270 - DNA, 657 bp, Artificial Sequence
  Synthetic polynucleotide encoding artificial human antibody VH chain
caggtgcttctggtggagtctgggggcggcttggtcaagcctggagggtccctgagactctcctgtgcagcctctggattcaccttcagtgactactacatgagctggatccgccaggctccagggaaggggctggagtgggtttcatacattggtagtagtactactgccatatactacgcagactctgtgaagggccgattcaccatctcccgggacaacgccaggaactcgctgtatctgcaaatgaacagcctgcgagccgaggacacggccgtgtattactgtgcgacctcatatacagtaacgactttctacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagtg

SEQ ID NO: 2271 - DNA, 656 bp, Artificial Sequence
  Synthetic polynucleotide encoding artificial human antibody VH chain
cccaggtgcagctgcaggagtcgggcccagggctggtgaagccttcacagaccctgtccctcacctgcgctgtctctggtggctccatcagcagtggtggttacccctggagctggatccggcagccaccagggaagggactggagtggattgggtatatctcttacagtgggagcaccgactacaacccgtccctcaagagtcgagttaccatatcgctggacacgtccagtaaccagttctccctgaacctgtcctctctgaccgccgcggacacggccgtgtattactgtgccagaggggcggccttctactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagtg

SEQ ID NO: 2272 - DNA, 657 bp, Artificial Sequence
  Synthetic polynucleotide encoding artificial human antibody VH chain
caggtgcagctgcaggagtcgggcccaggactggtgaagccttcggagaccctgtccctcacctgcactgtctctggtggctccatcagtatttactactggagctggatccggcagcccccagggaagggactggagtggattggatatatctattatagtgggagcaccaactacaacccctccctcaagagtcgagtcaccatatcagtagacacgtccaagaaccagttctccctgaagctgaggtctgtgaccgctgcggacacggccgtgtattactgtgcgagagatacctacggtgacccgaggggtgactactttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagtg

SEQ ID NO: 2273 - DNA, 370 bp, Artificial Sequence
  Synthetic polynucleotide encoding artificial human antibody VH chain
caggtgcagctacaggagtcgggcccaggactggtgaagccttcggagaccctgtccctcacctgcactgtcgctaatagctccatcagtagttactactggagctgggtccggcagcccccagggaaggcactggagtggattggatatatctcttattctgggagcaccaactacaacccctccctcaagagtcgagtcaccatgtcactagacacgcccaagagccagttctccctaaacctgagctctgtgaccggcgcagacacggccatatattactgtgcgagactgtggggtagcggtgactggtggccctccctgtattttgactcctggggccagggaaccctggtcaccgtctcctcag

SEQ ID NO: 2274 - DNA, 654 bp, Artificial Sequence
  Synthetic polynucleotide encoding artificial human antibody VH chain
gtggtgcagctggtggagtctgggggaggcttggtccagcctggggggtccctgagactctcctgtgcagcctctggattcacctttaatagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagaatccggcgtatagcagcaactagttttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaatgtg

SEQ ID NO: 2275 - DNA, 675 bp, Artificial Sequence
  Synthetic polynucleotide encoding artificial human antibody VH chain
gaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagtataggctatgcggactctgtgaagggccgattcaccatctccagagacaacgccaagaactccctgtatctgcaaatgaacagtctgagagctgaggacacggccttgtattactgtgcaaaaatagcacgtcgtcctcccagtttttacgactacatggacgtctggggcaaagggaccacggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgccca

SEQ ID NO: 2276 - DNA, 675 bp, Artificial Sequence
  Synthetic polynucleotide encoding artificial human antibody VH chain
gaggtgcagctggtgcagtctggagcagaggtgaaaaagccgggggagtctctgaagatctcctgtcagggttctggttacaggtttaacgcctactggatcggctgggtgcgccagatccccgggaaaggcctggagtggatggggatcatctatcctggtgactctgataccaaatacagcccatccttccaaggccaggtcaccatctcagccgacaagtccatcagcaccgcctacctgcagtggaacggcctggaggcctcggacaccgccgtctattactgtgcgaggtcgacaagtagttccacctccgacttccactacatggacgtatggggcaaggggaccacggtcaccatctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgccca

SEQ ID NO: 2277 - DNA, 654 bp, Artificial Sequence
  Synthetic polynucleotide encoding artificial human antibody VH chain
cacgtacaactgctacagtccggtccaggactggtgaagccctcgcagaccctctcactcacctgtgccatctccggggacagtgtctctagtaccagtggtgcttggaactggatcaggcagtccccatcgagaggccttgagtggctgggaaggacatactacaggtcccagtggatgaatgattatgcagaatctgtgagaagtcgaataaccatcaaccctgacacatccaagaaccaattctccctgcagttgaaatctgtgactcccgaggacacggctgtttattactgtacaagaggatgggcattcaccagctccgactggggccagggaacccaggtcaccgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagtg

SEQ ID NO: 2278 - DNA, 666 bp, Artificial Sequence
  Synthetic polynucleotide encoding artificial human antibody VH chain
cacgtacacctgcagcagtcaggtccaggactggtgacgccctcgcagaccctctcactcacctgtgccatctccggggacagtgtctctagcaacagtgctgcttggaactggatcaggcagtccccatcgagaggccttgagtggctgggaaggacatactacaggtccaagtggtataatgactatgcagtatctgtgaaaagtcgaataaccttcaaggcagacacgtccaagaaccagttctccctgcagctggactctgtgactcccgacgacacggctgtgtattactgtgcaggaggatgggcccttggctactggggccagggaaccctggtcaccgtctcctcagggagtgcatccgccccaacccttttccccctcgtctcctgtgagaattccccgtcggatacgagcagcgtggccgttggctgcctcgcacaggacttccttcccgactccatcactttctcctggaaatacaagaacaactctgacatcagcagcacccggggcttcccatcagtcctgagagggggcaagtacgcagccacctcacaggtgctgctgccttccaaggaggtcatgcagggcacagacgaacacgtggtgtgcaaagtccagcaccccaacggcaacaaagaaaagaacgtgcctcttcca

SEQ ID NO: 2279 - DNA, 349 bp, Artificial Sequence
  Synthetic polynucleotide encoding artificial human antibody VH chain
cccgtgcagctgcaggagtcgggcccaggactggtgaagccttcggagaccctgtccctcacctgcactgtctctggtggctccatcagtagttactactggagctggatccggcagcccccagggaagggactggagtggattgggtatctcttttacagtgggagcaccaactacaacccctccctcaagagtcgagtcaccatatcagtagacacgtccaagaaccagttctccctgaagttgggctctgtgaccgccgcagacacggccgtgtattactgtgcgagacaccgaattttcggtttggacgtctggggccaagggaccacggtcaccgtctcctcag

SEQ ID NO: 2280 - DNA, 691 bp, Artificial Sequence
  Synthetic polynucleotide encoding artificial human antibody VH chain
ctgtgccgaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacgcggaccgaccgatacatggtcaggggaagttggctactactttgactactggggccagggaaccctggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccg

SEQ ID NO: 2281 - DNA, 669 bp, Artificial Sequence
  Synthetic polynucleotide encoding artificial human antibody VH chain
cagtgtcaggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagatggaaaaacattagggtacggtggtaactccgttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaggtg

SEQ ID NO: 2282 - DNA, 672 bp, Artificial Sequence
  Synthetic polynucleotide encoding artificial human antibody VH chain
gaggtgcagctggtggagtctgggggaggcctggtcaagccgggggggtccctgagactctcctgtgcagtctctgggttcactttcagatcctacagcatgaactgggtccgccaggctccagggaaggggctggagtgggtctcatccattagtagcagtagtcgttacgtggactacgcagactcagtgaagggccgattcaccatctctagagacaacgccaagaacttactgtatctgcaaatgaacttcctgagagtcgaggacacggctgtgtattactgtgctcggacagaaactaaatgggaggacagggggctttgggactactggggccagggaaccctggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgccca

SEQ ID NO: 2283 - DNA, 645 bp, Artificial Sequence
  Synthetic polynucleotide encoding artificial human antibody VH chain
caggtccagctggtgcaatctggggctgaggtgaagaagcctgggtcctcggtgaaggtctcctgcaagacttctggaggcaccttcagcagttatactatcagctgggtgcgacaggcccctggacaagggcctgagtggatgggaaggatcatccctatacttaatataacaaactacgcgcagaagttccagggcagagtcacgattaccgcggacaaatccacgagcacaacctacatggagatgggcagcctgagatctgaggacacggccgtgtatttctgtgcgagatcgttttatggttcaggtttgcagtggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagtg

SEQ ID NO: 2284 - DNA, 654 bp, Artificial Sequence
  Synthetic polynucleotide encoding artificial human antibody VH chain
ggggtggacctggtggagtctgggggaggcctggtcaagcctggggggtccctgagactctcctgtgcagcctctggattcagcttcagcagatataatataaactgggttcggcaggctccagggaaggggctggagtgggtctcatccattagtagtactagcaattacatatactacgcggactctgtgaagggccggttcaccatctccagagacaacgccaagaactcactctatctgcaaatgaacagcctgagagccgaggacacggctgtgtattactgtgcgagggccatgggtggctacacttactaccttgacgactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaggtg

SEQ ID NO: 2285 - DNA, 666 bp, Artificial Sequence
  Synthetic polynucleotide encoding artificial human antibody VH chain
caggtgcagttggtggaatctgggggaggcgtggtccagcctgggaggtccctgagactctcctgtgcagcctctggattcaccttcactaattatgccatacactgggtccgccaggctccagacaaggggctggagtgggtgtcagttatttcatatgatggaagtgatgaatactacgcagactccgtgaagggccgattcaccatctccagagacaattccaagaacacggtttatctgcaaatgagcagcctgagagctgaggacacggctgtctatcgctgtgcgagggcggggaaagacggctacaattttttctactacggtatggacgtctggggccaagggaccacggtcagcgtctcctcaccctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaagttg

SEQ ID NO: 2286 - DNA, 660 bp, Artificial Sequence
  Synthetic polynucleotide encoding artificial human antibody VH chain
caggtgcagttggtggagtctgggggaggcgtggtccagcctgggaggtccctgagactctcgtgtgcagcgtctggattctccttcagtagttttggcatgcactgggtccgccaggctccaggcaaggggctggagtgggtggcagttatatggcatgatggaagtcataaatctcatgcagactccgtgaagggccgattcaccatctccagagacaattccaagaacacggtgtatctacaaatgaacagcctgggagccgaggacacggctgtatattactgtgcgagagggatcatgactacagcaatttcctactactttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagtt

SEQ ID NO: 2287 - DNA, 376 bp, Artificial Sequence
  Synthetic polynucleotide encoding artificial human antibody VH chain
gaggtgcagctgttgcagtctgggggaggcttggtccagcctggggggtccctgagactctcctgtgcagcctctggattcacatttagctcgtatgccgtgacctgggtccgccaggctccagggaaggggctggagtgggtctcaacgattagtggtgatggtcgtagcacatatttcgcagactccgtgaagggccgtttcgccatctacagagacaattccaagaacacgctgtctctgctattgaacagcctgagagccgaggacacggccgtatattactgtgcgaaaggagaaagggacctgacagactacggtgaccccgaatatttccagcactggggccagggcaccctggtcaccgtctcctcag

SEQ ID NO: 2288 - DNA, 376 bp, Artificial Sequence
  Synthetic polynucleotide encoding artificial human antibody VH chain
caggtgcaagtggtggagtctgggggaggcgtggtccagcctgggaggtccctgagactctcctgtgtagcctctggattcaccttcagtagtcatggcatgcactgggtccgccaggctccaggcaaggggctggagtgggtggcggttatatcagatgatggaaaaaataaatactatggagactccgtgcagggccgatttgtcatctccagagacaattccaagaacacgatatatctacagatgtacgacctgagggctgaggacacggctgtctattactgtgcgaaagatctgcgatattgtagcgctcgtagtagttgttttggcattgacttctggggccagggaaccctagtcaccgtctcctcag

SEQ ID NO: 2289 - DNA, 642 bp, Artificial Sequence
  Synthetic polynucleotide encoding artificial human antibody VH chain
gtggtgcaactggtggagtctgggggaggcttggtccagcctggggggtccctgagactctcctgtgcagcctctggattcagctttagtacctattggatgagctgggtccgccaggctccagggaaggggctagagtgggtggccaacataaagcaagatgggagtgagaaacactatgtggactctgtgaagggccgattcaccatctccagagacaacgccaagaactcactgtatctgcaaatgaatagcctgagagccgaggacacggctatgtattattgtgcgagaagagcatacagctttgactactggggccagggaaccttggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagtgag

SEQ ID NO: 2290 - DNA, 669 bp, Artificial Sequence
  Synthetic polynucleotide encoding artificial human antibody VH chain
gaggtgcagctggtggagtccgggggaggcttagttcagcctggggggtccctgagactctcctgtgcagcctctggattcaccttcaataactactggatgcactgggtccgccaagctccagggaagggactggtgtgggtctcacgtatttccagtgatgggagtaccacagcctccgcggactccgtgaagggccgattcaccatctccagagacaacgccaagaacacactatttctccaaatgaacagtctgagagccgaggacacggctgtgtattattgtgcaagagagggggccccagatgactacggtgactccgggactgcttttgatatttggggccaagggacaacggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaggtg

SEQ ID NO: 2291 - DNA, 659 bp, Artificial Sequence
  Synthetic polynucleotide encoding artificial human antibody VH chain
gcgaggtgcacctggtgcagtctgggggaggcttggtaaagcctggggggtcccttagactctcctgtgcagcctctggatttactttcagtcacggctggatgagctgggtccgccaggctccagggaagggactggagtgggttgcccgtattaggagcaaaaccgatggtgggactacagactacgctgctcccgtgaatggcagattcaccatctccagagacatttctattgagactctgtatttgcaaatggacagcctgaaaaccgaggacacagccgtctattactgtaccaccgatcacccctatggtgactactctgacaactggggccagggagtcctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagtgag

SEQ ID NO: 2292 - DNA, 656 bp, Artificial Sequence
  Synthetic polynucleotide encoding artificial human antibody VH chain
cccaggtgcagctgcaggagtcgggcccaggactggtgaagccttcggagaccctgtccctcacctgcactgtctccggtggctccatcagaaatgactactggagttggatccggcagtccccggggaagggactggagtggattgggtacatctctgacattggggacaccaactacaacccctctttcaagagtcgaatctccatatcactggacacgtccaagaaccagttctccctgaagctgaactctgtgaccgctgcggacacggccgtctattactgtgcgaaggaattattagggggttttgactattggggccagggaacccttgtcgccgtctccacagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccg

SEQ ID NO: 2293 - DNA, 656 bp, Artificial Sequence
  Synthetic polynucleotide encoding artificial human antibody VH chain
cccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccccatctttggtacagcaaactacgcacagaagttccagggcagagtcacgattaccgcggacgaatccacgagcacagcctacatggagctgagcagcctgagatctgaggacacggccgtgtattactgtgcgagagtttttggatcagcagctggtgcttttgatatctggggccaagggacaatggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagtgag

SEQ ID NO: 2294 - DNA, 654 bp, Artificial Sequence
  Synthetic polynucleotide encoding artificial human antibody VH chain
cccctgcagctgcatgagtcgggcccaggactggtgaagccttcggagaccctgtccctcacctgctctgtctctggtggctccatcagcagtagtaattacttctggggctggatccgccagtccccagggatggggctggagtggattgggagtatctattttagtgggaaaactcactacaacccgtcgctcaagagtcgagtcaccatatccgtagatacgtccaagaatcacttctccctgaagctgagctctgtgaccgccgcagacacggctgttttcttctgtgcgagacacgattggcgcttatacgcatttgactactggggcctcggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagtgag

SEQ ID NO: 2295 - DNA, 660 bp, Artificial Sequence
  Synthetic polynucleotide encoding artificial human antibody VH chain
gtggtgcagctggtggagtccgggggaggcttagttcagcctggggggtccctgagactctcctgtgcaggctctggatttaccttcagtgactactggatgcactgggtccgccaagctccagggaaggggctggtgtgggtctcaactattaatcgtgatgggagttacacaaaccacgcggactccgtgaagggccgattcaccatctccagagacaacgccaggagcacgctgtttctgcaaatgagcagtctcagagtcgaggacacggctgtgtattactgtgcaggaggggaaaccagtcctgactactggggccagggaaccctggtcaccgtctcctcagggagtgcatccgccccaacccttttccccctcgtctcctgtgagaattccccgtcggatacgagcagcgtggccgttggctgcctcgcacaggacttccttcccgactccatcactttctcctggaaatacaagaacaactctgacatcagcagcacccggggcttcccatcagtcctgagagggggcaagtacgcagccacctcacaggtgctgctgccttccaaggacgtcatgcagggcacagacgaacacgtggtgtgcaaagtccagcaccccaacggcaacaaagaaaagaacgtgcctcttcca

SEQ ID NO: 2296 - DNA, 665 bp, Artificial Sequence
  Synthetic polynucleotide encoding artificial human antibody VH chain
cccaactgcagctgcaggagtcgggcccaggactggtgaagccttcggagaccctgtccctcacctgcactgtctctgatgtctccatcatcagtagtttctattactggggctggatccgccagccccccgggaaggggctagagtggattgggagtgtctattatagtgggagcacctcctacaacccgtccctgaagagccgcgtcaccatatccgcagacacgtccaaggcacatttctccctgaacctgaggtctgtgaccgccgcagacacggctgtttattattgtgtgagtagggggcccctagggggagcagcagctggaccggactactggggccagggagcccttgtcatcgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagtt

SEQ ID NO: 2297 - DNA, 648 bp, Artificial Sequence
  Synthetic polynucleotide encoding artificial human antibody VH chain
caggtgcggctgcaggagtcgggcccaggactggtgaagccttcacagaccctgtccctcacctgcactgtctctggtgcctccgtttccagtggttcttactactgggcttgggtccggcagtccgccgcgaagggactggagtggattgggcgtgtgtctcccagcgggactaacaactacaacaccgcgctgaagagccgggtcaccatatccctggacacggcgaggaaccagttctccctgacagtgacctctgtgaccgccgaagacacggccatctattactgtgcgcgagatgtccgagggtggttcgtcccctggggccagggtagcctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagtgag

SEQ ID NO: 2298 - DNA, 672 bp, Artificial Sequence
  Synthetic polynucleotide encoding artificial human antibody VH chain
cccgtccagttggtgcagtctggggctgtggtgaagaagcctgggtcctcggtgaaagtctcctgcaaagcttctggaggcaccttcagcggctatggcatcaattgggtgcgacaggcccctggacaagggcttgagtggatgggaaggatcatccctattgttggagaagcaaactacgcacagaagttccagggcagagtcacaattaacgcggacaagtccacgagcacagccacattggaagtgaggagcctgagatctgaggacacggccgtctattactgtgtgagagatcgcaacattgtatctgtgccaggtgctatcccctacggaatggacgtctggggccaggggaccacggtcaccgtctcctcagcttccaccaagggcccatcggtcttccccctggcgccctgctccaggagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacacctgcaacgtgaatcacaagcccagcaacaccaaggtggacaagagagtt

SEQ ID NO: 2299 - DNA, 349 bp, Artificial Sequence
  Synthetic polynucleotide encoding artificial human antibody VH chain
gtggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagggagtgacacccttgactactggggccagggaaccctggtcaccgtctcctcag

SEQ ID NO: 2300 - DNA, 656 bp, Artificial Sequence
  Synthetic polynucleotide encoding artificial human antibody VH chain
cccaggtgcagctgcaggagtcgggcccaggactgctgaagccttcacagaccctgtccctcagctgcactgtctctggtggctccatcagcagtggagattactactggagttggatccgccagcccccagggaagggcctggaatggattgggtacatctattacaatgggagcacctactacagttcgtccctcaggagtcgacttaccatatcagtggacacgtccaagaaccagttctccctgaagctgagctctgtgactgccgcagacacggccgcgtattactgtgccagagtggggctaacttttgccttgttcgacccctggggccagggaaccctggtcaccgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagtt

SEQ ID NO: 2301 - DNA, 666 bp, Artificial Sequence
  Synthetic polynucleotide encoding artificial human antibody VH chain
gtggtgcagctgttggagtctgggggaggcttggtacagcctggggggtccctgagactctcctgtgcagcctctggattcacctttagcagctatgccataaactgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaacagtgcggggatacagctatggtcctcagacaactggttcgacccctggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagtgag

SEQ ID NO: 2302 - DNA, 657 bp, Artificial Sequence
  Synthetic polynucleotide encoding artificial human antibody VH chain
gaggtgcagctgttggagtctgggggaggcttggtgcagcctggggggtccctgagactctcctgtgcagcctctggattcacctttagcagctatgccatgagctgggtccgccaggctccagggaaggggctggagtgggtctcagccattagtgccagtggtcgtaccacatactacgcagactctttcaagggccggttcaccatctccagagacaattccaagaacacgctatatttgcaaatgagcagactgagaggcgacgacgcggccgtttattactgtgcgaaagagggcatagaactcatgatcctctggggccagggaaccctggtcaccgtctcctcaacatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccg

SEQ ID NO: 2303 - DNA, 669 bp, Artificial Sequence
  Synthetic polynucleotide encoding artificial human antibody VH chain
gtggtccagttggtggagtctgggggagccttggtccagcctggggggtccctgagactctcctgtgcagcctctggattcaccttgagcagctatgctatgtactgggtccgccaggctccagggaagggacttgaatatgtttcagctattactgctaatgggggtagcacatattatgcaaattctgtgaagggcagattcaccgtctccagagacaattccaagaaaacggtttatcttcaattgggcagcctgagagctgaggacacggctgtctattactgtgcgagaggcattaccctgactcggggagtctcctttgactactggggccagggaaccctggtcaccgtctccccagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccg

SEQ ID NO: 2304 - DNA, 352 bp, Artificial Sequence
  Synthetic polynucleotide encoding artificial human antibody VH chain
cccctgcagctgcaggagtccggctcaggactggtgaagccttcacagaccctgtccctcacctgcgctgtttcaggtggctccatcagcagtggtggttactcctggagctggatccggcagccaccagggaagggcctggagtggcttgggtacatctatcatagggggacctcctactacaacccgtccctcaagagtcgagtcaccatatcactagacatgtccaagaaccagctctccctgaagctgacctctgtgaccgccgcggacacggccgtgtattactgtgccagagatgggggagcttttgatatctggggccaagggacattggtcaccgtctcttcag

SEQ ID NO: 2305 - DNA, 663 bp, Artificial Sequence
  Synthetic polynucleotide encoding artificial human antibody VH chain
caggtgcacctggtggagtctgggggaggcgtggtccagcctgggaggtccctgagactctcctgtgcagcctctggattcaccttcagtaactctgctatgcactgggtccgccaggctccaggcaaggggctggattgggtgtcagttatctcatttgatggaagcaatcaatattatgcagactccgtgaagggccgattcaccatctccagagacaattccaagaacacgctgtttctgcaaatgaacagcctgagagctgaggacacggctgtatattactgtgcgagagatcggcttttcacagctattaacagtgggtactttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagtgag

SEQ ID NO: 2306 - DNA, 355 bp, Artificial Sequence
  Synthetic polynucleotide encoding artificial human antibody VH chain
caggtgcagctggtgcagcctgggggtgaggtgaagaagcctggggcctcagtgaagatttcctgcaaggcatctggatacaccttcaccagtcactatatgcactgggtacgacaggcccctggacaagggctagagtggatgggaatgatcgaccctagtggcggcagcagaacctacgcacagaagttccagggcagagtcaccatgaccagggacacgtccacgagcacagtctacatggagctgagcagcctgagatctgacgacacggccgtttattactgtgcgagagaggggagctactacgggattggctactggggccagggaaccctggtcaccgtctcctcag

SEQ ID NO: 2307 - DNA, 364 bp, Artificial Sequence
  Synthetic polynucleotide encoding artificial human antibody VH chain
gaggtgcaattggtggagtctgggggagtcgtggtgcagcctggggggtccctgagactctcctgtgcagcctctggattcaccttcagcgcctactggatgcactgggtccgccaagctccagggaaggggctggtgtgggtctcacgtattaatactgatgggagtagcacaagctacgcggactccgtgaagggccgattcaccatctccagagacaacgccaagaactcactgtatctgcaaatgaacagcctgagagccgaggacacggccgtgtattactgtgcgagagatacggacagtggctggttggattcgtttgactactggggccagggaaccctggtcaccgtctcctcag

SEQ ID NO: 2308 - DNA, 385 bp, Artificial Sequence
  Synthetic polynucleotide encoding artificial human antibody VH chain
cagggccaactggttcagtctggggctgaggtgaagaaggctggggcctcagtgaaggtctcctgcaaggtttccggatactccctcactgaaatctccatgcactgggtgcgacaggctcctggaaaagggcttgagtgggtgggaggttttgatcctgaaggtggtgaaacaatctacgcacagaagttccagggcagagtctccatgacctgggacacgtctatagaccttgcctacatggagctgagaagtctgagttctgacgacacggccctgtattactgtgcgacagatcaggggtgtgatgatggcagctgctatgtaggccactactacggaatggacgtctggggccaagggaccaaggtcaccgtctcttcag

SEQ ID NO: 2309 - DNA, 648 bp, Artificial Sequence
  Synthetic polynucleotide encoding artificial human antibody VH chain
cccctgcagctgcaggagtcgggcccaggactggtgaagccttcggagaccctgtccctcacctgcagtgtctctggtggctccatcaggagcagtgctcccttctggggctggatccgccagcccccagggaaggggctggagtggattggaaacatctattataatggagacacctcctacagcccgtccctcgagaatcgagtcaccttattcgtagacacgtccaagaaccagttctccctcaacctgacctctgtgaccgccgcggacacggccgtatattactgtgggaggattatgactccctcgattgacctctggggccagggaaagttggtcaccgtctcctcagcatccccgaccagccccaaggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaatgag

SEQ ID NO: 2310 - DNA, 656 bp, Artificial Sequence
  Synthetic polynucleotide encoding artificial human antibody VH chain
cccaggttcagctggtgcagtctggagctgaggtgaagaagcctggggcctcagtgaaggtctcctgcaaggcttctggttacatctttaccacctatgttatcagctgggtgcgacaggcccctggacaagggcttgagtggatgggatggatcagcgcttacactggtaacacaaactatccacagaaattccagggcagagtcaccatgaccacagacacagccacgagcacagcctacatggagctgaagagcctgagatctgacgacacggccgtgtattactgtgcgagagaaggacgggggggaggagacttctttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaatgtg

SEQ ID NO: 2311 - DNA, 660 bp, Artificial Sequence
  Synthetic polynucleotide encoding artificial human antibody VH chain
taagtgcagctggtggagtctgggggaggcttggtacagcctggcaggtccctgagactctcctgtgcagcctctggattcacgtttgatgattatgccatgcactgggtccggcaagctccagggaagggcctggagtgggtctcaggtattatttggaatagtggtacgacaggctatgcggactctgtgaagggccgattcaccatctccagagacaacgccaagaaatccctgtatctgcaaatgaacagtctgagaactgaggacacggccctgtattactgtgcaaaagatggggacagtttgggggatttctctacttttgatatctggggccatgggaccatggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaatgtg

SEQ ID NO: 2312 - DNA, 653 bp, Artificial Sequence
  Synthetic polynucleotide encoding artificial human antibody VH chain
gcgaggtgcagttggtggagtccgggggaggcttagttcagacgggggggtccctgagactctcctgttcagcctctggattcaccttcaataattactggatgcactgggtccgccaagctccgggaaaggggctgctgtggctctcgcgaataaatactgatggtagtcgaggacactacgacgactccgtgcagggccgatttaccatctccagagacaacgccaagcaaacggtctatctgcaaatggacgggctgagagccgaggacacggctgtctatttttgtgcaagagacggctatgactttcgggcttttgaccactggggccagggagtcctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaggtg

SEQ ID NO: 2313 - DNA, 674 bp, Artificial Sequence
  Synthetic polynucleotide encoding artificial human antibody VH chain
cccaggtgcagctgctggagtcgggcccaggagtggtgaagccttcggagaccctgtctctcacctgctctgtctccggtgactccgtcagtagtttctactggacgtggatccggcaacccccagggaagggaccggagtggattggtaatatttatcacagtggcagcaccaacttcaatccctccctcaagagtcgagtcaccatatcactcgacatgtccaagaaccagttctccctgcacctaaagtctgtgaccgctgcggacactgccgtctattactgtgcgcgagctcgcggtgggggtttttgtagtaatatggactgcccggcaatgtttgactactggggccggggaaccctggtcaccgtctccgcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagtgag

SEQ ID NO: 2314 - DNA, 364 bp, Artificial Sequence
  Synthetic polynucleotide encoding artificial human antibody VH chain
gaggtgcagttggtggagtccgggggaggctcggtaaagcctggggggtcccttagactctcctgtgtagccggtggatataattttaatgatgatcggatgagctcgatgaactgggtccgccaggctccagggaaggggctggagtgggttggccgtattaaaagtaaaagtgatggtgggtcaacaaactacgctgcacccgtgcaaggcagattcaccatctcaagagatgattcgaaaaacactctgtatctccaaatgaacagcctgaaaatcgaggacacagccgtgtattattgtaccacgattcatgactacggtgaccactggggccagggaaccctggtcaccgtctcctcag

SEQ ID NO: 2315 - DNA, 642 bp, Artificial Sequence
  Synthetic polynucleotide encoding artificial human antibody VH chain
gaggtgcaactggtggagtctgggggagccttggtccagcctggggggtccctgagaatttcctgtgcagcctctggattcaccgtcagtaccaactacatgagctgggtccgccaggctccagggaaggaactggagtggatctcagttatttatagcggtggtaccacatactacgcagcccccgtgaagggcagattcaccatctccagagacgattccaagaacacactgtatcttcaaatgaacagtctgagagtcgaggacacggctgtatatcactgtgcgaggggccttttacgatccctggacgtctggggccaagggaccacggtcaccgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccggctgtcctacagtcctcaggactctactccctcagcagcgtggtgaccgtgacctccagcaacttcggcacccagacctacacctgcaacgtagatcacaagcccagcaacaccaaggtggacaagacagtg

SEQ ID NO: 2316 - DNA, 677 bp, Artificial Sequence
  Synthetic polynucleotide encoding artificial human antibody VH chain
gtgaggtgcacctggtggagtctgggggaggcttcgtccagcctggagggtccctgagactctcctgtgcagcctctggattcacgttcagtgaccactacatggactgggtccgccaggctccagggaaggggctggagtgggttggccgtattaaaaacagagctaacagttacaacacagagtacgccgcgtctgtgagaggcagattcaccatctcaagagatgattcaaacaactcactgtttctgcaaatgaacagcctgacagccgaggacacggccgtatattactgtgctagagtgaaactgggggcatcgagccgtgtttttgatgtctggggccaagggacaatggtcaccgtctcttcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgccca

SEQ ID NO: 2317 - DNA, 361 bp, Artificial Sequence
  Synthetic polynucleotide encoding artificial human antibody VH chain
caggtccagctggtggagtctgggggaggcgtggtccagcctgggaggtccctgagactctcctgtgcagcctctggattcaccttccgtgattatggcatgcactgggtccgccaggccccaggccaggggctacagtgggtggcagttatatcttttgatggaagtgataaattctatgcagactccgtgaagggccggttcagcatctccagagacaattccagggacacggtgtatctgcaaatgaaccgcctaagacctgaagacacggctgtatattactgtgcgacaaccgttacacctaaggtgaccagttttgcttcctggggccagggaagcctggtcaccgtctccgcat

SEQ ID NO: 2318 - DNA, 664 bp, Artificial Sequence
  Synthetic polynucleotide encoding artificial human antibody VH chain
gtgtgaggtgcagctggtggagtcggggggaggcctggtcaagcccggggggtccctcagactctcctgtgcagcctctggattcgacatcaggagttataccatacactgggtccgccaggctccagggaaggggctggagtgggtctcatccattactgctggtggaagtttcataaactacgcagactcggtaaagggccgattcaccatctccagagacaacgcccagaactcactttttctgcaagtggaccgcctgagagccgaggacacggctctttatttttgtgcgagagaacagagccccctttatttcggtccatctttggacgtctggggccaagggacctcggtcatcgtctccttagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagtgag

SEQ ID NO: 2319 - DNA, 651 bp, Artificial Sequence
  Synthetic polynucleotide encoding artificial human antibody VH chain
caggtgcagctggtgcagtctggggctgaggtgaagaaccctggggcctcagtgaaggtctcctgcaaggcttctggatacaccttcaccgactactatatccactgggtgcgacaggcccctggacaagggcttgagtggatgggatggatcaaccctaatagtggtggcacaaatcatgcacagaagtttcagggcagggtcaccatgaccagggacatgtccatcaacacagcctacatggaggtgagcgggctgagatctgacgacacggccatctattactgtgcgagagagccttactcctcctacgctatggacgtctggggccaagggaccacggtcaccgtctcctcagcctccaccaagggcccatcggtcttccccctggcaccctcctccaagagcacctctgggggcacagcagccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaggtg

SEQ ID NO: 2320 - DNA, 655 bp, Artificial Sequence
  Synthetic polynucleotide encoding artificial human antibody VH chain
gtgtgaggtgcagctgttggagtcggggggaggcttggtacagcctggggggtccctgagactctcctgtgcagcctctggattcacctttagcaactatgccatgagttgggtccgccaggctccagggaaggggctgaagtgggtctcaagtattagttatagtggtggtagcacatactacgcagactccgtgaagggccgggtcaccatctccagagacaattccaagaacacgctgtatctgcaaatgaacagcctgagagccgaggacacggccgtatattactgtgcgaaagatggatccgagatgttattgtgtgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagatagtg

SEQ ID NO: 2321 - DNA, 653 bp, Artificial Sequence
  Synthetic polynucleotide encoding artificial human antibody VH chain
agtgtgatgtgcatctggtgcagtctgggggaggcctggtcaagccgggggggtccctgagactctcctgtgcagcctctggattcaacttcaattcttatacaatgacctgggtccgccaggctccagggaaggggctgcagtgggtctcatccattagtagtagtggtggtgacatcaactacgctgactcactgaagggccggttctccatctccagagacaacgccaagaactcagtctttttgcaactgaacagcctgagagccgaggacacggctgtctattactgtgcgagagacactaggtggcgagggttggacagctggggccagggaatcctggtcaccgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccggctgtcctacagtcctcaggactctactccctcagcagcgtggtgaccgtgacctccagcaacttcggcacccagacctacacctgcaacgtagatcacaagcccagcaacaccaaggtggacaagacagtg

SEQ ID NO: 2322 - DNA, 666 bp, Artificial Sequence
  Synthetic polynucleotide encoding artificial human antibody VH chain
ggagtgcagctggtggagtctgggggagacttggtacagcccggcaggtccctgagactctcctgtgcagcctctggattcacatttgatgattatgccatgcactgggtccggcaatctccagggaagggcctggagtgggtctcaagtattagttggaatagtggtgacatagcatatggggactctgtgaaggggcgattcaccgtctccagagacaacgccaagaactccctgcatctgcaactgaacagtctgagagttgaggactcggccctctattactgtgcaaaagatctgttagcagtgcctggcctacttgacgactggggccagggaaccctggtcaccgtctccacagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgccca

SEQ ID NO: 2323 - DNA, 639 bp, Artificial Sequence
  Synthetic polynucleotide encoding artificial human antibody VH chain
caggtgctactggtgcagtctggggctgaggtgaagaagcctgggtcctcggtgaaggtctcctgcaaggcttctggaggcaccttcagcagctatggtatcagctgggtgcgacaggcccctggacaagggcttgagtggatgggagggatggcaaactacgcacagaagttccagggcagagtcacgattagcggggacgaatcaacgagcacagcctacatggagctgagcaacctgacatctgaggacacggccgtgtattactgtgcgagtcggggtggatcttctcgccggtacggtatgggcgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagtg

SEQ ID NO: 2324 - DNA, 667 bp, Artificial Sequence
  Synthetic polynucleotide encoding artificial human antibody VH chain
gtgtgaggtgcagttgttggagtctgggggagccttggtacagccgggggggtccctgagactctcctgtgcagtctctggattaacctttaacagatttgccatgacctgggtccgccaggctccagggaaggggctggagtgggtctcacacattggtggtagtggtggttacacatactacgcagactccgtgaagggccggttcaccatctctagagacaattccaagaacacgttgtatctgcaaatgaacagcctgcgagccgaggacacggccgtatatcactgtgtgaaattgaagggcattggcgctatgtggacgtacgctatggacgtctggggccaagggaccacggtcaccgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccggctgtcctacagtcctcaggactctactccctcagcagcgtggtgaccgtgacctccagcaacttcggcacccagacctacacctgcaacgtagatcacaagcccagcaacaccaaggtggacaagacagtg

SEQ ID NO: 2325 - DNA, 681 bp, Artificial Sequence
  Synthetic polynucleotide encoding artificial human antibody VH chain
cagctgcagctgcaggagtcgggcccaggactggtgaagccttcggacaccctgtccctcacctgcactgtctcgggctactccattagcactgcttactactggggctggatccgacagcccccagggaagggactggaatggattgggagtatctttcacagtgggagcgcctactacaatccgtccctcgacggtcgagtcagcctttcagtggacacgtccaagaaccagttctccctgaggctgaagtctgttaccgccgcagacacggccgtttattactgtgcgagagatcagggctacggtgattacgactatcccagagactggatcgaaccctggggccaaggaaccctggtcaccgtctcttcagcatccccgaccagccccaaggtcttcccgctgagcctcgacagcaccccccaagatgggaacgtggtcgtcgcatgcctggtccagggcttcttcccccaggagccactcagtgtgacctggagcgaaagcggacagaacgtgaccgccagaaacttcccacctagccaggatgcctccggggacctgtacaccacgagcagccagctgaccctgccggccacacagtgcccagacggcaagtccgtgacatgccacgtgaagcactacacgaatcccagccaggatgtgactgtgccctgccca

SEQ ID NO: 2326 - DNA, 370 bp, Artificial Sequence
  Synthetic polynucleotide encoding artificial human antibody VH chain
caggtgcagctggtgcagtctggggctgaggtgaagaagcctgggtcctcggtgaaggtctcctgcaaggcttctggaggcaacgtcagaagttatagcatcagctgggtgcgacaggcccccggacaagggcttgagtggatgggagggatgatcaccacttttggaaaagcggactacgcactgaagttccgtgacagagtcacaataaccgcggacagatccacgaacacagtctacatggaactgagcagcctcacatcacaggacacggccgtctattactgtgcgagcgtccgagacctcgtcagtggcaccacttactactatcactactggggccagggaaccctgatctccgtctcctcag

SEQ ID NO: 2327 - DNA, 644 bp, Artificial Sequence
  Synthetic polynucleotide encoding artificial human antibody VH chain
cccaggtgcagctgcaggagtcgggcccaggactggtgaagccttcggagaccctgtccctcacctgcactgtctctggtgactccatcagtagtaactactggagctggatccggcagcccccagggaagggactggagtggattgggtatatctattacagtgggagcaccaactacaacccctccctcaagagtcgagtcaccatatcagtagacacgtccaagaaccagttctccgtgaagctgagctctgtgaccgctgcggacacggccgtgtattactgtgcgagatacggtgactactcctttgacccctggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagtgag

SEQ ID NO: 2328 - DNA, 656 bp, Artificial Sequence
  Synthetic polynucleotide encoding artificial human antibody VH chain
cccaggttcagttggtgcagtctggagctgaggtgaagaagcctggggcctcagtgaaggtctcctgcaaggcttttggttacaggttttccaactttgggatcagttgggtgcgacaggcccctggacaagggcttgagtggatgggatggatcagcgcttacaatgggaacacaaactatgcacagaagctccagggcagagtcaccatgaccacagacacatccacgagcacagcctacatggagctgaggagcctgagatctgacgacacggccgtgtattactgtgcgagagtcgtagacacagttttggcagactttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagtgag

SEQ ID NO: 2329 - DNA, 657 bp, Artificial Sequence
  Synthetic polynucleotide encoding artificial human antibody VH chain
caggtgcacctggtgcaatctgggtctgaatttaagaagcctggggcctcagtgaagatttcctgcaagacttctggatacacgttcactaattatgctatgaattgggtgcggcaggcccctggacaaggacttgaatgggtgggatggatcaacaccgtcactgggatcccaggttatgcccagggcttcacaggacgctttatcatctccttggacacctctggccgcacgtcttatctgcagatcaacagcctacaggctgaggacactgccgtatattactgtgcgcgatcagggggctttggctggtcaagggaccttgactactggggccagggaaccctggtcaccgtctcctctgcctccaccaagggcccatcggtcttccccctggcgccctgctccaggagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacacctgcaacgtgaatcacaagcccagcaacaccaaggtggacaagagagtt

SEQ ID NO: 2330 - DNA, 669 bp, Artificial Sequence
  Synthetic polynucleotide encoding artificial human antibody VH chain
ccgcagctgcagctgcaggagtcgggcccaggactggtgaagccttcggagaccctgtccctcacctgcagtgtctctggtgactccatcagcagcagtagctacttctggggctggatccgccagccccccgggaaggggctggagtggattgggagtgtctattatagtgggagcacctactacaagccgtccctcaagagtcgactcaccatatccgtagacacgtccaagaagcagttctccctgaatctgagctctatgaccgccgcagacacggctgtttattactgtgcgagacatggattttggagtggccccatacccgacgcttttgatatctggggccaagggacaatggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaatgag

SEQ ID NO: 2331 - DNA, 651 bp, Artificial Sequence
  Synthetic polynucleotide encoding artificial human antibody VH chain
caggtgcagctggtggagtctgggggaggcgtggtccaccctgggaggtccctgagactctcctgtgcagcctctggattcaccttcagtaactatggcatgcactggctccggcaggctccaggcaaggggctggagtgggtggcaattatagcctatgatggaagtcagaaaaagtatgcagactccgtgaagggccgattcaccatttccagagacaattccaaggacacgatgtatctgcaaatgaacaacctgagaactgaggacacggctgtgtattactgtgcgcacgaagactatggttcggggaatggtaattactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagtgag

SEQ ID NO: 2332 - DNA, 660 bp, Artificial Sequence
  Synthetic polynucleotide encoding artificial human antibody VH chain
cccgtgcacctggtgcagtctggggctgaggtgaggaagcctgggtcctcggtgaaggtctcctgcatggcctctggaggctccttcaacacctatgcagtcaactgggtgcgacaggcccccggacaggggcttgagtggatgggagggatcatccctgtttttggaacaacaaactacgcaccgaggttccagggcagagtcaccattaccgcggacgaatccacgagcacagtctacatggaactgaccagcctgacatctgaggacacggccgtgtattactgtgcgagagaccgcgacagtggctacgagaggaattgtctcgacccctggggccagggaaccctggtcaccgtctcctccgcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagtg

SEQ ID NO: 2333 - DNA, 695 bp, Artificial Sequence
  Synthetic polynucleotide encoding artificial human antibody VH chain
cccaggtccaacttatgcagtctggggctgaggtgaagcagcctggggcctcagtgaaggtttcctgcaaggcttctggagacaccttcacctcttttgccatccattgggtgcgccaggtctccggacaagggcttgagtggatgggatggatcaacgctggcaatggtgacacgaaatattcacagaagatccagggcagaatcaccataaccagggacacatccgcgagaacagcctacatggagttgagcagcctgagatctgaagacacggctgtgtattattgtgcgaggggggccccttatggttcgcgaatttattatgattacgactcctaccatggtatggacgtctggggccaagggaccacggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccg

SEQ ID NO: 2334 - DNA, 666 bp, Artificial Sequence
  Synthetic polynucleotide encoding artificial human antibody VH chain
caggtgcacctgcaggagtcgggcccaggactggtgaagccttcacagaccctgtccctcacctgcactgtctctggtgactccatcagtaacggtgattattgctggaactggatccgccagcgcccagggaagggcctggagtggattgggtacatctatcatagtgggagcacctacgagaacccgtccctcaggagtcgagttaccatgtcagtagacacgtctaagaaccagttctccatggagttgacctctgtgactgccgcggacacggccgtgtattactgtgcgagaggaaagtttgactggttccctcgtgtgtcctcctttgactactggggccggggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagtgag

SEQ ID NO: 2335 - DNA, 666 bp, Artificial Sequence
  Synthetic polynucleotide encoding artificial human antibody VH chain
gtggtgcaactggtggagtctgggggagactgggtccagcctggggggtccctgagactctcctgcgcagcctctggattcacctttagaagctattggatgagttgggtccgccaggctccagggaaggggctggagtgggtggccagtgtagagggataccgaagtgaagaatactacgtggactctgtgaagggccgattcaccatctccagagacaacgccaagaattcagtgtatctgcagatgaacagcctaagagccgaggacacggctgtttattactgtgcggccgcctattatattgatactagcggctttgactactggggccagggaacccaggtcactgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgccca

SEQ ID NO: 2336 - DNA, 673 bp, Artificial Sequence
  Synthetic polynucleotide encoding artificial human antibody VH chain
gtgtgaggtgcaactgttggagtctgggggaaagttggtacagcctggggggtccctgagactctcctgtgcagcctctggattcacctacgacagttatgtcatgaactgggtccgccaggctccagggaaggggctggagtgggtctcaggtattagtgccagtggcggtggcacctactacgcagactccgtgaagggccggttcaccatctccagagacaattccaagaacacgctgtacctggaaatgaacagcctgagagccgacgacacggccgtatattactgtgcgaaaggacggacgtatagcaataactggttatttcactggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaatgag

SEQ ID NO: 2337 - DNA, 657 bp, Artificial Sequence
  Synthetic polynucleotide encoding artificial human antibody VH chain
cccgtgcagctgcaggagtcgggcccaggactggtgaagccttcggagaccctgtccctcacttgcactgtctctagtggctccgtcagcagtggtagtcactactggagctggatccggcagcccccagggaagggactggagtggattgggtatatctattacagtgggacctccaactacaacccctccctcaagggtcgagtcgccatatcagtagacacgtccaagaaccagttctccctgaagctgagctctgtgaccgctgcggacacggccatatattactgtgcgagagtttttagtacgatatttcatggggtcgacccctggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagtg

SEQ ID NO: 2338 - DNA, 672 bp, Artificial Sequence
  Synthetic polynucleotide encoding artificial human antibody VH chain
caggtgcagctggtgcagtctggggctgaagtgaagaagcctggggcctcagtaaaggtctcctgcagggcttcaggatacagcttcaccggctattatatacactgggtgcgacaggcccctggacaagggcttgagtggatgggatggatcaaccctaaaactggtgacacacactatgcacagaactttcagggctgggtcaccatgaccagggacacgtccatcagtaccgcctacatggagttgaccattttgagatctgacgacacggccgtgtattactgtgcgagacacttaagcagtggcgaataccactacggtttggacgtctggggccaagggaccacggtcactgcctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgccca

SEQ ID NO: 2339 - DNA, 654 bp, Artificial Sequence
  Synthetic polynucleotide encoding artificial human antibody VH chain
taggtgcagctggtggagtctgggggaggcgtggtccagcctgggaggtccctgagactctcctgtgcagcccctggattcaccttcagtaactatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtctattactgtgcgaaaggaaagggtatagtgggagccacctttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaatgtg

SEQ ID NO: 2340 - DNA, 673 bp, Artificial Sequence
  Synthetic polynucleotide encoding artificial human antibody VH chain
gtgtgaggtgcagctggtggagtctgggggaggcctggtcaagcctggggggtccctgagactctcctgtgcagcctctggattcaccttcagtaactataacatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagagatgcgctagattttgactggttattgtcagccgggggctttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaggtg

SEQ ID NO: 2341 - DNA, 651 bp, Artificial Sequence
  Synthetic polynucleotide encoding artificial human antibody VH chain
cccctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattcctgtgcgagactacttgtggggggtgcttttgatatctggggccaagggacaatggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagtgag

SEQ ID NO: 2342 - DNA, 679 bp, Artificial Sequence
  Synthetic polynucleotide encoding artificial human antibody VH chain
gtgtgaggtgcagctggtggagtctgggggaggcttggtaaagcctggggggtcccttagactctcctgtgcagcctctggtttcactttcagtaacgcctggatgaactgggtccgccaggctccagggaaggggctggagtgggtcggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccccaggatcttgtagtggtggtagctgctactccggcgatgcttttgatatctggggccaagggacaatggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcatggtgaccgtgccctccagcagcttgggcacccagacctacatctgcaacgtgaatcacaagcccagcaacaccaaggtggacaagagtgag

SEQ ID NO: 2343 - DNA, 660 bp, Artificial Sequence
  Synthetic polynucleotide encoding artificial human antibody VH chain
caggtgcacctggtgcagtctggggctgaggtgaagaagcctggggcctcagtgaaagtttcctgtaaggcatctggatacaccttcaccaactactttatccactgggtgcgacaggcccctggacaggggcctgagtggatgggagtaatcaaccctagttttggaagcacaacctacgcacagaagttgcagggcagagtcaccatgaccagggagacgtccacgagcactgtctacatggaactgagcagcctgagatctgaggacacggccgtctattactgtgcgagagagtcccttgatagtgcctcatatagtaccatcgcacattggggccagggaaccctggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagtgag

SEQ ID NO: 2344 - DNA, 660 bp, Artificial Sequence
  Synthetic polynucleotide encoding artificial human antibody VH chain
caggtgcagctggtgcagtctggggctgaggtgaagaaacctgggtcctcggtgaaggtctcctgcaaggcccctggaggcaccttcaacaactatggtatcagctgggtgcgacaggcccctggacaagggcttgagtggatgggagggatcatgcctatgtttggaagaacaagcgagacacagaagttccagggcagagtcaccattagcgcggacgaatctacgagcacagtgtacatggagatgagtagcctcagatttgacgacacggccgtatattactgtgcgagagatcgaggaggcaacagctggcttgatgtttttgatatgtggggccaagggacaatggtcaccgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcaacttcggcacccagacctacacctgcaacgtagatcacaagcccagcaacaccaaggtggacaagacagtt

SEQ ID NO: 2345 - DNA, 672 bp, Artificial Sequence
  Synthetic polynucleotide encoding artificial human antibody VH chain
gaggtacaattgctggagtctgggggaggcttggtacatcctggagggtccctgagactgtcctgtgtggcctctggattcaccttcagtagttatgagatgacctgggtccgccaggctccagggaaggggctggagtggatctcctatatcagcagtactggaaccaccacataccacgcagactctgtgaggggccgattcaccatctccagagacaacgccaagagctcactgtttttgcagatgaacagcctgcgagtcgaagacacggctctgtattactgtgcgagatcccccgccgcctttggctcagagagttactttgactcctggggtcagggagtcctggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgccca

SEQ ID NO: 2346 - DNA, 666 bp, Artificial Sequence
  Synthetic polynucleotide encoding artificial human antibody VH chain
caggtgcagttggtggaatctgggggaggcgtggtccagcctgggaggtccctgagactctcctgtgcagcctctggattcaccttcacgacctatgctgtgcactgggtccgccaggctccaggcaaggggctggagtgggtggcagttatatcaaatgacggaagtaataaaaactacgcagactccgtgaggggccgattcatcatctccagagacaattccaagaacactctgtatctccaaatgaacagcctgagagctgaggacacggctgtgtattactgtgcgaaagatcttctagaggacccatacttcggggacttattgtttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaatgtg

SEQ ID NO: 2347 - DNA, 671 bp, Artificial Sequence
  Synthetic polynucleotide encoding artificial human antibody VH chain
ccgaggtgcagctggtgcagtctggagcagaggtgaaaaagtccggggagtctctgaagatctcctgtaagggttctggatacacctttaccagctactggatcgcctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgtgaggacccccgctgttggcaccgaccctgactactggggccagggaaccctggtcaccgtctcctcagggagtgcatccgccccaacccttttccccctcgtctcctgtgagaattccccgtcggatacgagcagcgtggccgttggctgcctcgcacaggacttccttcccgactccatcactttctcctggaaatacaagaacaactctgacatcagcagcacccggggcttcccatcagtcctgagagggggcaagtacgcagccacctcacaggtgctgctgccttccaaggacgtcatgcagggcacagacgaacacgtggtgtgcaaagtccagcaccccaacggcaacaaagaaaagaacgtgcctcttccg

SEQ ID NO: 2348 - DNA, 651 bp, Artificial Sequence
  Synthetic polynucleotide encoding artificial human antibody VH chain
gaggtccagttgatggaatctgggggaggtttggtacagccgggggggtccctgagactctcctgtgcagcctctggactcaccttcagcatttatagcatgaattgggtccgccaggccccagggaaggggctggagtgggtttcatatattagtcgggggagcagtgtgatataccacgcagactctgtgaagggccgattcaccatctccagagacgacggcaagaacctactgtatctgcaaatgaacagcctgagagacgacgacacggctatgtattactgttcgagtggggggtccacatcgatggttgggagatactggggccagggatccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagtg

SEQ ID NO: 2349 - DNA, 662 bp, Artificial Sequence
  Synthetic polynucleotide encoding artificial human antibody VH chain
cccaggtcaccttgaaggagtctggtcctgtgctggtgaaacccacagagaccctcacgctgacctgcaccgtctctgggttctcactcagcaatgctagaatgggtgtgagctggatccgtcagcccccagggaaggccctggagtggcttggacacattttttcgaatgacgaaaaatcctacagcacatctctgaagagcaggctcaccatctccaaggacacctccaaaagccaggtggtccttaccttgaccaacatggaccctgtggacacagccacatattactgtgcacggatgaccccattcaagtttggactatgccctgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaggtg

SEQ ID NO: 2350 - DNA, 659 bp, Artificial Sequence
  Synthetic polynucleotide encoding artificial human antibody VH chain
cccaggtgcagctggtgcagtctggggctgaggtgaagaagcctggggcctcagtgaaggtctcctgcaaggcttctggatacaccttcaccgtctactatatgcactgggtgcgacaggcccctggacaagggcttgagtggatgggacggatcaaccctaacagtggtggcacaaactatgcacagaagtttcagggcagggtcaccatgaccagggacacgtccatcagcacagcctacatggaactgagcaggctgacatctgacgacacggccgtgtattactgtgcgagagtagtggtggtaggtacagactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagtgag

SEQ ID NO: 2351 - DNA, 659 bp, Artificial Sequence
  Synthetic polynucleotide encoding artificial human antibody VH chain
cccaggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgacatctgacgacacggccgtgtattactgtgcgagagatcaaggactggagagggctaactggttcgacccctggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagtg

SEQ ID NO: 2352 - DNA, 651 bp, Artificial Sequence
  Synthetic polynucleotide encoding artificial human antibody VH chain
caggtacacctgcaggagtcaggtccaggactggtgaagccctcgcggaccctctcactcacctgtgccatctccggggacagtgtctctagcaccagtgctgcttggaactggatcaggcagtccccatcgggaggccttgagtggctgggaaggacattctacaggaccaagtggtatagtgaatctacaggctctctgaaaagtcgaataatcgtcaacccagacacatccaagaaccagttctccctacagctgaattctgtgactcccgaagacacggctgtctattactgtgcaagaggtgtccgccactttgactactggggccagggcaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagtg

SEQ ID NO: 2353 - DNA, 653 bp, Artificial Sequence
  Synthetic polynucleotide encoding artificial human antibody VH chain
cccaggtgcagctgcaggagtcgggcccaggactggtgaagccttcggggaccctgtccctcacctgcgcagtctctggtggctccatcagcagtagtaactgctggagttgggtccgccagccccccgggaaggggctggagtggcttggggaaatctgtcatagtgggagcaccagctacaacccgtccctcaagagtcgagtcaccatatcagtcgacaagtctaagaaccagttctccctgaaactgcgctctgtgaccgccgcggacacggccgtgtattactgtgcgagagagtcacctttaactgtcgtctttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagtg

SEQ ID NO: 2354 - DNA, 645 bp, Artificial Sequence
  Synthetic polynucleotide encoding artificial human antibody VH chain
gaggtgcagctggtggagtctgggggaggcttggtccagcctggggggtccctgagactctcctgtgcagcctctgggttcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtctcttcaaatgaacagcctgagagccgaggacacggccgtgtattactgtgcgagggaatcctcagcagctggttatgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagtgtg

SEQ ID NO: 2355 - DNA, 665 bp, Artificial Sequence
  Synthetic polynucleotide encoding artificial human antibody VH chain
cccaggtgcagttggtgcagtcgggggctgaggtgaggaagcctggggcctcagtgaaggtttcctgcaaggcatctggatacaccttcaccacctactacatacactgggtgcgacaggcccctggacaagggcttgagtggatggggttaatcaaccctaatggtggtactactaactacgcacagaagttccagggcagactcagcatgaccacggacacgtccaccaacacagtctacatggagctgagtagcctgagatctgaagacacggccgtgtattactgtgcgagaaagcttatgtctggcatagtgtctcggggctggttcgacccctggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagtgtg

SEQ ID NO: 2356 - DNA, 660 bp, Artificial Sequence
  Synthetic polynucleotide encoding artificial human antibody VH chain
cccgtgcagctgcaggagtcgggcccaggactggtgaagccttcggagaccctgtccctcacctgcactgtctctggtggctccgtcagcagtggtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagagatcgcggtgactacgttacccactggttcgacccctggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagtgag

SEQ ID NO: 2357 - DNA, 657 bp, Artificial Sequence
  Synthetic polynucleotide encoding artificial human antibody VH chain
cagctgcagctgcaggagtcgggcccaggactggtgaagccttgggagaccctgtccctcagttgcactgtctctggtggctccatcagcagtagtttcttctactggggctggatccgccagcccccagggaaggggctgcagtggattgggaatatccattatactgggagcacctactacaacccgtccctcaagagtcgaatcaccatgtccgtagacacgtccaagaaccagttctccctgaagctgagctctgtgaccgccgcagacacggctgtgtattactgtgcgagacatagggttggcgacagcccgggactccactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagtgag

SEQ ID NO: 2358 - DNA, 651 bp, Artificial Sequence
  Synthetic polynucleotide encoding artificial human antibody VH chain
caggtgcagctggtggagtctgggggaggcgtggtccagcctgggaggtccctgagactctcctgtgcagcctctggattcaccttcagtagctatgctatgcactgggtccgccaggctccaggcaaggggctagagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagccctatagcagtggctgccccctttgcctactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagtgag

SEQ ID NO: 2359 - DNA, 688 bp, Artificial Sequence
  Synthetic polynucleotide encoding artificial human antibody VH chain
gtgtgaggtgcaactgttggagtctgggggaggcttggtacagcctggggggtccctgagactctcctgtgcagcctctggattcacctttagcacctatgtcatgagctgggtccgccaggctccagggaaggggctggagtgggtctcattaattagtggcagtggtggtagcacacactacgcagactccgtgaggggccggttcaccatctccagagacaattccaagaatacgctgtatctgcaaatgaacagtctgagagccgaggacacggccgtatattactgtgtgaaggattatcttgctgttggtgggacctactacgactactttgactactggggccagggaaccctggtcaccgtctcctcagggagtgcatccgccccaacccttttccccctcgtctcctgtgagaattccccgtcggatacgagcagcgtggccgttggctgcctcgcacaggacttccttcccgactccatcactttctcctggaaatacaagaacaactctgacatcagcagcacccggggcttcccatcagtcctgagagggggcaagtacgcagccacctcacaggtgctgctgccttccaaggacgtcatgcagggcacagacgaacacgtggtgtgcaaagtccagcaccccaacggcaacaaagaaaagaacgtgcctcttccg

SEQ ID NO: 2360 - DNA, 651 bp, Artificial Sequence
  Synthetic polynucleotide encoding artificial human antibody VH chain
cccctgcagctgcaggagtcgggcccaggactggtgaagccttcggagaccctgtccctcacctgcactgtctctggtggctccatcagcagtagtagttactactggggctggatccgccagtccccagggaaggggctggagtggatggggagtatctattatagtgggagcacctactacaacccgtccctcaagagtcgagtcaccatatccgtagacacgtccaagaaccagttctccctgaacctgagctctgtgaccgccgcagacacggctgtgtattactgtgcgagacatgactaccgtaactactttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagtgag

SEQ ID NO: 2361 - DNA, 662 bp, Artificial Sequence
  Synthetic polynucleotide encoding artificial human antibody VH chain
cccaggtgcagctggtgcagtctggggctgaggtgaagaagcctggggcctcagtgaaggtctcctgccaggcttctggatacaccttcaccggctactatatacactgggtgcgacaggcccctggacaagggcttgagtggatgggatggatcaaccctaacagtggtggcacaaactatgcacagaagtttcagggcagggtcaccatgaccagggacacgtccatcagcacagcccacatggagctgggcaggctgagatctgacgacacggccgtgtattactgtgcgaccccaccgtctcgatatggtggaaactactacgcagactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaggtg

SEQ ID NO: 2362 - DNA, 648 bp, Artificial Sequence
  Synthetic polynucleotide encoding artificial human antibody VH chain
ccggtgcagctggtgcagtctggagcagaggtgaaaaagcccggggactctctgagcatctcctgtgaggtttctggatacagctttaccagctactggattggctgggtgcgccagatgcccgggaaaggcctggagtggatggcgatcatcaatcctgctgactctgataccagatacagtccgtccttccgaggccaggtcaccatctcagtcgacaagtccatcaacaccgcctacctgcagtggaccagcctgcaggcctcggacaccgccatgtattactgtgcgagacaagggccgacagtagcgattgacttctggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagtgag

SEQ ID NO: 2363 - DNA, 349 bp, Artificial Sequence
  Synthetic polynucleotide encoding artificial human antibody VH chain
gaggtgcagctggtgcagtctggagcagaggtgaaaaagcccggggagtctctgaagatctcctgtaagggttctggatacagctttaccacctactggatcgcctgggtgcgccagatgcccgggaaaggcctggagtggatggggatcatctatcctgctgactctgataccagatacagcccgtccttccaaggccaggtcaccatgtcagccgaccagtccatcaataccgcctacctgcagtggagcagcctgaaggcctcggacaccgccatgtattactgtgcgagacggggtagagagtttgattactggggccagggaaccctgctcaccgtctcctcag

SEQ ID NO: 2364 - DNA, 670 bp, Artificial Sequence
  Synthetic polynucleotide encoding artificial human antibody VH chain
gtgtgaggtgcagctgttggagtctgggggaggcttggtgcagcctggggggtccctgagactctcctgtgcagcctctggattcacctttagaatctatgccatgagctgggtccgccaggctccagggaaggggctggagtgggtctcagctatcagttatagtggtaataccacatactacgcagactccgtgaagggccgtttcaccatctccagagacaattccaagaacacgctgtatctgcaaatcaacaacctaagagccgaggacacggccatatattactgtgcgatccaggaaaaacgggaactgcaactacgtcgagaactagataactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagtg

SEQ ID NO: 2365 - DNA, 351 bp, Artificial Sequence
  Synthetic polynucleotide encoding artificial human antibody VH chain
caggtgcagctggtgcagtctggggctgaggtgaagaagcctggggcctcagtgaaggtttcctgcaaggcatctggatacaccttcaccagctactatatgtactgggtgcgacaggcccctggacaagggcttgagtggatgggaataatcaaccctggtggtggtagcacaagctacgcacagaagttccagggcagagtcaccatgaccagggacacgtccacgagcacagtctacatggagctgagcagcctgagatctgaggacacggccgtgtattactgtgcgagagtatttcgatacggtatggacgtctggggccaagggaccacggtcaccgtctcctca

SEQ ID NO: 2366 - DNA, 352 bp, Artificial Sequence
  Synthetic polynucleotide encoding artificial human antibody VH chain
caggtgcaggtggtggaatctgggggaggcttggtcaagcctggagggtccctgagactctcctgtgcagtctctggattagacttcagggactactatgtaaactggatccgtcaggctccggggaaggggctggagtggctttcctacattactagtcctggtggtcacacaagctactcagactctgtgaagggccgattcaccatctccagagacaacgccaagaattcagtgtatctccaaatggacagcctgacagtcgaggacacggccgtatatttctgtgcgatcaaagaaggctacggtctttcagactggggccagggaaccctggtcaccgtctcgtcag

SEQ ID NO: 2367 - DNA, 669 bp, Artificial Sequence
  Synthetic polynucleotide encoding artificial human antibody VH chain
gtggtgcagctgttggagtctgggggaggcttggtacagcctggggggtccctgagactctcctgtgcagcctctggattcacctttatcagttatgccatgagctgggtccgccaggctccagggaaggggctggagtgggtctcagatattagtggcagtggtggtagcacatactacgcagactccgtgaagggccggctcaccatctccagagacaattccaacaacacgctgtatttgcaaatgaacagcctgagagccgaggacacggccgtatattactgtgcgaaagaggatggctacactcaaaattttgactactggggccagggaaccctggtcaccgtctcctcagggagtgcatccgccccaacccttttccccctcgtctcctgtgagaattccccgtcggatacgagcagcgtggccgttggctgcctcgcacaggacttccttcccgactccatcactttctcctggaaatacaagaacaactctgacatcagcagcacccggggcttcccatcagtcctgagagggggcaagtacgcagccacctcacaggtgctgctgccttccaaggacgtcatgcagggcacagacgaacacgtggtgtgcaaagtccagcaccccaacggcaacaaagaaaagaacgtgcctcttcca

SEQ ID NO: 2368 - DNA, 364 bp, Artificial Sequence
  Synthetic polynucleotide encoding artificial human antibody VH chain
caggtccaacttgtgcagtctggggccgaggtgaagaagccaggggcctcagtgaagatttcctgcaaggcctctggatacaccttcactagtcatgccatacactgggtgcgccaggcccccggacaaacttttgagtggctgggctggatcaaccctgtcaatggggtcacaaaatattcacagacgtttcaggacagagtcaccattgtgagggacaagtccgcgaccacaacctacatggacctgagcgggctgacatttgaagacacggctatgtattattgtgcgagagttctggacttttatggaagtagtgtcctagactactggggccagggaaccctggtcactgtctcctcag

SEQ ID NO: 2369 - DNA, 346 bp, Artificial Sequence
  Synthetic polynucleotide encoding artificial human antibody VH chain
cacgtgcagctggtgcaatctgggtctgagttgaagaagcctggggcctcagtgaaactttcctgcaaggcttctggatacaccttcactaactatgctatgaattgggtgcgacaggcccctggacaagggcttgagtggatggggtggatcaacaccaacactgggaacccaacgtatgcccagggcttcacaggacggtttgtcttctccttggacacctctgtcagcacggcatatctgcagatcagcagcctaaaggctgaggacactgccctgtattactgtgcgagagatcggcccggggactactggggccagggaaccctggtcaccgtctcctcag

SEQ ID NO: 2370 - DNA, 648 bp, Artificial Sequence
  Synthetic polynucleotide encoding artificial human antibody VH chain
caggtgcagctggtggagtctgggggaggcgtggtccagcctgggaggtccctgagactctcctgtgcagcctctggattcaccttcagtaactttgctatgcactgggtccgccaggctccaggcaaggggttggagtgggtggtggttatttcatctgatggaagcaataaaaactacgcagactccgtgaagggccgattcaccatctccagagacaattccaagaacacgctgtatctgcaaatgaacagcctgagagctgaggacacggctgtgtattactgtgcgagagatcttggtgtgggatctactacctactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagtc

SEQ ID NO: 2371 - DNA, 657 bp, Artificial Sequence
  Synthetic polynucleotide encoding artificial human antibody VH chain
ggggagcagctgttggagtctgggggaggcttggttcagccgggggggtccctgagactctcctgtgcagcctctggattcaccttcagtcactacgccatgacctgggtccgccaggctccagggaaggggctcgaatgggtctcaggtgttagtggaagtggttttaccacttattacgcagactccgttaagggccggttcaccatctcccgagacaatgcccagaacacactgtatctgcacatgaacagcctgagagccgaggacacggccatatattactgtgtgaaagatttggaggtttctataggtcacaattttgacttttggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagtc

SEQ ID NO: 2372 - DNA, 675 bp, Artificial Sequence
  Synthetic polynucleotide encoding artificial human antibody VH chain
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagagataggggggtagtggtggtagctgctaccccttactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagtc

SEQ ID NO: 2373 - DNA, 669 bp, Artificial Sequence
  Synthetic polynucleotide encoding artificial human antibody VH chain
cagatcaccttgaaggagtctggtcctacgctggtgaaacccacacagaccctcactctgacctgcaccttctctgggttctcactcagtactaatggagtgggtgtgggctggatccgtcagcccccaggaaaggccctggagtggcttgcactcattaattgggatgatgataagcgctacagtccatctctgaagagcaggctcaccatcactaaggacacctccaaaaaccaggttgtccttacaatgaccaacctggaccctgtagacacagccacatattactgtgtacacgcacgagatgactacggtgactccgcttggtcaactgggcctgtctggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagtt

SEQ ID NO: 2374 - DNA, 669 bp, Artificial Sequence
  Synthetic polynucleotide encoding artificial human antibody VH chain
ctgatcaccttgaaggagtctggtcctacgctggtgaaacccacacagaccctcacgctgacctgcaccgtctctgggttgtcactcagcactagtggagtggctgtgggctggatccgtcagcccccaggaaaggccctggagtggcttgcactcatttattgggatgatgatacgcggtacagcccatctctgaagagcaggctcagcatcaccaaggacacctccaaaaaccaggtggtccttacaatgagaaacgtggaccctgtggacacagccacatattactgtggacacagacgtctgttaaggggggttactactactgtctatttcgacccctggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagtc

SEQ ID NO: 2375 - DNA, 669 bp, Artificial Sequence
  Synthetic polynucleotide encoding artificial human antibody VH chain
ccggtgcagctgcaggagtcgggcccaggacttgtgaacccttcacagaccctgtccctcacctgcactgtctctggtggctccatcagcagcggtggttactgctggagctgggtccgccagcacccagggaagggcctggaatggattgggtgcatctattacattgggaccacctactacatgcggtccctcaagagtcgacttatcatatcaatagacacgtctaagaaccagttctccctgaagctgacctctgtgactgccgcggactcggccgtgtattactgtgcgagaggaggggagctgctgggcggattcggctacagtggtatggacgtctggggccaagggaccacggtcaccgtctcctcagcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagtt

SEQ ID NO: 2376 - DNA, 672 bp, Artificial Sequence
  Synthetic polynucleotide encoding artificial human antibody VH chain
gagctgcagctggtggagtctgggggaggcttggtccagcctggggggtccctgcgactctcctgtgcagcctctggattcacctttagtagctattggatgagctgggtccgccaggctccagggaaggggctggagtgggtggccaacataaaccaagatggaggtgagaaatactatgtggactctgtgaagggccgattcaccatctccagagacaacgccaagaactcactgtatctgcaaatgaacagcctgagagccgaggacacggccgtgtattactgtgcgcattattattatgatagtagtggttattaccaaaacgctgaatacttccagtactggggccagggcaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagtg

SEQ ID NO: 2377 - DNA, 678 bp, Artificial Sequence
  Synthetic polynucleotide encoding artificial human antibody VH chain
caggttcagctggtgcagtctggggctgaagttaagaagcctgggtcctcggtgaaggtctcctgtaaggcttctagaggcaccttcagcaaccatgctgtcagctgggtgcgacaggcccccggacaagggcttgagtgggtgggagggatcatccctgtctttggtccaccaaactacgcacagaagttccggggcagagtcacgattaccgcggacagatccacgaacacagcctacatggagctgaacagcctgagatctgaggacacggccgtatattactgtgcgagaacccagtgggggaccgatgtagaggcaacgaatccctactactatttcatggacgtctggggcaaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagtg

SEQ ID NO: 2378 - DNA, 651 bp, Artificial Sequence
  Synthetic polynucleotide encoding artificial human antibody VH chain
caggtgcagctggtgcagtctgggactgagatgaagaggcctgggtcctcggtgaaggtctcctgcaaggcttctggaggcaccttcaacttctatgctatcaactgggtgcgacaggcccctggacaagggcttgagtggatgggagggatcgtccctatctttgatacaacaacttacgcacagaggttccagggcagagtcaccattacggcggacgagtccacgaccacagtccacatggaactgagcagcctgagatttgacgacacggccgtctattactgtgcgcgagatcagagtggagctgacagatttgactcctggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagtgag

SEQ ID NO: 2379 - DNA, 654 bp, Artificial Sequence
  Synthetic polynucleotide encoding artificial human antibody VH chain
caggtccagcttgtgcagtctggggctgaggtgaagaagcctggggcctcagtgaaaatttcctgtcaggcttttggatataacttcattgacaatgctatacattgggtgcgccaggcccccggacaaaggcctgagtggatgggatggatcaacgctggcaatgggaacacaagatattcacagaatttccagggcagagtcaccataaccaaagtcacatccgcgagcacagcctacatggagatgagccgcctgaaatctgaggacacggctgtgtatttctgtgcgagatcttcgaagtggacggactggcattttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagtgag

SEQ ID NO: 2380 - DNA, 659 bp, Artificial Sequence
  Synthetic polynucleotide encoding artificial human antibody VH chain
cccagattcaactggtccagtctggagctgaggtgaagaagcctggggcctcagtgaaggtctcctgcaagacttctggttacacttttacccactatggtgtcgcctgggtgcgacaggcccctggacaagggcctgagtggatgggatggatcagcccttacaatggtaacatagagtatggacagaagttccaggggagagtcactatgaccacagacacatcgacgaatacagcctacatggagctgaggagcctgagatatgacgacacggccgtctattactgtgcgagagatctcgacgaaataaatagttcttggctcgacccctggggccagggaaccctgatcatcgtctccccagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagtgag

SEQ ID NO: 2381 - DNA, 678 bp, Artificial Sequence
  Synthetic polynucleotide encoding artificial human antibody VH chain
gtggtgcagttgttggagtctgggggaggcgtggtacagccgggggggtccctgagactctcctgtgcagcctctggattcacctttagcaactatgccatgaactgggtccgccaggctccagggaaggggctggagtgggtcacaggcattagtggtcctggtgaaagttcatactacgcagactccgtgaagggccggttcaccgtctccagagacaattacaggaacactctatatctgcaaatgaacgacttgggagccgaagacacggccacatatttctgtgcgaaacgccccaccgctggaaacagctatggtggatactactttgaccattggggccagggaaccctggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgccca

SEQ ID NO: 2382 - DNA, 672 bp, Artificial Sequence
  Synthetic polynucleotide encoding artificial human antibody VH chain
caggtgcaactggtgcagtctggggctgaggtgaagaagcctggggcctcagtgaagctttcctgcaagccatctggatacaccttcagcagctactatatccactggctgcgacaggcccctggacaagggcttgagtggatgggaataatcaaccctagcggtggttacacaagctccgcacagaaattccagggcagagtcaccatgaccagggacacgtccacgagcacaatctacatggagctgagcagcctgagagctgaggacacggccgtgtattactgtgcgagacggggcgaagtcgggactatggttcgggttttccgaaagccgtttgactactggggccagggaaccctggtcaccgtctcctccgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaggtg

SEQ ID NO: 2383 - DNA, 669 bp, Artificial Sequence
  Synthetic polynucleotide encoding artificial human antibody VH chain
ccggtgcagctggtgcagtctggagcagaggtgaaaaagcccggggagtctctgaagatctcctgtcagggttctggatacaactttagtcgctactggatcggctgggtgcgccagatgcccgggaaaggcctggagtggatgggggtcgtctttcctggtgactctgatatcagatacagcctgtccttccaaggccacatcaccatctacgccgacaactccatcagcaccgcctacctccagtggagcagcctgaaggcctcggacaccgccatttattactgtgcgacaacctcgactatgccaatgcctactagagggagagactggttcgacccctggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagtg

SEQ ID NO: 2384 - DNA, 648 bp, Artificial Sequence
  Synthetic polynucleotide encoding artificial human antibody VH chain
caggtgcagctggtggagtctgggggaggcgtggtccagcctgggacgtccctgacactgtcctgtgaagcgtctggattcaccttcaatagatatggcatgcactgggtccgtcaggctccaggcaaggggctggaatgggtggcagtaatatggtatgatggaaccaacaagtattatgctgactccgtgaggggccgattcaccatctccagagacaattccaagaacaccctttatctgcaaatgaacacactgagaggcgacgacacggctgtgtacttttgtgcgggtgcccacggtgactacggtcttgactattggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagag

SEQ ID NO: 2385 - DNA, 660 bp, Artificial Sequence
  Synthetic polynucleotide encoding artificial human antibody VH chain
gaagtgcagctggtgcagtctggagcagaggtgaaaaagcccggggagtctctgaggatctcctgtaagggttctggatacagctttaccagcttctggatcagctgggtgcgccagatgcccgggaaaggcctggagtggatggggaggattgatcctagtgactcttataccaactacagcccgtccttccaaggccacgtcaccatctcagctgacaagtccatcagcactgccttcctgcagtggagcagcctgaaggcctcggacaccgccatgtattactgtgcgagacatcagcagaagtatagccccatttccccgcttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagtt

SEQ ID NO: 2386 - DNA, 360 bp, Artificial Sequence
  Synthetic polynucleotide encoding artificial human antibody VH chain
gaagtgcagctggtggagtcggggggaggcgtgatcaagcctggggggtccctgaaactctcctgtgaaggctctggattcaccctggatgattatgtcatgcactgggtccgtcaggctccagggaagggtctggagtggatctcttctattagtggggatggtactcggacatattatgcagactctgtgaagggccgattcaccatctccagaaacaacggcaaaaattccctgtatctgcaaatggacagtctgagaagggaagacaccgccttgtattactgtgcaaaagacgcacgcctggcttattatggtatggacgtctggggccaagggaccacggtcaccgtctcctca

SEQ ID NO: 2387 - DNA, 364 bp, Artificial Sequence
  Synthetic polynucleotide encoding artificial human antibody VH chain
cagctgcagctgcaggagtcgggcccaggactggtgaagccttcggagaccctgtccctcacctgcactgtctctggtgactccatcagtagtagcggtttcttctgggcctggatccgccaggccccagggaagggcctggactggattggcagcacttatcatcgcacaactaccacctactacaacccgtccctcaagagtcgagtcaccatatccgtagacacgtccaagaaccagttctccctgaccctgaactctctgaccgccgcagacacggctgtctattactgtgcgagacactcgagtggttattcagaacttgcctactggggccagggaaccctggtcatcgtctccacag

SEQ ID NO: 2388 - DNA, 669 bp, Artificial Sequence
  Synthetic polynucleotide encoding artificial human antibody VH chain
caggagcaactggtgcagtctggggctgaggtgaagaagcctgggtcgtcggtgaaggtctcctgcaaggtttctggaggccccttcaagacctaccctatcaactgggtgcgacaggcccctggacaagggcttgagtggatgggagggatcacccctaattctggcacaccaaactacgcccagaagttccagggcagagtcacaattaccgcggacgaatccacgactacagtctacatgcaactgagcagcctgagatctgaggacacggccgtgtattactgtgcgagagtccacaattgggacttctactacggtatggacgtctggggcctagggaccacggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgccca

SEQ ID NO: 2389 - DNA, 678 bp, Artificial Sequence
  Synthetic polynucleotide encoding artificial human antibody VH chain
gaggtgcaggtggtggagtctgggggaggcttggtacagccagggcggtccctgagactctcctgtacaccttctggattcacctttggtgataatgctatgggctggttccgccaggctccagggaaggggctggagtgggtaggtttcattagaagcaaagcttatggtgggacaagagactacgccgcgtctgtgaaaggcagattcaccatctcaagagatgactccaaaagcatcgcctatctgcaaatgaacagcctgaaaaccgaggacacagccgtttattactgtactagagagaggccccctaattgtggatctagctgccccgagacctggggccagggaaccctggtcaccgtctcttcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgccca

SEQ ID NO: 2390 - DNA, 358 bp, Artificial Sequence
  Synthetic polynucleotide encoding artificial human antibody VH chain
caggttcagctggtacagtctggaagtgaggtgaagaagcctggggcctccgtgaggctcgcctgcaagacctctggttacacctttagtaattacggtgtctcctgggtgcgacagggccctggccgaggacttgagtggctgggctggataagcggttacaatggaagaacacactctgcagacaagtttcgggacagagtcaccctgaccacagacacatccacaaccacagtctacgtggacctgaagaacctgacctctgacgacacggccgtgtattattgtgcgagagtcgggacatctcattggtactctgattcttggggccagggaaccctggtcaccgtctcctcag

SEQ ID NO: 2391 - DNA, 352 bp, Artificial Sequence
  Synthetic polynucleotide encoding artificial human antibody VH chain
gaggtacagttggtggagtctgggggagggatggtccagcctggggaatcactcagactctcgtgcgcagcctctggattcgactttacttcgtattggatggcctgggtccgccaggctccagggaaggggctggagtgggtggccaatatgaacgcagatgggagtgagaaacactatgtggactctgtgaaggggcgattcagcatatccagagacaacgcgaagaagttactgtttctgcaaatgaacagcctgacagttgacgatacaggtgtctattattgtgcgagagacgaggggcgaagagagggcgcctggggccagggaacccaggtcatcgtttccgctg

SEQ ID NO: 2392 - DNA, 658 bp, Artificial Sequence
  Synthetic polynucleotide encoding artificial human antibody VH chain
gtgtgaggtgcagctggtggagtctgggggaggcttggtacagcctggggggtccctgagactctcctgtgcagcctctggattcaccttcagtagctatagcatgaactgggtccgccaggctccagggaaggggctggagtgggtttcatacattagtagtagtagtagtaccatatactacgcagactctgtgaagggccgattcaccatctccagagacaatgccaagaactcactgtatctgcaaatgaacagcctgagagccgaggacacggctgtgtattactgtgcgagagatatcgcgctgggacggggcggtatggacgtctggggccaagggaccacggtcaccgtctcctcagggagtgcatccggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaatgtg

SEQ ID NO: 2393 - DNA, 361 bp, Artificial Sequence
  Synthetic polynucleotide encoding artificial human antibody VH chain
cagctgcaactgcaggagtcgggcccaggactggtgaagccttcggagaccctgtccctcacctgcactgtctctggtgtctccatcggcaccagtagttactattggggctggatccgccagccccctgcgaagggtctggagtggattgggagtatctactatagtgggagcacctactacaacccgtccctcaagaatcgagtcaccatatcagtagacacgtccaagaaccacttctccctgaagctgagctctgtgaccgccgcagacacggctgtgtattactgtgcgagacatagaacgggccaatattactataatagttggggccagggaaccctggtcaccgtctcctcag

SEQ ID NO: 2394 - DNA, 354 bp, Artificial Sequence
  Synthetic polynucleotide encoding artificial human antibody VH chain
cccaggtgcagctgcaggagtcgggcccaggactggtgaagccttcggagaccctgtcactcacctgctctgtctctggtgactccttcagtgattactactggagctggacccgtcagtccccagggaagggactagagtggcttggttatatgttttatggtgggagcaccaactacaacccctccctcaagagtcgactcaccatgtcagtagacacgtccaagaaacacgtctacctgaagttgagctctgtgaccgctgcggacacggccgtgtattattgtgcggcgtccggctacggtgaccacgtggcctactggggccagggaaccctagtcaccgtctcctccg

SEQ ID NO: 2395 - DNA, 663 bp, Artificial Sequence
  Synthetic polynucleotide encoding artificial human antibody VH chain
caggtgcagctggtggagtctgggggaggcgtagtccagcctgggaggtccctgagactctcctgtgtagcgtctggattcaccttcagtaattatgccatgcactgggtccgccaggctccaggcaaggggctggagtgggtggcagttatatggtatgatggaagtaatgaatactatagagactccgtggagggccgattcaccatctccagagacagttccaagaatactctgtatctgctagtgaacagcctgagagccgaggacacggctgtctattattgtgcgagagggaatggacctaagagtgggaagtactcggactttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagtgag

SEQ ID NO: 2396 - DNA, 352 bp, Artificial Sequence
  Synthetic polynucleotide encoding artificial human antibody VH chain
caggttcagctggtgcaatctggaactgaggtgaagaagcctggggcctcagtgaaggtctcctgcaaggcttctggttacagatttaccagcaatggtatcagttgggtgcgacaggctcctggacaagggcttcagtggatgggatggatcagcactgacagtggtaacacaaattacgcacagagcttccagggcagagtcaccttgaccagagacacatccacgaacacagcctatctggaactcaggagactaagatctgaggacacggccgtgtattattgtgcgagagataagtcctggtactttgactactggggccagggaaccctggtcagcgtctcctcag

SEQ ID NO: 2397 - DNA, 664 bp, Artificial Sequence
  Synthetic polynucleotide encoding artificial human antibody VH chain
gtgtgaggtgcagctggtggagtctgggggaggtgtggtacggcctggggggtccctgagactctcctgtgcagcctctggattcacctttgatgattatggcatgagctgggtccgccaagctccagggaaggggctggagtgggtctctggtattcattggaatggtggtagcacaggttatgcagactctgtgaagggccgattcaccatctccagagacaacgccaagaactccctgtatctgcaaatgaacagtctgagagccgaggacacggccttgtatcactgtgcgagatccaccgctagtagtggttattatgatgcttttgatatctggggccaagggacaatggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagtgag

SEQ ID NO: 2398 - DNA, 681 bp, Artificial Sequence
  Synthetic polynucleotide encoding artificial human antibody VH chain
caggtgcagctggtggagtctgggggaggcgtggtccagcctgggaggtccctgagactctcctgtgcagcgtctggattcagtttcagtgcctatggcatgcactgggtccgccaggctccaggcaaggggctggagtgggtggcaattatgtggtatgatggaaataataaatactatgcagactccgtgaagggccgattcaccatctccagagacaattccaagaacacgctatatctgcaaatgaacagcctgagagccgaggacacggctgtgtattactgtgcgagagatcgtcgagagtatagcagctcgtcccggccttcatatcactactactacatggacgtctggggcaaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagtgag

SEQ ID NO: 2399 - DNA, 654 bp, Artificial Sequence
  Synthetic polynucleotide encoding artificial human antibody VH chain
gtggtgcagctgttggagtctgggggaggcttggtacaccctggggggtccctgagaatttcctgtgcagcctctgaattcacctttagcgcctatgccatgacctgggtccgccaggctccagggaaggggctggagtgggtctcggctattagtggcagtggtggtcggacatactacgcagactccctgaagggccggttcaccatctccagagacaattccaagcacactctgtatctcctaatgaatagtctgagagtcgaggacacggccgtttattactgtgcgtcccgatatagaagcccgtccggtgcttttgacatctggggccaagggacattggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagtc

SEQ ID NO: 2400 - DNA, 645 bp, Artificial Sequence
  Synthetic polynucleotide encoding artificial human antibody VH chain
gaggtgcagctggtggagtctgggggaggcttggtaaagcctggggggtcccttagactctcctgtgcagcctctggtttcactttcagtaacgcctggatgaactgggtccgccagactccagggaaggggctggagtgggtcggccgtattaaaaccaaaactgatggtgggacaacagactacgctgaacccgtaaaaggcagattcaccatctcaagagatgattcaaaaaacacgctatatctgcaaatgaacagcctgaaaaccgaggacacagccgtgtattattgtaccagaggagcagtggccgactactggggccagggaacccaggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagtc

SEQ ID NO: 2401 - DNA, 657 bp, Artificial Sequence
  Synthetic polynucleotide encoding artificial human antibody VH chain
caggtgcagctgaagcagtcggggggaggcgtggtccagcctgggaggtccctgacactctcctgtgtagcgtctggactcaccttcagtgactatggcatgcactgggtccgccaggctccaggcaaggggctggagtgggtggccgttatttggcatgatggcagtaagacgaattatgcagactccgtgaagggccgaatcatcatctccagagacaactccaagagcacggtgtatttgcaaatgaacagattgagaggcgaggacacggctgtgtattactgtgcgacctcccacggaggactagtgcctggcggcgaaaactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagtc

SEQ ID NO: 2402 - DNA, 370 bp, Artificial Sequence
  Synthetic polynucleotide encoding artificial human antibody VH chain
caggttcagctggtgcagtcgggatctgagttgaagaagcctggggcctcagtgaaggtctcctgcacaagttccggttacgtctttaccagctttggggtcagctgggtgcgacaggtcccgggacaagggcctgagtggatgggatggattagcccttacacccgtcagacaaaatatgcacagagtctccagggcagaatcaccctgaccgcagacacatccacaaatacgacttacatggaactgaggagcctgagatctgacgacacggccatgtattactgtgtgagagaggagtttggagtggttcgtggacctaatccctttgatgtctggggccaggggacaatggtcaccgtctcttcag

SEQ ID NO: 2403 - DNA, 672 bp, Artificial Sequence
  Synthetic polynucleotide encoding artificial human antibody VH chain
gaggtgcagctggtggagtcggggggaggcgtggtccagcctggggggtccctgagactctcctgtgcagcgtctggattcaccttcgaagacttcggcatgcactgggtccgccaggctccaggcaaggggctggagtgggtggcatttacacgttttgatggaagtgaaaaatattatgtcgactccgtgaagggccgattcaccgtctccagagacaattccaagaatacactttttctacatatgaacagcctgagaccggaagacacggctgtatattactgtgcgaaaacccgttcttatagttccgctgacactactcgtcccaatgccccgggctactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagtc

SEQ ID NO: 2404 - DNA, 660 bp, Artificial Sequence
  Synthetic polynucleotide encoding artificial human antibody VH chain
caggtgcagctggtggaatctgggggaggcgtggtccagcctgggaggtccctgagactctcctgtgcagcctctggattcaccctcagtacctatggcatgcactgggtccgccaggctccaggcaaggggctggagtgggtggcagttatatcacatgatggaagtaataactactatgcagactacgtgaagggccgattcaccatctccagagacaattccaagaacacgctgtacctgcaaatgaacagcctgagaattgaggacacggctgtgtattactgtgcgaaagatggccaaactggaactacaaccccatactttgactactggggccagggaaccctggtcaccgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccggctgtcctacagtcctcaggactctactccctcagcagcgtggtgaccgtgacctccagcaacttcggcacccagacctacacctgcaacgtagatcacaagcccagcaacaccaaggtggacaagacagtg

SEQ ID NO: 2405 - DNA, 657 bp, Artificial Sequence
  Synthetic polynucleotide encoding artificial human antibody VH chain
cccgtccagcttgtgcagtctggggcccaggtgaagaagcctggggcctcagtgaggctttcctgcaagtcttctggatataccttcagtaactatgctatacattggctgcgccaggcccccggacagaggcttgagtgggtggggtggatccacgttggaaatgatcacacaagatattcacagagtttccagggcagagtcaccatttccgcagatacatccgcgaacacggcctacatggaggtgagaggcctgcgatctgaagacacgtctctgttttactgtgcgagagccggggctgagggcgttgactattggggccagggaacccaggtgaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgccca

SEQ ID NO: 2406 - DNA, 657 bp, Artificial Sequence
  Synthetic polynucleotide encoding artificial human antibody VH chain
gcagtgcagctggtgcagtctggagcagaggtgaaaaagcccggggagtctctgaggatctcctgtaagggttctggatacagcttttccacctactggatcatctgggtgcgccagatgcccgggaaaggcctagagtggattgggaggtttgatcctagtgactcttataacgtcaacagcccgtccttccaaggccacgtcaccatctcagctgacacgtccatcaacactgcctacttgcagtggagcagcctgaaggcctcggacagcgccatgtattactgtgcgagacgatccgataaagcagtgcctgggacctttgaccagtggggccagggaaccctggtcaccgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccggctgtcctacagtcctcaggactctactccctcagcagcgtggtgaccgtgccctccagcaacttcggcacccagacctacacctgcaacgtagatcacaagcccagcaacaccaaggtggacaagacagtg

SEQ ID NO: 2407 - DNA, 663 bp, Artificial Sequence
  Synthetic polynucleotide encoding artificial human antibody VH chain
cagatcaccctgaaggagtctggtcctacgctgctgaaacccacacagaccctcacgctgacctgcaacttctctgggttctcactcaccacatatggagtgggtgtggcctggatccgtcagcccccaggaaaggccctggagtggcttgcactcatttattgggatgatgataagcgctacagcccatctctgaagagcagactcaccgtcaccaaggacacctccaaaaaccaggtggtccttacaatgaccaacatggaccctgtggacacagccacatattactgtgcacacagggggggaaagaaccctcgttattggtacttcgatctctggggccgcggcactctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagtg

SEQ ID NO: 2408 - DNA, 654 bp, Artificial Sequence
  Synthetic polynucleotide encoding artificial human antibody VH chain
gaggtacagctggtggagtctggtggaggcctggtcaagcctagggggtccctgagactctcctgtgcagcctctggattcaccttcagtgcttatggcatgaactgggttcgccaggctccagggaagggactggagtgggtctcatccattagtggagatagtcgtgacatctactatggagcctctatgaagggccgattcaccatctccagagacaacgccaagagctcactgtatctgcaaatgaacagcctgagagccgaggacacggctgtttattactgtgcgagaggggaggggggggaattatgggcctttgactactggggcctgggagtcctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagcc

SEQ ID NO: 2409 - DNA, 657 bp, Artificial Sequence
  Synthetic polynucleotide encoding artificial human antibody VH chain
cccgtgcagctggtgcagtctggggctgaggtgaagaagcctgggtcctcggtgcaggtctcctgcaagggttctggaggcaccttcagcgaatatggtatcagctggttgcgacaggcccctggacaagggcttgagtggattggaggaatcatacctgtcctaggtataccaaattacgcacaaaaattccggggcagagtcaccattaccgcggacgaatccacgggctcagcctacatggaggtgagcagcctcagatctgaagacacggccgtttattactgtgcgagagaggggcttcgtctggcacgtggctggtttcacccctggggccagggaaccctcgtcaccgtcacctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagtgag

SEQ ID NO: 2410 - DNA, 361 bp, Artificial Sequence
  Synthetic polynucleotide encoding artificial human antibody VH chain
caggtgcaactgcaagagtcgggcccaggactggtgaagccttcggagaccctgtccctcatctgcactgtctctggtgcctccgtcaacagtgggactcacttctggagctggatccggcagcccccagggaagggactggagtggattggctatgtctattacagtgggaacaccaattacaatccctccctcaagagccgagtcgccatatcagttgacacgtccaagaaccagttctccctgaagctgacctctgtgacctctgcggacacggccgtgtattactgtgcgagagattttgatgatggctacgacatccgttactggggccagggaacccgggtcagcgtctcctcag

SEQ ID NO: 2411 - DNA, 654 bp, Artificial Sequence
  Synthetic polynucleotide encoding artificial human antibody VH chain
gtggtgcagctggtggagtctgggggaggcttggtccagcctggggggtccctgagactctcctgttcagcctctggattcaccttcagtagctatgctatgcactgggtccgccaggctccagggaagggactggaatatgtttcagctattagtagtaatgggggtagcacatactacgcagactccgtgaagggcagattcaccatctccagagacaattccaagaacacgctgtatcttcaaatgagcagtctgagagctgaggacacggctgtgtattactgtgtgaaatcaccagtggccgcaaatgatgcttttgatatctggggccaagggacaatggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagtgtg

SEQ ID NO: 2412 - DNA, 658 bp, Artificial Sequence
  Synthetic polynucleotide encoding artificial human antibody VH chain
gtgtgaggtgcagctggtggagtctgggggaggcttggtacagcctggggggtccctgagactctcctgtgtagcctctggattcaccttcagtagctatagcatgaactgggtccgccaggctccagggaaggggctgaagtgggtttcatacattagtagtagtaggagtaccatatacaacgcagactctgtgaagggccgattcaccatctccagagacaatgccaagaagtcactgtatctgcaaatgaacagcctgagagccgaggacacggctgtgtattactgtgcgagagtgtctgtggccgccccaacgtgcttggactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaggtg

SEQ ID NO: 2413 - DNA, 663 bp, Artificial Sequence
  Synthetic polynucleotide encoding artificial human antibody VH chain
cagctgcagctgcaggagtcgggcccaggactggtgaagccttcggagaccctgtccctcacctgcactgtcgctggtgactccatcagcaggagtaattactactgggcctggatccgccagcccccagggaaggggctggagtggattgggagtatcattcatactgggaccacctaccacaacccgtccctcaggagtcgcggcaccattttggtagacacgtccaagaaccaattctccctgaaactgagctctgtgaccgccgcagacacgggtctatattactgtgcgagacattcagggcacgatcagttgccgctagactttgacaactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagtgag

SEQ ID NO: 2414 - DNA, 349 bp, Artificial Sequence
  Synthetic polynucleotide encoding artificial human antibody VH chain
gaggtgcaactggttgagtccgggggaggcttagttcagccgggggggtccctgagactctcctgtgcagcctctggattcacctttagtaagttttggatgcactgggtccgccaagctccagggaaggggctggtgtggctctcacgtattaatactgatgggactgtcacaacctacgcggactccgtgaagggccggttcaccatctccagagacaacgccaagagcacgctgtatctgcaaatgaacagtctgagagtcgaggacacggctgtttattattgtgcaggaggaggaagtcaagtggacttctggggccagggaaccctggtcaccgtctcctcag

SEQ ID NO: 2415 - DNA, 671 bp, Artificial Sequence
  Synthetic polynucleotide encoding artificial human antibody VH chain
cccagatcaccttgaaggagtctggtcctacgctggtgaaacccacacagaccctcacgctgacctgcaccttctctgggttctctctgaccactactggagtgggtgtgggctggatccgtcagcccccaggaaaggccctggagtggcttgcactcatttattgggatgatgataagcgctacagcccatctctgaagagcaggctcatcatcaccaaggacacctccaaaaaccaggtggtccttacaatgaccaacatggaccctgtggacacagccacatattactgtgcacacagattcgggagaggggtgtcctactactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaggtg

SEQ ID NO: 2416 - DNA, 651 bp, Artificial Sequence
  Synthetic polynucleotide encoding artificial human antibody VH chain
caggtgcagctggtggagtctgggggaggcgtggtccagcctgggaggtccctgagactctcctgtgcagcctctggattcatcttcagtagctatggcatgcactgggtccgccaggctccaggcaaggggctggagtgggtggcagttatatcatatgatggaagtaataaatactatgcagactccgtgaagggccgattcaccatctccagagacaaatccaagaacacgctgcatctgcaaatgaacagcctgagagctgaggacacggctgtgtattactgtgcgaaagatagtgggagcaacgacgacatggacgtctggggcaaggggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagtgag

SEQ ID NO: 2417 - DNA, 658 bp, Artificial Sequence
  Synthetic polynucleotide encoding artificial human antibody VH chain
gtgtgaggtgcagctggtggagtctgggggaggcttggtacagcctggagggtccctgagactctcctgtgcagcctctggattcaccttcagtagttatgaaatgaactgggtccgccaggctccagggaaggggctggagtgggtttcatacattagtagtagtggtagtaccatatactacgcagactctgtgaagggccgattcaccatctccagagacaacgccaagaactcactgtatctgcaaatgaacagcctgagagccgaggacacggctgtttattactgtgcgagaagaggtttttactactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagtgag

SEQ ID NO: 2418 - DNA, 649 bp, Artificial Sequence
  Synthetic polynucleotide encoding artificial human antibody VH chain
gtgtgaggtgcagctggtggagtctgggggaggcttggtacagcctggggggtccctgagactctcctgtgcagcctctggattcaccttcagtagctatagcatgaactgggtccgccaggctccagggaaggggctggagtgggtttcatacattagtagtagtagtagtaccatatactacgcagactctgtgaagggccgattcaccatctccagagacaatgccaagaactcactgtatctgcaaatgaacagcctgagagccgaggacacggctgtgtattactgtgcgagtctcctcgggggcgatcctgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaggtg

SEQ ID NO: 2419 - DNA, 678 bp, Artificial Sequence
  Synthetic polynucleotide encoding artificial human antibody VH chain
cccgtcaccttgagggagtctggtcctgcgctggtgaaacccacacagaccctcacactgacctgcaccttctctgggttctcactcagcactagtggaatgtgtgtgagctggatccgtcagcccccagggaaggccctggagtggcttgcacgcattgattgggatgatgataaatactacagcacatctctgaagaccaggctcaccatctccaaggacacctccaaaaaccaggtggtccttacaatgaccaacatggaccctgtggacacagccacgtattactgtgcacggatgcaaatagtggctacgacacagacctactactactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagtgag

SEQ ID NO: 2420 - DNA, 654 bp, Artificial Sequence
  Synthetic polynucleotide encoding artificial human antibody VH chain
gaggtgcagctggtggagtctgggggaggcttggtccagcctggggggtccctgagactctcctgtgcagcctctggattcacctttagtagctattggatgacctgggtccgccaggctccagggaaggggctggagtgggtggccaacataaagcaagatggaagtgagaaatactatgtggactctgtgaagggccgattcaccatctccagagacaattccaagaactcgctgtatctgcaaatgaacagcctgagagctgaggacacggctgtgtattactgtgcgagagcgggctacgatcttttcggctggttcgacccctggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaagttg

SEQ ID NO: 2421 - DNA, 376 bp, Artificial Sequence
  Synthetic polynucleotide encoding artificial human antibody VH chain
gaggtgcagctgttggagtctgggggaggcttggtacagcctgggggatccctgagactctcctgtgtagcctctggattcacctttgccagctatggcatggcctgggtccgccaggctccagggcaggggctgacctggatctgttttgttggtagcggtgacaccacacactacgcggagtccgtgaagggccgcttcacctgttccagagacaactccaacaatacactttatctccatatgagcggtctgagaggcgcagacacggccaaatattactgtgcgaaacccaactcccctttcactggcagtggaagtttccacaactactttgactactggggccagggcgcgctggtcatcgtctcctcag

SEQ ID NO: 2422 - DNA, 342 bp, Artificial Sequence
  Synthetic polynucleotide encoding artificial human antibody VH chain
gtgaggtgcaggtggtggagtctgggggaggcttgggacagcctggggggtccctgagactctcctgtgcagcctctggattcaccttcagtagctatagtatgaactgggtccgccaggctccagggaaggggctggagtgggtttcatacattagtagtagtagtagtaccaaatactacgcagactctgtgaagggccgattcaccatctccagagacaatgccaagaaatcactgtatctgcaaatgaacagcctgagagacgaggacacggctgtgtattactgtgcgagtcccgttcgaccctggggccagggaaccctggtcaccgtctcctcag

SEQ ID NO: 2423 - DNA, 678 bp, Artificial Sequence
  Synthetic polynucleotide encoding artificial human antibody VH chain
caggtgcagctggtgcagtccggggctgagatgaagaagcctgggacctcagtgaaggtctcctgcaggacttctggatacatcttcaccggctcctttatgcactgggtgcgacaggcccctgcacaagggctcgagtggatgggatggatcaaccctaagactggtgccacatactatacagagaaatttaagggcagggtcaccctgaccagggacacgtccatcaacacagcctacatggagatgaccagcctgagatctgacgacacggccgtgtattattgtgcgagaggattttgtgatcttcccgcctgttatcccgtacctcaatacaactggttcgacccctggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagtt

SEQ ID NO: 2424 - DNA, 657 bp, Artificial Sequence
  Synthetic polynucleotide encoding artificial human antibody VH chain
cccgtgcagctgcaggagtcgggcccaggacttgtgaagccttcacagaccctgtccctcacctgcactgtctctggtggctccatcagcagtggtacttactactggagctggatccggcagcccgccgggaagggactggagtggattgggcgtatctatgccagtgggagcaccaactacaacccctccctcaagagtcgagtcaccatatcagtagacacgtccaagaaccagttctccctgaagctgacctctgtgaccgccgcagacacggccgtgtattactgtgcgcgatatagtgggagctaccctttgggctttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaggtg

SEQ ID NO: 2425 - DNA, 650 bp, Artificial Sequence
  Synthetic polynucleotide encoding artificial human antibody VH chain
gcggtgccgaggtgcagctggtgcagtctggagcagaggtgaaaaagccggggcagtctctgaagatctcctgtaagggttctggatacagctttaccaactactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacatgaaggtgcttttgatatctggggccaagggacaatggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaggtg

SEQ ID NO: 2426 - DNA, 364 bp, Artificial Sequence
  Synthetic polynucleotide encoding artificial human antibody VH chain
gtggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacactgcacccgtgaaaggcagattcaccatctcaagagatgattcaaaaaacacgctgtatctgcaaatgaacagcctgaaaaccgaggacacagccgtgtattactgtaccacagatcttgcggtgactacgcgatttgactactggggccagggaaccctggtcaccgtctcctcag

SEQ ID NO: 2427 - DNA, 648 bp, Artificial Sequence
  Synthetic polynucleotide encoding artificial human antibody VH chain
caggtgcagctggtggagtctgggggaggcgtggtccagcctgggaggtccctgagactctcctgtgcagcctctggattccccttcagtacctatgctctgcactgggtccgccaggctccaggcaaggggctggagtgggtggcagtcatatcaaaagatggaaacagcaaatcttccgcagagtccgtgaagggccgattcaccatctccagagacaaatccaggaacacactttatctgcaaatgaacagcctgagacctgaagacacggctgtatattactgtgcgagaagcacacgtacagacgctttggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagtg

SEQ ID NO: 2428 - DNA, 660 bp, Artificial Sequence
  Synthetic polynucleotide encoding artificial human antibody VH chain
gaggtgcagctggtggagtccgggggaggcttggtccagcctggggggtccttgaaactctcctgtgcagcctctggtttctccttcagtggctcttctgtgcactgggtccgccaggcttccgggaaagggctggagtgggttggccgtattagaagcaaaactaagaattacgcgacagcatatgctgcgtcggtgaaaggcaggttcaccatctccagagatgattcaaagaacacggcgtttctgcaaatgcgcagcctgaaagccgaggacacggccgtatattactgtgctaaaaatgacgagatggactttaagggctatgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaggtg

SEQ ID NO: 2429 - DNA, 641 bp, Artificial Sequence
  Synthetic polynucleotide encoding artificial human antibody VH chain
cccaggtgcagctgcaggagtcgggcccaggactggtgaagccttcggagaccctgtccctcacctgcactgtctctggtggctccatcagtagttattactggagctggatccggcagcccgccgggaagggactggagtggattgggcgtatctacaccagtgggagcaccaactacaacccctccctcaagagtcgagtcaccatgtcagtagacacgtccaagaaccagttctcgctgaagatgagctctgtgaccgccgcggacacggccgtgtattactgtgcgagaggggagttattattcgaccactggggccagggaacgctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaatgtg

SEQ ID NO: 2430 - DNA, 651 bp, Artificial Sequence
  Synthetic polynucleotide encoding artificial human antibody VH chain
gaggtgcagctggtggagtctgggggaggcttggtgcagccagggcggtccctgagactctcctgtgtagcttctggattcacctttggtgattatgctgtgaactggttccgccaggctccagggaagggcctggaatgggttggtttcattagtaccaaaggttatgatgagacagcagaatatgccgcgtctgtgaagggcagatttaccatgtcaagagatgactccaaaaacatcgcctatctgctgatggacagcctgaaagccgaggacacagccatgtattattgtgctagagaatctacggtggttcttgacttctggggccaggggaccctggtcgccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagtg

SEQ ID NO: 2431 - DNA, 651 bp, Artificial Sequence
  Synthetic polynucleotide encoding artificial human antibody VH chain
caggtgcagctggtggactctgggggaggcgtggtccagccgggggggtccctgagactctcctgtgcagcgtcgggattcaccctcagtaactatggcatgaactgggtccgccaggctccaggcaaggggctggagtgggtggcatttataccgtatgatggaagtaataaatactacgcagactccgtgaagggccgattcaccatctccagagacatttccaagaacacactgtatctgcaaatgaacagcctgagaactgaggacacggctgtgtattactgtgcgaaaaggtcaacagcagtgggggacttcgacccctggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaggtg

SEQ ID NO: 2432 - DNA, 675 bp, Artificial Sequence
  Synthetic polynucleotide encoding artificial human antibody VH chain
gaggtgcagctggtggagtctgggggaggcttggtacagccgggggggtccctgagactctcctgtgcagcctctggattcagcatcactacccatagcatgaactgggtccgccaggctccagggaaggggctgcagtgggttgcatacatcagtactagtacaagtaccatatactacgcagactctgtggagggccgattcaccatctcgagagacaaggccaagaacgcactgtatctacaaatggacagcctgagagcccaggacacggctgtatattactgtgcgcgggggccgtccaactggaacgggggtccggagcacatggacgtctggggcaaagggaccacggtcaccgtctcctcagcatccccgaccagccccaaggtcttcccgctgagcctcgacagcaccccccaagatgggaacgtggtcgtcgcatgcctggtccagggcttcttcccccaggagccactcagtgtgacctggagcgaaagcggacagaacgtgaccgccagaaacttcccacctagccaggatgcctccggggacctgtacaccacgagcagccagctgaccctgccggccacacagtgcccagacggcaagtccgtgacatgccacgtgaagcactacacgaatcccagccaggatgtgactgtgccctgccca

SEQ ID NO: 2433 - DNA, 633 bp, Artificial Sequence
  Synthetic polynucleotide encoding artificial human antibody VH chain
gtggtgcagctggtggagtctgggggaggcttggtacagcctggagggtccctgagactctcctgtgcagcctctggattcaccttcagtagttatgagatgaactgggtccgccaggctccagggaaggggctggagtgggtttcatacattagtagtagtggtagtaccatatactacgcagactctgtgaagggccgattcaccatctccagagacaacgccaagaactcactgtatctgcaaatgaacagcctgagagccgaggacacggctgtttattactgtgcgagagattttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaatgtg

SEQ ID NO: 2434 - DNA, 657 bp, Artificial Sequence
  Synthetic polynucleotide encoding artificial human antibody VH chain
gtggtgcagctggtggagtctgggggaggcttggtacagcctggggggtccctgagactctcctgtgcagcctctggattcaccttcagtagctatagcatgaactgggtccgccaggctccagggaaggggctggagtgggtttcatacattagtagtagtagtagtaccatatactacgcagactctgtgaagggccgattcaccatctccagagacaatgccaagaactcactgtatctgcaaatgaacagcctgagagacgaggacacggctgtgtattactgtgcgagagatccctatggttcggggacggtctggttcgacccctggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaatgtg

SEQ ID NO: 2435 - DNA, 672 bp, Artificial Sequence
  Synthetic polynucleotide encoding artificial human antibody VH chain
gaggcacagttggtggagtctggaggaggcttgatccagccgggggggtccctgagactctcctgtgcagcctctgggttcagcgtcagtagcaagtacatgagctgggtccgccaggctccagggaaggggctggagtgggtctcagttatgtacagtggtggcgccacatactacgcagattccgtgaagggccgattcgtcatctccagagacagttccaagaacacggtatttcttcaaatgaacagcctgagagccgaggacacggccgtttattactgtgcgaaaactgagtacacttttttgagtggctccgactactaccagtacggtatggacgtctggggccaagggacaacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagtg

SEQ ID NO: 2436 - DNA, 663 bp, Artificial Sequence
  Synthetic polynucleotide encoding artificial human antibody VH chain
ccggtgcagctggtgcagtctggagcagaggtgaaaaagccgggggagtctctgaagatctcctgtaagggttctggatacagctttaccaactactggatcggctgggtgcgccagatgcccgggaaaggcctggagtggatggggatcatctatcctggtgactctgataccagatacagcccgtccttccaaggccaggtcaccatctcagccgacaagtccatcagcaccgcctaccttcagtggagcagcctgaaggcctcggacaccgccatgtattactgtgcgagacgggggttattgcgtgggagcaacgagggaaggtttgactactggggccagggaaccctggtcaccgtctcctcagcctccaccaagggcccatcggtcttccccctggcaccctcctccaagagcacctctgggggcacagcagccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaggtg

SEQ ID NO: 2437 - DNA, 666 bp, Artificial Sequence
  Synthetic polynucleotide encoding artificial human antibody VH chain
gtggtgcagctggtggagtccgggggagacttggtccagcctggggggtccctgaaactctcctgtgcagcctctgggttcaccttcagtggctctgctatgcactgggtccgccaggcttccgggaaagggctggagtgggttggccgtattagaagtaaacctaacagttacgcgacagcatatgctgtgtcggtgaaaggcaggttcaccatctccagagatgattcaaagaacacggcgtatctgcaaatgaacagcctgaaaaccgaggacacggccgtatattattgtactagacgcggcagtgcctggacggacccctactacacggacgtctggggcaaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagag

SEQ ID NO: 2438 - DNA, 666 bp, Artificial Sequence
  Synthetic polynucleotide encoding artificial human antibody VH chain
tcggtgcagctggtggagtctgggggaggcgtggtccagcctgggaggtccctgagactctcctgtgcagcgtctggattcaccttcagtgactatggcatgcactgggtccgccaggctccaggcaaggggctggagtgggtggcagttatatggtatgatggaagtaatgagtactatgcagactccgtgaagggccgattcaccatctccagagacaattccaagaacacggtttatctgcaaatgaacagcctaggagccgaggacacggctgtatattactgtgcgagagatgatgtccctaggggttatgactactggggccagggaaccctggtcaccgtctcctcagggagtgcatccgccccaacccttttccccctcgtctcctgtgagaattccccgtcggatacgagcagcgtggccgttggctgcctcgcacaggacttccttcccgactccatcactttctcctggaaatacaagaacaactctgacatcagcagcacccggggcttcccatcagtcctgagagggggcaagtacgcagccacctcacaggtgctgctgccttccaaggacgtcatgcagggcacagacgaacacgtggtgtgcaaagtccagcaccccaacggcaacaaagaaaagaacgtgcctcttcca

SEQ ID NO: 2439 - DNA, 654 bp, Artificial Sequence
  Synthetic polynucleotide encoding artificial human antibody VH chain
tcagtgcagctggtggagtctgggggaggcgtggtccagcctgggaggtccctgagactctcctgtgcagcgtctggatacaccttcaataactatggcatgcactgggtccgccaggctccaggcaaggggctggagtgggtggcaattatatggtatgatggaagtaataaatactatgcagactccgtgaagggccgattcaccatctccagagacaattccaagaacacgctgtatctgcaaatgaacagcctgagagccgaggacacggctgtgtattactgtgcgagagagtacattgtacccttctacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaggtg

SEQ ID NO: 2440 - DNA, 644 bp, Artificial Sequence
  Synthetic polynucleotide encoding artificial human antibody VL chain
gcgacatccagatgacccagtctccatcttccctgtctgcatctgtgggagacagagtcagcatcacttgtcgggcgagtcagggtgttagcagctacttagcctggtatcaaaagaaaccagggagagcccctaaactcctgatctatagtgcatccagtttgcaaagtggggtcccatcaaggttcagcggcagtggatctgggacagatttcactctcaccatcaccggcctgcagcctgaagattttgcaacttacttttgtcaacagactaacactttccccctcactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaactctacgcctgcgaagtcacccatcagggcctgagctcgcccgtcacaaagagcttcaacaggggagagtgt

SEQ ID NO: 2441 - DNA, 644 bp, Artificial Sequence
  Synthetic polynucleotide encoding artificial human antibody VL chain
gtgacatccagatgacccagtctccatcctccctgtctgcatctgttggagacagagtcaccatcacttgccgggcaagtcagagcattggcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccgcgttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2442 - DNA, 644 bp, Artificial Sequence
  Synthetic polynucleotide encoding artificial human antibody VL chain
gcgacatccagatgacccagtctccatcttacgtgtctgcatctgtaggagacagagtcaccatcacttgtcgggcgagtcagggtattgacgtctggttggcctggtatcagcagaaaccagggaaagcccctaagctcctgatctatactgcatccagtttacaaagtggggtcccatcaaggtttagcggcagtggaggtgggacagaattcactctcaccatcagcagcctgcagcccgaggattttgcaacttactattgtcaacagtctaacagtttccccgggactttcggccctgggaccaaagtggatgtcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2443 - DNA, 331 bp, Artificial Sequence
  Synthetic polynucleotide encoding artificial human antibody VL chain
ccgtctgtgctgactcagccaccctcagcgtctgggacccccgggcagagggtcaccatctcttgttctggaagcagttccaacatcggaagtaattatgtatactggtaccagcagctcccaggaacggcccccaaattcctcatctataggaataatcagcggccctcaggggtccctgaccgattctctggctccaagtctggcacctcagcctccctggccatcagtgggctccggtccgaggatgaggctgattattactgtgcagcatgggaggacagcctgagtggtccggtgttcggcggagggaccaagctgaccgtcctag

SEQ ID NO: 2444 - DNA, 636 bp, Artificial Sequence
  Synthetic polynucleotide encoding artificial human antibody VL chain
tcttctgagctgactcaggaccctgctgtgtctgtggccttgggacagacagtcaggatcacatgccaaggagacagcctcagaaactattatgcaagttggttccagcagaagccaggacaggcccctgtacttgtcatctttggtaaaaactaccggccctccgggatcccagaccgattctctggctccaactcaggaaacacagcttccctgaccatcactggggctcaggcggaagatgaggccgactactactgtaactcccgggacaggagtggttatgtcttcggatccgggaccaaggtcaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttca

SEQ ID NO: 2445 - DNA, 642 bp, Artificial Sequence
  Synthetic polynucleotide encoding artificial human antibody VL chain
ctctatgtgctgactcagccaccctcagtgtcagtggccccaggaacgacggcctggatttcctgtgggggaaacaacattggaattaaaagtgtccactggtaccagcagaagccaggccaggcccctctgttggtcatctcttatgatagcgaccggccctcagtgatccctgagcgattctctgtctccaactctgggaacacggtcaccctgaccatcagcagggtcgaagccggggatgaagccgactattactgtcaggtgtgggataatggtcattctcattgggtgttcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttca

SEQ ID NO: 2446 - DNA, 319 bp, Artificial Sequence
  Synthetic polynucleotide encoding artificial human antibody VL chain
gacatccagatgacccagtctccatcctccctgtctgcatctgtaggagacagagtcaccatcacttgccgggcaagtcagagcataagcagttatttaaattggtatcagcaaaaacccgggagagcccctaggctcctgatctatgctgcatccaggttgcaaattggggtcccatcaaggttcagtggcagtggatctgggacagatttcactctcaccatcagcagtctgcagcctgaagattttgcaacttactactgtcaacagagttacagaatgccttgcagttttggccaggggaccaagctggagatca

SEQ ID NO: 2447 - DNA, 650 bp, Artificial Sequence
  Synthetic polynucleotide encoding artificial human antibody VL chain
gagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctcccatcaccttcggccaagggacacgactggagattaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaactctacgcctgcgaagtcacccatcagggcctgagctcgcccgtcacaaagagcttcaacaggggagagtgt

SEQ ID NO: 2448 - DNA, 331 bp, Artificial Sequence
  Synthetic polynucleotide encoding artificial human antibody VL chain
cattttatgctgactcagccccactctgtgtcggagtctccggggaagacggtaaccatctcctgcacccgcagcagtggcaacattgccagctactatgtgcagtggtatcagcagcgcccgggcagtgcccccaccactgtgatctatgaggatgaccaaagaccttctggggtccctgatcggttctctgcctccatcgacagctcctccaactctgcctccctcaccatctctggactgaagactgaggacgaggctgactattattgtcagtcttatgatacaaccaatgtgatattcggcggagggaccaagctgaccgtgctcg

SEQ ID NO: 2449 - DNA, 645 bp, Artificial Sequence
  Synthetic polynucleotide encoding artificial human antibody VL chain
gaaattgttttgacgcagtctccaggcaccctgtctttgtctccaggggaaagagccaccctctcctgcagggccagtcagagtgttagcagcagttacttagcctggtatcagcagaaacctggccaggctcccaggctcctcatctttggtgcatccaccagggcctctggcatcccagacaggttcagtggccgtgggtctgggacagagttcactctcaccatcagcagactggagcctgaagattttgcagtgtattactgtcaacagtatgatagttcacccttcactttcggccctgggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaactctacgcctgcgaagtcacccatcagggcctgagctcgcccgtcacaaagagcttcaacaggggagagtgt

SEQ ID NO: 2450 - DNA, 645 bp, Artificial Sequence
  Synthetic polynucleotide encoding artificial human antibody VL chain
ccgtctgtgttgacgcagccgccctcagtgtctgcggccccaggacagaacgtcaccatttcctgctctggaagtagctccaatattgagaataatgatgtatcctggtaccagcagctcccaggaacagcccccaaagtcatcatctatgaaaataatcagcgaccctcagggattcctgaccgattctctggctccaagtctggcacgtcagccaccctgggcatcaccggactccagactggggacgaggccgattattactgcggaacatgggatgacaacctgagtgctgtattcggcggagggaccaaactgaccgtcctaggtcagcccaaggctgccccctcggtcactctgttcccgccctcctctgaggagcttcaagccaacaaggccacactggtctgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2451 - DNA, 337 bp, Artificial Sequence
  Synthetic polynucleotide encoding artificial human antibody VL chain
gatgttgtgatgactcagtctccactctccctgcccgtcacccttggacagccggcctccatctcctgcaggtctagtcaaagcctcgtacacagtgatggaaacacctacttgaattggtttcaacagaggccaggccaatctccaaggcgcctaatttatatggtttctaaccgggactctggggtcccagacagattcagcggcagtgggtcaggcactgatttcacactgaaaatcagcagggtggaggctgaggatgttggggtttattactgcctgcaaggtacacactggcctccgacgatcggccaggggaccaaggtggaaatcgaac

SEQ ID NO: 2452 - DNA, 648 bp, Artificial Sequence
  Synthetic polynucleotide encoding artificial human antibody VL chain
ccgtctggactgactcagccaccctcggcgtctgggacccccgggcagagggtcaccatgtcttgctctggaagcagctccaatatcgggagaaattatgtttactggtaccaacaactcccaggagcggcccccaaactcctcatctatagggataatcagcggccctcaggggtccctgatcgattctctggctccaagtctggcacctcagcctccctggccatcagtgggctccggtccgaggatgaggctgattattactgtgcagcatgggatgacaatgtgagtggtcctggcttcggagctgggaccaggctcaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttca

SEQ ID NO: 2453 - DNA, 648 bp, Artificial Sequence
  Synthetic polynucleotide encoding artificial human antibody VL chain
cccgctgtgctgactcagtcaccctcagcgtctgggacccccgggcagagggtcaccatctcttgttttgggagcatctccaacatcggaagtaatcctgtaaactggtaccagcaggtcccaggagcggcccccaaactcctcatctatagtagtagtcagcggccctcaggggtccctgaccgattctctggctccaagtctggcacctcagcctccctggccatcagtggcctccagtctgaggatgaggctgactattactgtgcaacatgggatgacagcctgaatggtccggtgttcggcggagggaccaagcttaccgtccttggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttca

SEQ ID NO: 2454 - DNA, 639 bp, Artificial Sequence
  Synthetic polynucleotide encoding artificial human antibody VL chain
gaaacagtgatgacgcagtctccagccaccctgtctgtgtctccgggggatagagccaccctctcctgcagggccagtcagaatgttaacttcaacttagcctggtaccagcagaaacctggccaggctcccaggctcctcatctatgatgcatccaccagggccactggtatccctgccaggttcagtggcagtgcgtctgggacagagttcacgctcaccatcaacagcctgcagtctgaagattttgcagtttactactgtcagcagtataataactggtggacgttcggccaagggaccaaactggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgg

SEQ ID NO: 2455 - DNA, 647 bp, Artificial Sequence
  Synthetic polynucleotide encoding artificial human antibody VL chain
cagaaattgtgttgacgcagtctccaggcaccctgtctttgtctccaggggaaagagccaccctctcctgcagggccagtcagagtgttagcagcagctccttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcaatatggtagttttcggtacacttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgg

SEQ ID NO: 2456 - DNA, 639 bp, Artificial Sequence
  Synthetic polynucleotide encoding artificial human antibody VL chain
ccctatgagctgacacagccaccctcggtgtcagtgtccccaggacagacggccaggatcacctgctctggagatgctttgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagacgaggctgactattactgtcaatcagcagacagcagtgatacttatgtgttcggcggagggaccaagttgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2457 - DNA, 644 bp, Artificial Sequence
  Synthetic polynucleotide encoding artificial human antibody VL chain
cagaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctctcactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgg

SEQ ID NO: 2458 - DNA, 647 bp, Artificial Sequence
  Synthetic polynucleotide encoding artificial human antibody VL chain
gagaaattgtgttgacacagtcgccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagggtagcaactggttggcgctcactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2459 - DNA, 639 bp, Artificial Sequence
  Synthetic polynucleotide encoding artificial human antibody VL chain
atccagatgacccagtctccatcctccctgtctgcatctgtaggagacagagtcaccatcacttgccgggcgagtcaggccattgccaactctttagcctggtatcagcagagaccagggaaagcccctaagctcctgatctatgctgcatccagtttggaaagtggggtcccatccaggttcagcggcagtggatctgggacggattacactctcaccatcagcagcctgcagcctgaagactttgcaacctattactgtcaacagtattatattaaccctcggacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2460 - DNA, 660 bp, Artificial Sequence
  Synthetic polynucleotide encoding artificial human antibody VL chain
ggcatcgtgatgacccagtctccagactccctggctgtgtctctgggcgagagggccaccatcaactgcaagtccagccagagtgttttatacagctccaacaatgagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtacacttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgg

SEQ ID NO: 2461 - DNA, 320 bp, Artificial Sequence
  Synthetic polynucleotide encoding artificial human antibody VL chain
gacatccagatgacccagtctccatcctccctgtctgcatctgtaggagacagagtcaccatctcttgccgggcaagtcacaacattaacacctatttaaattggtatcaacacaaaccagggaaagcccctaagatcgtgatttatggtgcatccagtttgcaaagtggagtcccatcaaggttcagtggcagtggatctgggacagacttctctctcaccatcagcagtctgcagcgtgaagattttgcaacttacttctgtcaacagagtttcaacaccgtgctcactttcggcggagggaccagggtggatatcaa

SEQ ID NO: 2462 - DNA, 651 bp, Artificial Sequence
  Synthetic polynucleotide encoding artificial human antibody VL chain
cagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattatcactgcagctcatatacaatcaccagcacgctttgggtgttcggcggagggaccaagctgaccgtcctaggtcagcccaaggctgccccctcggtcactctgttcccaccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttca

SEQ ID NO: 2463 - DNA, 648 bp, Artificial Sequence
  Synthetic polynucleotide encoding artificial human antibody VL chain
cagtctgtgctgactcagccaccctcagcgtctgggacccccgggcagggggtcaccatctcttgttctggaaccagcgccaacatcggaaagaattatgtatcttggtaccagcacctcccgggaacggcccccagactcctcatctataggattgatcagcggccctcaggggtccctgaccgattctctggctccaagtctggcacctcagcctccctggccatcagtgggctccggcccgaggatgaggctgattattactgtgcagcatgggatgacagcctgagtggtccggtattcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2464 - DNA, 642 bp, Artificial Sequence
  Synthetic polynucleotide encoding artificial human antibody VL chain
gacctgcagatgacccagtctccatcctccctgtctgcatctataggagacagagtcaccatcacttgccgggcaagtcagagcattagcacttatttcaattggtatcagcagaaaccagggaaagcccctaagctcctgatctatgctgcatccagtttgcaaagtggggtcccatcaaggttcagtggcagtggatctgggacagatttcactctcaccatcaccagtctgcagcctgaagactttgcaacttactactgtcagcagacttacagtaatccttggacgttcggccaagggaccaaggtggacttcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgg

SEQ ID NO: 2465 - DNA, 644 bp, Artificial Sequence
  Synthetic polynucleotide encoding artificial human antibody VL chain
gtgacatccagatgacccagtctccgtcctccctgtctgcatctgtaggagatagagttaccatcacttgccgggcaagtcagagcattaagaactatgtaaattggtatcagcagaaaccaggagaagcccctaacctcttgatctttgctgcatccaatttgcaaagtggggtcccatcaaggttcactggcagtggatctgggacagatttctctctcaccatcagcagtctgcaacctgaagactttgcagcttactactgtcaacagacttacagtcaccctcgcacgttcggccaagggaccagggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaactctacgcctgcgaagtcacccatcagggcctgagctcgcccgtcacaaagagcttcaacaggggagagtgt

SEQ ID NO: 2466 - DNA, 651 bp, Artificial Sequence
  Synthetic polynucleotide encoding artificial human antibody VL chain
caatctgtcctgacgcagccgccctcagtgtctggggccccagggcagagggtcaccatctcctgcactgggagcagctccaacatcggggcaggttatgatgtacactggtaccagcaccttccaggaacagcccccaaactcctcatttatggtgacagccatcggccctcaggggtccctgacggattctctggctccaagtctggcacctcagcctccctggccatcactgggctccaggctgaggatgaggctgattattactgccagtcctatgacagcagcctgagtggttatgtcttcggaactgggaccaaggtcaccgtcctaggtcagcccaaggccaaccccactgtcactctgttcccgccctcctctgaggagcttcaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttca

SEQ ID NO: 2467 - DNA, 325 bp, Artificial Sequence
  Synthetic polynucleotide encoding artificial human antibody VL chain
tcctatgtgctgactcagccaccctcggtgtcagtggccccaggacagacggccaggattgcctgtgggggaaacaacattggaagtaaaactgtgcactggtaccagcagaagccaggccaggcccctatggtggtcgtctatgatgatagcgaccggccctcagggatccctgagcgattctctggctccaactctgggaacacggccaccctgaccatcagcagggtcgaagccggggatgaggccgactactactgtcaggtgtgggatagtagtagtgatcattatgtcctcggaactgggaccaaggtcaccgtcctag

SEQ ID NO: 2468 - DNA, 644 bp, Artificial Sequence
  Synthetic polynucleotide encoding artificial human antibody VL chain
gcgacatccagatgacccagtctccatcttctgtgtctgcatctgtaggggacagagtcaccatcacttgtcgggcgagtcaggatattagcaactggttagcctggtatctgcagaaaccagggaaagcccctaagctcctgatctatgctgcatccagtttgcaaagtggagtcccatccaggttcagcggcagtggatctgggacagatttcactctcaccatcagcagcctgcagcctgaagattttgcgacttactattgtcaacagactagcagtttccctcgaactttcggccctgggaccaaagtggatatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2469 - DNA, 639 bp, Artificial Sequence
  Synthetic polynucleotide encoding artificial human antibody VL chain
ccctatgagctgacacagccaccctcggtgtcagtgtccccaggacagacggccaggatcacctgctctggagatgcattgccaaacgaaaatgctttttggtaccagcagaagccaggccaggcccctgtgttggtgatatatgaggacattaagaggccctcagggatccctgagcgattctctggctccagttcagggacaacagtcacattgaccatcagtggggtccaggcagaggacgaggctgactattactgtcaatcagtagacattacttctacttgggtgttcggcggggggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttca

SEQ ID NO: 2470 - DNA, 651 bp, Artificial Sequence
  Synthetic polynucleotide encoding artificial human antibody VL chain
cagtctgccctgactcagcctccctccgtgtccgggtctcctggacagtcagtcaccatctcctgcactggaaccaccagtgacattggtagttatgaccgtgtctcctggtaccagaagcccccaggcacagcccccaaactcatcatttatgaggtcagtcatcggccctcaggggtccctgatcgcttctctgggtccaagtctggcaacacggcctccctgaccatctctgggctccaggctgaggacgaggctgattattattgcagctcatatataagtagcctcacttatgtgctgttcggcggagggaccaagctgaccgtcctgggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttca

SEQ ID NO: 2471 - DNA, 648 bp, Artificial Sequence
  Synthetic polynucleotide encoding artificial human antibody VL chain
ccctctgtgttgacgcagccgccctcagtgtctgcggccccaggacagaaggtcaccatctcctgctctggaagcagctccaacattgggaacaattatgtgtcctggtaccagcagctcccaggaacagcccccaaactcctcatttatgacaataataagcgaccctcagggatccgtgaccgattctctggctccaagtctggcacctcagccaccctgggcatcaccggactccagactggggacgaggccgactattactgcggaacatgggatagtagcctgagtgttggggtgttcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttca

SEQ ID NO: 2472 - DNA, 657 bp, Artificial Sequence
  Synthetic polynucleotide encoding artificial human antibody VL chain
ggggttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcaaggtacacactggccgatcaccttcggccaagggacacgactggagattaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgg

SEQ ID NO: 2473 - DNA, 325 bp, Artificial Sequence
  Synthetic polynucleotide encoding artificial human antibody VL chain
gaaattgtgttgacgcagtctccaggcaccctgtctttgtctccaggggaaagagccaccctctcctgcagggccagtcagagtattagaagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatgatagctcatcgtggacgttcggccaagggaccaaggtggaaatcaaac

SEQ ID NO: 2474 - DNA, 651 bp, Artificial Sequence
  Synthetic polynucleotide encoding artificial human antibody VL chain
ccctctgtgctgacgcagccgccctcagtgtctggggccccagggcagagggtcaccatctcctgctctgggagcacctccaacatcggggctggttatgatgtacactggtaccagcaatttccaggaacagcccccaaactcctcatctatggtaacatctttcggccgtcaggggtccctgaccgattctctggctccaagtctggcacctcagcctccctggccatcactgggctccaggctgaggacgaggctgcttattactgccagtcgtatgacagcagcctgagaggtgtggtgttcggcggagggacctacctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2475 - DNA, 644 bp, Artificial Sequence
  Synthetic polynucleotide encoding artificial human antibody VL chain
gtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcggacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgg

SEQ ID NO: 2476 - DNA, 660 bp, Artificial Sequence
  Synthetic polynucleotide encoding artificial human antibody VL chain
ggcatcgtgatgacccagtctccagactccctggctgtgtctctgggcgagagggccaccatcaactgcaagtccagccagaatgttttatacagttccaacaataaaaactacttaggttggtaccagcagaaaccaggacagcctcctaagttgctcatttactgggcatctacccgggaatcgggggtccctgaccgattcagtggcagcgggtctgggacagatttcactctcaccatcaacagcctgcaggctgaagatgtggcagtttattactgtcagcaatattatagcactccgtggacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgg

SEQ ID NO: 2477 - DNA, 657 bp, Artificial Sequence
  Synthetic polynucleotide encoding artificial human antibody VL chain
ccgtctgtgctgacgcagccgccctcagtgtctggggccccagggcagaaggtcaccatctcctgcactgggagcagctccaacatcggggcaggttatgatgtacactggtaccagcagcttccaggaacagcccccaaactcctcatctatcgtaacaacaatcggccctcaggggtccctgaccgattctctggctccaagtctggcacctcagcctccctggccatcactggactccagactgaggatgaggctgattattactgccagtcctatgacagcggcctgagtggttcgaaggtggtcttcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2478 - DNA, 648 bp, Artificial Sequence
  Synthetic polynucleotide encoding artificial human antibody VL chain
cattttatgctgactcagccccactctgtgtcggagtctccggggaagacggtaaccatctcctgcacccgcagcagtggcagcattgccagcagctatgtgcagtggtaccagcagcgcccgggcagttcccccaccactatgatctatgaggataaaaaaagaccctctggtgtccctgatcgcttctctggctccatcgacagctcctccaactctgcctccctcaccatctctggactgaagactgaggacgaggctgactactactgtcagtcttatgatctcagcacttgggtgttcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttca

SEQ ID NO: 2479 - DNA, 642 bp, Artificial Sequence
  Synthetic polynucleotide encoding artificial human antibody VL chain
gacatccagatgacccagtctccattctccctgtctgcatctgttggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaccagagttacagtacctctctcactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2480 - DNA, 642 bp, Artificial Sequence
  Synthetic polynucleotide encoding artificial human antibody VL chain
tcctatgtgctgactcagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggatagtagtagtgatcattgggtgttcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttca

SEQ ID NO: 2481 - DNA, 648 bp, Artificial Sequence
  Synthetic polynucleotide encoding artificial human antibody VL chain
cagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaggtattcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2482 - DNA, 644 bp, Artificial Sequence
  Synthetic polynucleotide encoding artificial human antibody VL chain
gtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctaagacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgg

SEQ ID NO: 2483 - DNA, 325 bp, Artificial Sequence
  Synthetic polynucleotide encoding artificial human antibody VL chain
gccatccagttgacccagtctccatcctccctgtctgcatctgtaggcgacagagtcatcctcacttgccgggcaagtcagggcattaacagtgccttagcctggtatcagcaaaaaccagggaaacctcctaagctcctgatttatgctgcctccagtttggaaagtggggtcccatcgaggttcagcggcagtgggtctgggacagatttcactctcaccatcagcaacctgcagcctgaagattttgcaacttatttctgtcaacagtttaatacttaccctctgtacacctttggccaggggaccaagctggatatcacga

SEQ ID NO: 2484 - DNA, 328 bp, Artificial Sequence
  Synthetic polynucleotide encoding artificial human antibody VL chain
gtttcttctgagctgactcaggaccctgctgtgtctgtggccttgggacagacagtcaggatcacatgccaaggagacagcctcagaaggtattatgcaagctggtaccagcagaaggcaggacaggcccctatacttgtcatctatggtgaaaacaaccggccctcagggatcccagaccgattctctggctccggctcaggaaacacagcttccttgaccatcactggggctcaggcggaagatgaggctgactattactgtgactcccgggacagcagtggtaacctcgtggtattcggcggagggaccaagctgaccgtcctag

SEQ ID NO: 2485 - DNA, 642 bp, Artificial Sequence
  Synthetic polynucleotide encoding artificial human antibody VL chain
gacatccagatgacccagtccccatcttccgtgcctgcatctgtaggagacagagtcaccatcacttgtcgggcgagtcagggtattaggaattggttagcctggtatcggcagagaccagggaaagcccctgagctcctaatctatgctgcatccaatttgcaatttggggtcccatcaaggttcagcggcagtggatctgggacagacttcgctctcaccatcagcagcgtgcagcctgaagattttgcaacttactattgtcaacagactaacagtttcccccggactttcggccctgggaccaaagtggatatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgg

SEQ ID NO: 2486 - DNA, 645 bp, Artificial Sequence
  Synthetic polynucleotide encoding artificial human antibody VL chain
gacatccagatgacccagtctccatcctccctgtctgcatctgtaggagacagaatcaccatcacttgccgggcaagtcagagcgttggcacctatttaagttggtttcagcagaaaccagggaaagcccctaagctcctgatttatgctgcatccagtttacaaagtggggtcccgtcaaggttcagtggcagtggatccgggacagatttcactctcaccatcagcagtctgcaacctgaagattttgcaacttacttttgtcaacagagttacagtgtccctccgtggacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgg

SEQ ID NO: 2487 - DNA, 648 bp, Artificial Sequence
  Synthetic polynucleotide encoding artificial human antibody VL chain
gaagttgtattgacgcagtctccaggcaccctgtctttgtctccaggggaaagagcgaccctctcctgcagggccagtcagagcgttagcagtaattacttagcctggtaccagcaaaaacttggccaggctcccaggctcctcatctatggtgcatccagcagggccactggcatcccagacaggttcagtggcagtgggtctgggacagacttcactctcaccatcagcagactggaggctgaagattttgcagtgtattactgtcagcaatatggtagctcacctcggtacacttttggccaggggaccaaggtggagatcagacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaactctacgcctgcgaagtcacccatcagggcctgagctcgcccgtcacaaagagcttcaacaggggagagtgg

SEQ ID NO: 2488 - DNA, 644 bp, Artificial Sequence
  Synthetic polynucleotide encoding artificial human antibody VL chain
cagaaattgtgttgacgcagtctccaggcaccctgtctttgtctccaggggaaagagccaccctctcctgcagggccagtcagagtgttagcagcaggtacttagcctggtaccagcagaaacctggccaggctcccaggctcctcatccatggtgcatccagcagggccactggcatcccagacaggttcagtggcagtgggtctgggacagacttcactctcaccatcagcagactggagcctgaagattttgcagtgtattactgtcagcagtatggtagcgcgtggacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgg

SEQ ID NO: 2489 - DNA, 645 bp, Artificial Sequence
  Synthetic polynucleotide encoding artificial human antibody VL chain
gaaattgtgttgacacagtctccagccaccctgtccttgtctccaggggaaagagccaccctctcctgcagggccagtcagagtgttggcagctccttagcctggtaccaacagaaacctggccaggctcccaggctcctcatctttgattcatccaacagggccactgccatcccagccaggttcactggcagtgggtctgggacagacttcactctcaccatcagcagcctagagcctgaagattttgcagtttattactgtcagcagcgtgccaactggcctcctatcaccttcggccaagggacacgactggacattagacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2490 - DNA, 644 bp, Artificial Sequence
  Synthetic polynucleotide encoding artificial human antibody VL chain
gtgacatccagatgacccagtctccttccaccctgtctgcatctgtaggagacagagtcaccatcacttgccgggccagtcagagtattagtagctggttggcctggtatcagcagaaaccagggaaagcccctaagctcgtgatctataaggcatctagtttaaaaagtggggtcccatcaaggttcagcggcagtggatctgggacagagttcactctcaccatcagcagcctgcagcctgatgattttgctacttattactgccaacagtataatagttacccgtggacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgg

SEQ ID NO: 2491 - DNA, 645 bp, Artificial Sequence
  Synthetic polynucleotide encoding artificial human antibody VL chain
ccctatgtgctgactcagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggatagtagtagtgatcattatgtggtattcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttca

SEQ ID NO: 2492 - DNA, 327 bp, Artificial Sequence
  Synthetic polynucleotide encoding artificial human antibody VL chain
gagaaattgtgttgacacagtctccagccaccctgtctttgtctccaggggaaagagccaccctctcctgcagggccagtcagagtgttagcacctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctccgctcactttcggcggagggaccaaggtggagatcgaac

SEQ ID NO: 2493 - DNA, 659 bp, Artificial Sequence
  Synthetic polynucleotide encoding artificial human antibody VL chain
gggatattgtgatgactcagtctccactctccctgcccgtcacccctggagagccggcctccatctcctgcaggtctagtcagagcctcctgcatagtaatggatacaactatttggattggtacgtgcagaagccagggcagtctccacagctcctgatctatttggggtctaatcgggcctccggggtcactgacaggctcagtggcagtggatcaggcacagatttcacactggaaatcggcagagtggaggctgaggatgttggggtttattactgcatgcaagctctacaaactccctacacttttggccaggggaccaagctggagatcagacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2494 - DNA, 641 bp, Artificial Sequence
  Synthetic polynucleotide encoding artificial human antibody VL chain
gtgacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttattcgacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgg

SEQ ID NO: 2495 - DNA, 333 bp, Artificial Sequence
  Synthetic polynucleotide encoding artificial human antibody VL chain
ctcagactgtggtgacccaggagccgtcggtctcagtgtcccctggagggacagtcacactcacttgtggcttgaggtctggctcagtctcaactggaaactaccccagctggtaccagcagaccccaggccaggctccacgcactctcatctacaacattaatactcggtcgtccggggtccctcatcgcttctctgcctccattattgataacagagctgccctcaccatcacgggggcccagtcagatgatgaatctctttattactgtttgctatatatgggcagtggcatttcggttttcggcggagggaccaaggtgaccgtcttag

SEQ ID NO: 2496 - DNA, 648 bp, Artificial Sequence
  Synthetic polynucleotide encoding artificial human antibody VL chain
gaaattgtcttgacgcagtctccaggcaccctgtcttcgactctaggtgaaagagccaccctctcctgcagggccagtcagagtgttagcagcagctacttagcctggtaccaacagaaacctggccaggctcccaggctcctcatctatggtgcatcccgcagggccactggcatcccagacaggttcagtggcagtgggtctgggacagacttcactctcaccatcagcagactggagcctgaagattttgcagtgtattactgtcagcactatggtgcctcaccgccgtggacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2497 - DNA, 645 bp, Artificial Sequence
  Synthetic polynucleotide encoding artificial human antibody VL chain
ccctatgtgctgactcagccaccctcggtgtcagtggccccaggacagacggccagaattacctgtgggggaaacaacattggaagtaagagtgtgcactggtaccagcagaagccaggccaggcccctgtgatggtcgtctatgctgatagagagcggccctcagggatccccgagcgactctctggctccaactttgggaacacggccaccctgaccatcagcagggtcgaagccggggatgaggccgactattactgtcaggtgtgggatagtaataatgatcaccgggaggtgttcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttca

SEQ ID NO: 2498 - DNA, 642 bp, Artificial Sequence
  Synthetic polynucleotide encoding artificial human antibody VL chain
gacatccagatgacccagtctccttccaccctgtctgcatctgtaggagacagagtcaccatcacttgccgggccagtcagagtattagtaggtggttggcctggtatcagcagaaaccagggaaagcccctaaactcctgatctataaggcgtctgctttagaaagtggggtcccatcaaggttcagcggcagtggatctgggacagaattcactctcaccatcagcagcctgcaacctgatgattttgcaacttattactgccaacagtatgatagttatcctctctctttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgg

SEQ ID NO: 2499 - DNA, 642 bp, Artificial Sequence
  Synthetic polynucleotide encoding artificial human antibody VL chain
gcaacgacactcacgcagtctccagcattcatgtcagcgactccaggagacagagtcaacatctcctgcaaagccagccaagacattgatgatgatatgaactggtaccaacagaaaccaggagaagctgctattttcattattcaagaagctactactctcgttcctggcgtcccacctcgattcagtggcagcgggtatgggacagattttaccctcacaattaataacatagaatctgaggatgctgcatattacttctgtctacaacatgataatttcccgtacacttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgg

SEQ ID NO: 2500 - DNA, 645 bp, Artificial Sequence
  Synthetic polynucleotide encoding artificial human antibody VL chain
gaaattgtgttgacgcagtctccaggcaccctgtctttgtctccaggggaaagagccatcctctcctgcagggccggtcagagtattggcgccgcctacttagcctggtaccaacagaaacctggccaggctcccagactcctcatctctggtgcatccaggagggccactggcatcccagacaggttcagtggcagtgggtctgggacagacttcactctcaccatcagcagactagagcctgaagattttgcagtgtattactgtcagcaatacggcagttcaccgctcaccttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2501 - DNA, 642 bp, Artificial Sequence
  Synthetic polynucleotide encoding artificial human antibody VL chain
ctctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctatgaggacagcaaacgaccctccgggatccctgagagattctctggctccagctcagggacaatggccaccttgactatcagtggggcccaggtggaggatgaagctgactactactgttactcaacagacagcagtggtaatcatggggtgttcggcggagggaccaagctgaccgtcctaggtcagcccaaggctgccccctcggtcactctgttcccaccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttca

SEQ ID NO: 2502 - DNA, 659 bp, Artificial Sequence
  Synthetic polynucleotide encoding artificial human antibody VL chain
gggatattgtgatgactcagtctccactctccctgcccgtcacccctggagagccggcctccatctcctgcaggtctagtcagagcctcctgcatagtgatggatacaactatttggattggtacctgcagaagccagggcagtctccacagctcctgatctacttgggttctaatcgggcctccggggtccctgacaggttcagtggcagtggatcaggcacagattttacactgaaaatcagcagagtggaggctgaggatgttggggtttattactgcatgcaagctctacaaactcctaacacttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2503 - DNA, 651 bp, Artificial Sequence
  Synthetic polynucleotide encoding artificial human antibody VL chain
cagtctgccctgactcagcctgcctccgtgtctgggtctcctggacagtcgatcaccatctcctgcactggaaccagcagtgacgttggtggttataactatgtctcctggtaccaacaccacccagacaaagcccccaaactcataatttatgaggtcaagaatcggccctcaggggtttctaatcgcttctctggctccaagtctgacaacacggcctccctgaccatctctgggctccaggctgaggacgaggctgattattactgcaactcatattcaagcagcagcactctttatgtcttcggaactgggaccaaggtcaccgtcctaagtcagcccaaggccaaccccactgtcactctgttcccgccctcctctgaggagctccaagccaacaaggccacactagtgtgtctgatcagtgacttctacccgggagctgtgacagtggcctggaaggcagatagcagccccgtcaaggcgggagtggagaccaccaaaccctccaaacagagcaacaacaagtacgcggccagcagctacctgagcctgacgcctgagcagtggaagtcccacagaagctacagctgccaggtcacgcatgaagggagcaccgtggagaagacagtggcccctacagaatgttca

SEQ ID NO: 2504 - DNA, 647 bp, Artificial Sequence
  Synthetic polynucleotide encoding artificial human antibody VL chain
gagaaattgtgttgacgcagtctccagccaccctgtctttgtctccaggggaaagagccaccctctcctgcagggccagtcagagtattagcagtaacttagcctggtaccaacagaaacctggccaggctcccaggctcctcatctatgatgcatccaacagggccactggcatcccagccaggttcagtggcagtgggtctgggacagacttcactctcaccatcagcagcctcgagcctgaagattttgcagtttattactgtcaacaacatagcaactggcctgagctcactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2505 - DNA, 648 bp, Artificial Sequence
  Synthetic polynucleotide encoding artificial human antibody VL chain
gcctctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcgtatagaagcagcggcgtttatgtcttcggaactgggaccaaggtcaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttca

SEQ ID NO: 2506 - DNA, 657 bp, Artificial Sequence
  Synthetic polynucleotide encoding artificial human antibody VL chain
caagttgtgatgacccagactccactctctctgtccgtcacccctggacagccggcctccatctcctgcaagtctagtcagcgcctcctgcatagtgatggaaagacctatttgtattggtacctgcagaagccaggccagtctccacagctcctgatctatgaagtttccaaccggttctctggagtgccagataggttcagtggcagcgggtcagggacagatttcacactgaaaatcagccgggtggaggctgcggatgttggggtttattactgcatgcaaagtatacaccttccgtacacttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgg

SEQ ID NO: 2507 - DNA, 648 bp, Artificial Sequence
  Synthetic polynucleotide encoding artificial human antibody VL chain
gaaattgtgttgacgcagtctccaggcaccctgtctttgtctccaggggaaagagccaccctctcctgcagggccagtcagagtgtcagcagtagcttcttggcctggtaccagcagaaacctggccaggctcccagactcctcatctatggcgcatccagcagggccactggcgtcgcagacaggttcagtggcagtgggtctgggacagacttcactctcaccatcaacagactggagcctgaagattttgcagtgtattactgtcaccagtatggtggctcacctccaaacacttttggccaggggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2508 - DNA, 645 bp, Artificial Sequence
  Synthetic polynucleotide encoding artificial human antibody VL chain
gacatccagttgacccagtctccatccttcctgtctgcatctgtaggagacagagtcaccatcacttgccgggccagtcaggacgttgacacttatttagcctggtatcagcaaaaaccagggaaagcccctaagctcctgatctatgctgcatccactttgcacagtggggtcccatcaaggttcagcggcagtggagctgggacagaattcactctcacaatcagcagcctgcagcctgaagattttgcaacttattattgtcaacaacttaatagttaccctccactcactttcggcggggggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2509 - DNA, 648 bp, Artificial Sequence
  Synthetic polynucleotide encoding artificial human antibody VL chain
cagtctgtgttgacgcagccgccctcattatctgcggccccaggacagaaggtcataatctcctgctctggaagcagctccaatattgggaaatattctgttttctggtaccagcaagtcccaggaacaggccccaaactcctcatttttgacaataacagacgaccctctgggatccgtgaccgattctctgcctccaagtctggcacgtcagccaccctggagatcaccggcctccagactggggacgaggcacattattactgcgcaacatgggatagcagcctgactgctggggtgttcggcggagggaccaaactgaccgtcctacgtcagcccaaggctgccccctcggtcactctgttcccaccctcctctgaggagcttcaagccaacaaggccacactggtgtgtctcataagtgacttctacccgggagccgtgacagtggcctggaaggcagatggcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttca

SEQ ID NO: 2510 - DNA, 644 bp, Artificial Sequence
  Synthetic polynucleotide encoding artificial human antibody VL chain
gagaaattgtgttgacacagtctccagccaccctgtccttgtctccaggaaatagagccgccctctcctgcagggccagtcagagtgttggtagctccttacactggtatcaacagaaacctggccaggcccccaggctcctcatctatgatgtgtccaacagggccgctggcatcccaggcaggttcagtgccagtgggtctgggacagacttcactctcaccatcagcaacctagagcctgaagattttgcagtttattactgtcagcagcgtagcgcctggcctatcactttcggccaagggacacgactggagattaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2511 - DNA, 650 bp, Artificial Sequence
  Synthetic polynucleotide encoding artificial human antibody VL chain
gagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctctggtgcatccagcagggccactggcatcccagacaggttcagtggcagtgggtctgggacagacttcactctcaccatcagcagactggagcctgaagattttgcagtgtattactgtcagcagtatggtagctcacggaagctcactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2512 - DNA, 322 bp, Artificial Sequence
  Synthetic polynucleotide encoding artificial human antibody VL chain
gacatccagatgacccagtctccttccaccctgtctgcatctgtaggagacagagtcaccatcacttgccgggccagtcagagtattagtgtctggttggcctggtatcaacagaaaccagggaaagcccctaaactcctgatctataaggcgtctactttagaagctggggtcccatcgaggttttccggcagcggatctgggacagaattttctctcactatcagcggcctacagcctgatgactttggaacttatttctgtcaacactatgacagttatccgtggacgttcggccaagggaccaaggtggagatgaaac

SEQ ID NO: 2513 - DNA, 645 bp, Artificial Sequence
  Synthetic polynucleotide encoding artificial human antibody VL chain
gtttcttccgagctgactcaggaccctgctgtgtctgtggccttgggacagacagtcaggatcacatgccaaggagacagtctcagaaggtattatgtaagctggtaccggcagaagccaggagaggcccctgtagttgtcatctatggtaaaaacaatcggccctcatggatcccagaccgactctctggctccagttcaggaaacacagcttccttgaccatcactggggctcaggcggaagatgaggctgactattactgttgttcccgggacagcagtggtaacccttgggtattcggcggagggaccaagctgaccgtcctaggtcagcccaaggctgccccctcggtcactctgttcccaccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttca

SEQ ID NO: 2514 - DNA, 642 bp, Artificial Sequence
  Synthetic polynucleotide encoding artificial human antibody VL chain
gtcatccagatgacccagtctccaacctccctgtctgcatctgtaggagacagagtcaccatcacttgccgggcaagtcagagcattagcagctatttaaattggtatcagcagaaactagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagcacgtcgctcactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2515 - DNA, 653 bp, Artificial Sequence
  Synthetic polynucleotide encoding artificial human antibody VL chain
gagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatgatgcatccagcagggccgctggcgtcccagacaggttcagtggcagtgggtctgggacagacttcactctcaccatcagcagactggagcctgaagattttgcagtgtatttctgtcagcagtatgatagctcacctcccatgtacacttttggccaggggaccaagctggagatcagacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2516 - DNA, 651 bp, Artificial Sequence
  Synthetic polynucleotide encoding artificial human antibody VL chain
ccgtctgtgttgacgcagccgccctcagtgtctgcggccccaggacagaaggtcaccatctcctgctctggaagcagctccaacattgacaataattatgtatcctggtaccagcagctcccaggaacagcccccaaactcctcatctatgaaaataataagcgagcctcagggattcctgaccgattctctggctccaagtctggcacgtcagccaccctgggcatcaccggactccagactggggacgaggccgattattactgcggaacatgggatagcagcctgagtcctgggggggtattcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2517 - DNA, 641 bp, Artificial Sequence
  Synthetic polynucleotide encoding artificial human antibody VL chain
gtgacatccagatgacccagtctccatcctccctgtctgcatctgtaggagacagagtcaccatcacttgccgggcaagtcagaccattagcacctacttaaattggtatcagcagaaaccagggaaagcccctaagctcctgatctatgctgcatccagtttacagagtggggtcccatcaaggttcagtggcagtggatctgagacagatttcactctcaccatcagcagtctgcaacctgaagattttgcaacttactactgtcaacagagttacaatgcccggacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2518 - DNA, 665 bp, Artificial Sequence
  Synthetic polynucleotide encoding artificial human antibody VL chain
gggacatcgtgatgacccagtctccagactccctggctgtgtctctgggcgagagggccaccatcaactgcaagtccagccagactgttttacacagttccaacaataggaactacttagcttggtatcagcacaaaccaggccagcctcctaagctgctcatttactgggcttctacccgggaatccggggtccctgaccgattcagtggcagcgggtctgggacagatttcactctcaccatcaacagccttcaggctgaagatgtggctgtttattactgtcagcaatattatgatactgctccgctcactttcggcggcgggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2519 - DNA, 642 bp, Artificial Sequence
  Synthetic polynucleotide encoding artificial human antibody VL chain
gaaatagtgatgacgcagtctccagccaccctgtctgtgtctccaggggaaagggccaccctctcctgcagggccagtcagagtgttgacggcaacttagcctggtaccaacagaaacctggccaggctcccaggctcctcatctttgacgcatctaccagggccactactatcccagtcaggttcagtggcagtgggtctgggacagagttcactctcaccatcagcagcctgcagtctgaagattttgcagtttattactgtcagcagtatagtaaatggcccatcaccttcggccaagggacacgactggagattaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaactctacgcctgcgaagtcacccatcagggcctgagctcgcccgtcacaaagagcttcaacaggggagagtgt

SEQ ID NO: 2520 - DNA, 644 bp, Artificial Sequence
  Synthetic polynucleotide encoding artificial human antibody VL chain
gtgacatccagatgacccagtctccatcctccctgtctgcatctctaggagacagaatcaccatcacttgccgggcaactcagagcattagcaactatttaaattggtatcaacaaaaatcagggaaagtccctgaacttctgatttatgctgcatcccatttgcaaagtggggtcccatcaaggttcagtggcactggatctgggacagacttcagtctcacaatcagcggtctgcagcctgaagattttgcaacttactactgtcaacagacttacactacccctaggacgttcggccgagggaccacggtggagatcagacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2521 - DNA, 651 bp, Artificial Sequence
  Synthetic polynucleotide encoding artificial human antibody VL chain
ccgtctgtgctgacgcagccgccctcagtgtctggggccccaggacagagggtcaccatctcctgcactgggagcagctccaacatcggggcaggttatgatgtacactggtaccagcagcttccaggaacagcccccaaactcctcatctatggtaacatcaatcggccctcaggggtccctgaccgattctctggctccaagtctggcccctcagcctccctgaccatcactgggctccaggctgacgatgaggctgattattactgccagtcctatgacagccgcctgagtggtgtggtattcggcggggggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2522 - DNA, 642 bp, Artificial Sequence
  Synthetic polynucleotide encoding artificial human antibody VL chain
gaaatagtgatgacgcagtctccagccaccctgtctgtgtctccaggggagagagccaccctctcctgcagggccagtcagagtgtgagcaccaacttagcctggtaccagcagagacctggccaggctcccaggctcttcatctttggtgcatccaccagggccactggtatcccagccaggttcagtggcagtgggtctgggacagagttcactctcaccatcagcagcccgcagcctgaagactctgcagtttattactgtcagcagtatactaccaggcctctcactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2523 - DNA, 644 bp, Artificial Sequence
  Synthetic polynucleotide encoding artificial human antibody VL chain
gcgaaattgtgttgacacagtctccagccaccttgtctttgtctccaggggaaggagccaccctctcctgcagggccagtcagagtgtgagtggctacttagcctggtaccaacagaaacctggccaggctcccaggctcctcatctatgacgcatccaacagggccactggcatccctgccaggttcagtggcagtgggtctgggacagacttcactctcaccatcagcagcctagagcctgaagattttgcagtttattactgtcaacagcggagcaagtggcctctcactttcggcggagggacccaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaactctacgcctgcgaagtcacccatcagggcctgagctcgcccgtcacaaagagcttcaacaggggagagtgt

SEQ ID NO: 2524 - DNA, 651 bp, Artificial Sequence
  Synthetic polynucleotide encoding artificial human antibody VL chain
cagtctgtggtgactcaaccaccctcagcgtctgggccccccgggcagacagtcaccatctcttgttctggaggcaggtccaacgtcgccagtcatgctgtacattggtaccagcatctcccgggaacggcccccaaactcctcatctataatgatcatcagcggccctccggggtccctgaccgattctctggctccaagtctggcccttcagcctccctggccatcagtggcctccggtccgaagatgaggctgattattactgtgcaacatgggatgacagcctgggtggccgtgtggttttcggcggagggaccaaattgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2525 - DNA, 660 bp, Artificial Sequence
  Synthetic polynucleotide encoding artificial human antibody VL chain
gatattgtgatgacccagactccactctccatgcccgtcacccctggagagccggcctccatctcctgcaggtctagtcagagcctcttggacagtgatgatggaaaaacctatttggactggtacctgcagaagccagggcagtctccacagctcctgatctatacggtttcctatcgggcctctggagtcccagacaggttcagtggcagtgggtcaggcactgatttcacactgaaaatcagcagggtggaggctgaggatgttggagtttattactgcatgcaacgtatagagtttcctttcactttcggccctgggaccaaagtggatatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2526 - DNA, 319 bp, Artificial Sequence
  Synthetic polynucleotide encoding artificial human antibody VL chain
tcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcagcactgcggtattcggcggagggaccaagctgaccgtcctag

SEQ ID NO: 2527 - DNA, 636 bp, Artificial Sequence
  Synthetic polynucleotide encoding artificial human antibody VL chain
ccctatgaactgactcagccaccctcagtgtccgtgtccccaggacagacagccaacatcacctgttctggagataaattgggggatatatgtgtttgctggtatcagcagaagccaggccagtcccctgtgttggtcatctatcaacataacaagcggccctcagggatccctgagcgattctctggctccaactctggcaacacagccacgctgaccatcagcgcgacccaggctacggatgaggctatctattactgtcagtcgtgggacagtagttctgtgctattcggcggagggaccaagctgaccgtcctcggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2528 - DNA, 660 bp, Artificial Sequence
  Synthetic polynucleotide encoding artificial human antibody VL chain
ggcatcgtgatgacccagtctccagactccctgggtgtgtctctgggcgagagggccaccatcaactgcaagtccagccagagtcttttctatagctccaacaataagaactacttagcttggtaccagcagaaaccagggcagcctcctaaactgctcatttactgggcatctacccgggaatccggggtccctgaccgattcagtggcagcgggtctgggacagatttcactctcaccatcagcagcctgcaggctgaagatgtggcagtttattactgtcagcaatattatggtcgtctattcactttcggccctgggaccaaagtggatatcagacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2529 - DNA, 648 bp, Artificial Sequence
  Synthetic polynucleotide encoding artificial human antibody VL chain
caaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcggtgggtctgagacagacttcactctcaccatcagcagcctagagcctgaagattttgcagtttattactgtcagcagcgtagcaactggcctccgaggctccctttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2530 - DNA, 645 bp, Artificial Sequence
  Synthetic polynucleotide encoding artificial human antibody VL chain
caaattgtgttgacacagtctccagccaccctgtctttgtctccaggggaaagagccaccctctcctgcagggccagtcagagtgttagcaactatttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctccgtacacttttggccaggggaccaagctggacatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2531 - DNA, 657 bp, Artificial Sequence
  Synthetic polynucleotide encoding artificial human antibody VL chain
gatattgtgatgactcagtctccactctccctgcccgtcacccctggagagccggcctccatctcctgcaggtctagtcagagcctcctacagagtaatggaaacaactatttggcttggtacctgcagaagccagggcagtctccacaactcctgatctatttgggttctaatcgggcctccggggtccctgacaggttcagtggcagtggatcaggcacagattttacactgaaaatcagcaaattggcggctgaggatgttggggtttattactgcatgcaagctctacaaactccgtacacttttggccaggggaccaagctggacatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2532 - DNA, 642 bp, Artificial Sequence
  Synthetic polynucleotide encoding artificial human antibody VL chain
gacatccagatgacccagtctccttccaccctgtctgcatctgtaggagacagagtcaccatcacttgccgggccagtcagagtattagtggctggttggcctggtatcagcagaagccagggaaagcccctcaactcctgatctatttggtgtctagtttagaaagtggggtcccgtcaaggtttagcggcagtggatctgggacagaattcactctcaccatcagcagcctgcagcctgatgattttgcaacttattactgccaacactatgatagttatattggaacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaactctacgcctgcgaagtcacccatcagggcctgagctcgcccgtcacaaagagcttcaacaggggagagtgt

SEQ ID NO: 2533 - DNA, 648 bp, Artificial Sequence
  Synthetic polynucleotide encoding artificial human antibody VL chain
cagtctgtgttgacgcagccgccctcagtgtctgcggccccaggacagaaggtcaccatctcctgctctggaggcagctccaacattggaaataattatgtatcctggtaccagcagctcccaggaacagcccccaaactcatcatttatgacaatgataaacgacccgcagggattcctgaccgattctctggctccaagtctggttcgtcagccaccctgggcatcaccggactccagaatggggacgaggccgagtattattgcggaacatgggatagcagtttgggtggcggagtgttcggcggagggaccaaggtgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacggaatgttca

SEQ ID NO: 2534 - DNA, 645 bp, Artificial Sequence; identical to SEQ ID NO: 2530
  Synthetic polynucleotide encoding artificial human antibody VL chain

SEQ ID NO: 2535 - DNA, 337 bp, Artificial Sequence
  Synthetic polynucleotide encoding artificial human antibody VL chain
ggaattgtgatgactcagtctccactctccctgcccgtcacccctggagagacggcctccatctcctgtaggtctagtcagagcctccttcgtcgtgatggaaacaactatttggagtggtacctgcagaaaccagggcagcctccacacctcctgatctatttgggttctattcgggcctccagagtccctgacaggttcagtggcactgggtcagggacagacttcacactgataatcagcagagtggaggctgacgatgttggcgtttattactgcatggaagctgaacaaactccggggacttttggccaggggaccaagctggagatcaaac

SEQ ID NO: 2536 - DNA, 648 bp, Artificial Sequence
  Synthetic polynucleotide encoding artificial human antibody VL chain
cagtctgccctgactcagcctgcctccgtgtctgggtctcctggacagtcgatcaccatctcctgcactggaaccagcagtgacgttggtggttttaactatgtctcctggtaccaacaacacccaggcaaagcccccaaactcctgatttatgatgtcagtgagcggccctcaggggtttctagtcgcttctctggctccaagtctggcaacacggcctccctgaccatctctgggctccaggctgaggacgaggctgattattactgcagctcatatacaagcagcaccactgtgcttttcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttca

SEQ ID NO: 2537 - DNA, 660 bp, Artificial Sequence
  Synthetic polynucleotide encoding artificial human antibody VL chain
ggggttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctccgatcaccttcggccaagggacacgactggagattaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2538 - DNA, 642 bp, Artificial Sequence
  Synthetic polynucleotide encoding artificial human antibody VL chain
gacatccagatgacccagtctccatcctccctgtctgcatctgtaggagacagagtcaccatcacttgccgggcaagtcagagtattagcagctatttaaattggtatcagcagaaaccagggaaagcccctaagctcctgatctatgctgcatccagtttgcaaagtggggtcccatcaaggttcagtggcagtggatctgggacagatttcactctcgccatcagcagtctgcaacctgaagattttgcaacttactactgtcaccagacttacagtacccggctcactttcggcggagggaccgaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2539 - DNA, 644 bp, Artificial Sequence
  Synthetic polynucleotide encoding artificial human antibody VL chain
gtgacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggcagtggatctgggacagatttcactctcaccatcagcagcctgcagcctgaagattttgcaacatattactgtcaacagtatgataatctcccgctcactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2540 - DNA, 642 bp, Artificial Sequence
  Synthetic polynucleotide encoding artificial human antibody VL chain
tcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatagcagtagtgatccttgggtgttcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttca

SEQ ID NO: 2541 - DNA, 647 bp, Artificial Sequence
  Synthetic polynucleotide encoding artificial human antibody VL chain
gtgacatccagttgacccagtctccatccttcctgtctgcatctgtaggagacagagtcaccatcacttgccgggccagtcaggtcattagcgattatgtagcctggtatcagcaaaaaccagggaaagcccctaagctcctgatctatgctgcatccactttgcaaagtggggtcccatctaggttcagcggcagtggatctgggacagaattcactctcacaatcagcagcctgcagtctgaagattttgcaacttattactgtcaacaactgaatagttaccctccggtcaccttcggccaagggacacgactggacattaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2542 - DNA, 644 bp, Artificial Sequence
  Synthetic polynucleotide encoding artificial human antibody VL chain
gtgacatccagatgacccagtctccatcctccctgtctgcatctgtaggagacagagtcaccatcacttgccgggcaagtcagagcattagcacttatttaaattggtatcagcagaaaccagggaaagcccctaagctcctgatctatgttgcatccagtttgcaaagtggggtcccatcaaggttcagtggcagtggatctgggacagatttcactctcacaatcagcggtctgcaacctgaagattttgcaacttactactgtcaacagagttacagtaccccgtacacttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2543 - DNA, 647 bp, Artificial Sequence
  Synthetic polynucleotide encoding artificial human antibody VL chain
gtgacatccagatgacccagtctccttccaccctgtctgcatctgtaggagacagagtcaccatcacttgccgggccagtcagagaattagtaactggttggcctggtatcagcagacaccagggaaagcccctaagctcctgatctataaggcgtccagtttagaaagtggggtcccatcaaggttcagcggcagtggatctgggacagaattcactctcaccatcagcagcctgcagcctgatgattttgcaacttattactgccaacagtatagtagttcttctccaagaacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2544 - DNA, 337 bp, Artificial Sequence
  Synthetic polynucleotide encoding artificial human antibody VL chain
gatattttgatgacccagactccactctctctgtccgtcacccctggacagccggcctccatctcctgcaagtctagtcagagcctcctgaatcctgatggaaagacctatttgtattggtacctgcagaagtcaggccagcctccacagctcctgatctatgaactttccaaccgcttctctggagtgccagataggttcagtggcagcgggtcagggacagatttcacactgaagatcagccgggtggaggctgaggatattggagtttatttctgcatgcaaagtttacaacttccgattaccttcggccaagggacacgactggagattaaac

SEQ ID NO: 2545 - DNA, 647 bp, Artificial Sequence
  Synthetic polynucleotide encoding artificial human antibody VL chain
gtgacatccagatgacccagtctccatcctccctgtctgcatctgtaggagacagagtcaccatcacttgccgggcaagtcagagcattagcggctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccgtttactcactttcggccctgggaccaaagtggatatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2546 - DNA, 651 bp, Artificial Sequence
  Synthetic polynucleotide encoding artificial human antibody VL chain
cagtctgtgctgacgcagccgccctcagtgtctggggccccagggcagagggtcaccatctcctgcactgggagtagctccaacgtcggggcagattatgatgtgcactggtaccagcagcttccaggaacagcccccaaactcctcatctatggtaacagaaatcggccctcaggggtccctgaccgattctctggctccaagtctggcacctcagcctccctggccatcactgggctccaggctgaggatgaggctgattattactgccagtcctttgacagcagcctgagaggttatgtcttcggaactgggaccaaggtcaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttca

SEQ ID NO: 2547 - DNA, 648 bp, Artificial Sequence
  Synthetic polynucleotide encoding artificial human antibody VL chain
gaaattgtattgacccagtctccagacaccctgtctttgtctccaggggaaagagccaccctctcctgcagggccagtcagagtgttagcagctccttagcctggtaccaacagaaacctggccaggctccccgactcctcatctattatgcatccaacagggccactgacatcccagccaggttcagtggcagtgggtctgggacagacttcactctcaccatcagcagcctagagcctgaagattttgcactttattactgtcagcaccgtatcacctggcctcccctgatcaccttcggccaagggacacgactggagattaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2548 - DNA, 645 bp, Artificial Sequence
  Synthetic polynucleotide encoding artificial human antibody VL chain
gaaattgtgttgacgcagtctccaggcaccctgtctttgtctccaggggaaagagccaccctctcctgcagggccagtcagagttttgacggcaagtccttagcctggtaccagcagaaacctggccagactccccgcctcctcgtctatggcgcgtccagcagggccactggcatcccagacaggttcggtggcagtgggtctgggacagacttcactctcaccatcagcagactggagtctgaagattttgcagtgtatttctgtcagcaatatgcttatgtaccgatcaccttcggccaagggacacgactggagcgtaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2549 - DNA, 660 bp, Artificial Sequence
  Synthetic polynucleotide encoding artificial human antibody VL chain
ggcatcgtgatgacccagtctccagactccctggctgtgtctctgggcgagagggccaccatcaactgcaagtccagccagagtattttatacagctccaacaataaggactccttagcttggtaccagcagaaaccaggacagcctcctaaacttctcatttcctcggcatctacccggcaatccggggtccctgaccgattcagtggcagcgggtctgggacagatttcaccctcaccatcagcagcctacaggctgaagatgtggcagtttattactgtcagcaatattatagtattcccctcactttcggccctgggaccaaagtggatatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgg

SEQ ID NO: 2550 - DNA, 325 bp, Artificial Sequence
  Synthetic polynucleotide encoding artificial human antibody VL chain
gaaattgtgttgacgcagtctccaggcaccctgtctttgtctctaggggaaagagccaccctctcctgcagggccagtcagagtgttagcggcagccacttagcctggtatcagcagaaacctggccaggctcccaggctcctcatctatgatgcatccagcagggccactggcatcccagacaggttcagtggcagtgggtctgggacagagttcactctcaccatcagcagactggagcctgaagattttgcagtgtattactgtcagcagtatggtagctcacccctgtggttcggccaagggaccaaggtggaaatcaaac

SEQ ID NO: 2551 - DNA, 648 bp, Artificial Sequence
  Synthetic polynucleotide encoding artificial human antibody VL chain
cagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttca

SEQ ID NO: 2552 - DNA, 642 bp, Artificial Sequence
  Synthetic polynucleotide encoding artificial human antibody VL chain
ccctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctatgaggacagcaaacgaccctccgggatccctgagagattctctggctccagctcagggacaatggccaccttgactatcagtggggcccaggtggaggatgaagctgactactactgttactcaacagacagcagtggtaatcatagggtgttcggcggagggaccaagctgaccgtcctaggtcagcccaaggctgccccctcggtcactctgttcccaccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttca

SEQ ID NO: 2553 - DNA, 645 bp, Artificial Sequence
  Synthetic polynucleotide encoding artificial human antibody VL chain
gaaatagtgatgacgcagtctccagccaccctgtctgtgtctccaggggaaacagccaccctctcctgcagggccagtcagagtgttagcagcaacttagcctggtaccagcagaaacctggccaggctcccaggctcctcatgtatggtgcatccaccagggccactagtgtcccagccaggttcagtggcagtgcgtctgggacagatttcactctcaccatcagcagcctgcagtctgaagattttgcactttattactgtcagcagtataataactggcctcagtacacttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgg

SEQ ID NO: 2554 - DNA, 651 bp, Artificial Sequence
  Synthetic polynucleotide encoding artificial human antibody VL chain
gaaattgtgttgacgcagtctccaggcaccctgtctttgtctccaggggagagagccaccctctcctgcagggccagtcagagtgttagcagcagctacttagtctggtaccaacaaaaagctggccaggctcccaggctcctaatctatggtgcatccagcagggccactggcatctcagacaggttcagtggcagtgggtctgggacagacttcactctcaccatcagcagactggagcctgaagattttgcagtgtattactgtcagcactttcgtagctcacctcccacgtacacttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2555 - DNA, 648 bp, Artificial Sequence
  Synthetic polynucleotide encoding artificial human antibody VL chain
cagtctgccctgactcagcctgcctccgtgtctgggtctcctggacagtcgatcaccatctcctgcactggaaccagcagtgacgttggtctttataactttgtctcctggtatcaacaacacccaggcaaagcccccaaactcatgatttttgatgtcaataatcggccctcaggggtttctaatcgcttctctggctccaagtctgacaacacggcctccctgaccatctctggcctccaggctgaggacgaggctgattattactgcagctcatattcaaggaccaccactctcgtattcggcggagggaccaaggtgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccatcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2556 - DNA, 654 bp, Artificial Sequence
  Synthetic polynucleotide encoding artificial human antibody VL chain
ccagctgtactgacgcagccgccctcagtttctggggccccagggcagagggtcaccatctcctgcactgggagcaactccaacatcggggcaggttattatgtacactggtaccagcaccgtccaggagcagcccccaaacgcctcatctatgcagacagcgatcgcccctcaggagtccctgaccgattctctggctccaggtctggcacctcagcctccctggccatcactgggctccaggctgaggatgaggctgattattactgccagtcctatgacagcggcctgagtgctccttgggtgttcggcggagggaccaagttgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttca

SEQ ID NO: 2557 - DNA, 645 bp, Artificial Sequence
  Synthetic polynucleotide encoding artificial human antibody VL chain
gaaattgtgctgacgcagtctccaggcaccctgtctttgtctccaggacaaagagccaccctctcctgtagggccagtcagagtgttaccagcagctacttagcctggtaccagcagaaacctggccaggctcccaggctcctcatctatgctgcatccagcagggccactggcaccccagacaggttcagtggcagtgggtctgggacagacttcactctcaccatcagcagactggagcctgaggattttgcagtgtattcctgtcagcaatatggtaactcacctcccactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2558 - DNA, 331 bp, Artificial Sequence
  Synthetic polynucleotide encoding artificial human antibody VL chain
ccgtctgtgctgactcagccactctcagcgtctgggacccccgggcagagggtcaccatctcttgttctggaagcagctccaacatcggagataattttgtttattggtatcagcaattcccgggaacggcccccaaagtcctcatctttaaaaataatcagcggccctcaggggtccctgaccgattcttcggctccaagtctggcacctcagcctccctggccatcagtggactccggtccgaggatgaggctgagtattactgtgcaacctgggatgacgacctgagtggtccggtcttcggcggagggaccaaggtgaccgtcctag

SEQ ID NO: 2559 - DNA, 322 bp, Artificial Sequence
  Synthetic polynucleotide encoding artificial human antibody VL chain
gaaacgacactcatgcagtctccagcactcatatcagcgactccaggagacaaagtccacatctcctgcaaagccagccaagacattgacgatgatttgaattggtatcaacagaaaccaggagaagctcctattctcattattgaagaagcaactaatctcggtcctggattctcacctcgattcagtggcagcgggtatggaacagatttcaccctcacaatttatgacatagagtctggagatgctgcattttacttctgtctacaacatgatactttccctctgacgttcggccaagggaccaaagtggaaatcaaac

SEQ ID NO: 2560 - DNA, 644 bp, Artificial Sequence
  Synthetic polynucleotide encoding artificial human antibody VL chain
gtgacatccagatgacccagtctccttccaccctgtctgcatctgtaggagacaaagtcaccatcacttgccgggccagtcagagtgttggtagctggttggcctggtatcagcaaaaaccagggaaagcccctaagctcctgatctctgtggcgtctagtttagaaagtggggtcccatcaaggttcagcggcagtggatctgggacagaattcactctcaccgtcagcagcctgcagcctgatgattttgcaacttattactgtcaacagtataatagttattcgtggacgttcggccaagggaccaaggtggagctcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtta

SEQ ID NO: 2561 - DNA, 644 bp, Artificial Sequence
  Synthetic polynucleotide encoding artificial human antibody VL chain
gtgacatccagttgacccagtctccatccttcctgtctgcatctgtaggagacagagtcaccatcacttgccgggccagtcaggacattagcagttttttagcctggtatcagcaaaaaccagggaaagcccctgacctcctaatctatgctgcatccactttgcagagtggggtcccatcaaggttcagcggcagtggatctgggacagaattcactctcacaatcagtagcctgcagcctgaagattttgcagcttattactgtcaacaccttactagtttcccgtacacttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtta

SEQ ID NO: 2562 - DNA, 645 bp, Artificial Sequence
  Synthetic polynucleotide encoding artificial human antibody VL chain
gtttcttctgagctgactcaggaccctgctgtgtctgtggccttgggacagacagtcaggatcacatgccaaggagacagcctcagagactattctgctagctggtaccagcagaagccaggacaggcccctattcttgtcatctttttcagaaacaagcggccctctgggatcccagaccgattctctggctccgcctcaggaaacacagcttccttgaccatcactggggctcaggcggaagatgaggctgactattactgtggctcccgggacagtagtggtaacccttctgtcttcggagctgggaccaaggtcaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttca

SEQ ID NO: 2563 - DNA, 644 bp, Artificial Sequence
  Synthetic polynucleotide encoding artificial human antibody VL chain
cagaaattgtgttgacacagtctccagccaccctgtctttgtctccaggggaaggagccaccctctcctgcagggccagtcagagtgttagcgcctacttaggctggtaccaacagaaacctggccaggctcccaggctcctcatctatgatacatccaacagggccactggcatcccagccaggttcagtggcagtgggtctgggacagacttcactctcaccatcagcagcctagagcctgaagattttgcagtttattactgtcagcagcgtagcaactggctgtacacttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgg

SEQ ID NO: 2564 - DNA, 645 bp, Artificial Sequence
  Synthetic polynucleotide encoding artificial human antibody VL chain
tcctatgtgctgactcagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggatagtagtagtgatcatcaagaggtattcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatggcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2565 - DNA, 648 bp, Artificial Sequence
  Synthetic polynucleotide encoding artificial human antibody VL chain
cagtctgccctgactcagcctgcctccgtgtctgggtctcctggacagtcgatcaccatctcctgcactggatccagcagtgatgttggaaattataaccttgtctcctggtaccaactacaccccggcaaagcccccaaactcatgatttatgaggtcattaagcggccctcaggagtttctagtcacttctctggctccaagtctggcaacacggcctccctgacaatctctgggctccaggctgaggacgaggctgattattactgctgctcatatgcacctagtaacacttatgtcttcggaactgggaccagggtcaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttca

SEQ ID NO: 2566 - DNA, 642 bp, Artificial Sequence
  Synthetic polynucleotide encoding artificial human antibody VL chain
cagattgtgttgacacagtctccagccaccctgtctttgtctccaggggaaagagtcaccctctcctgcagggccagtcagagtgtcagaagccacttagcctggtaccagcagaaacctggccaggctcccaggctcctcatgtatgatgcattcaatagggccactggcaccccagccaggttcagtggcagtgggtctgggacagacttcactctcaccattagcagcctagagcctgaagattttgcaatttattactgtcagcagcgtagcaactggcctctcactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtta

SEQ ID NO: 2567 - DNA, 648 bp, Artificial Sequence
  Synthetic polynucleotide encoding artificial human antibody VL chain
gtttcttctgagctgactcaagaccctgctgtgtctgtggccttgggacagacagtccggatcacatgccaaggagacagcctcagaagttattatgcaacctggtaccagcagaagccaggacaggcccctctacttgtcatatttgataaagacaaacggccctcagggatcccagaccgattctccggctccagctcaggaaacacagcttccttgaccatcactggggctcagccggaagatgaggctgtctattactgtaactcccgagacagcagtgctcatgaccatctgttattcggcggagggaccacgctgaccgtcctgggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttca

SEQ ID NO: 2568 - DNA, 648 bp, Artificial Sequence
  Synthetic polynucleotide encoding artificial human antibody VL chain
gaagttgttttgacgcagtctccaggcaccctgtctttgtctccaggtgagagagccaccctcttctgcaaggccagtcaggctattgtcagcaattacttagtctggtatcagcagaaacctggcctggctcccagactcctcatctacagtgcttccaccagggccactggcattccagacaggttcagtggcggtggctctggaacagacttcagtctcaccatcagcggactggaacctgaagattttgcagtttattactgtcaacactttggtgactcacccttgtacatttttggccaggggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2569 - DNA, 636 bp, Artificial Sequence
  Synthetic polynucleotide encoding artificial human antibody VL chain
ccctatgagctgactcagccactctcagtgtcggtggccctgggacagacggccagggttacctgtgggggaacgaacattggaaagaaagatgttcattggtaccaacaaaagccaggccaggcccctgtgttggtcatttatagggatgacaaccggccctctgggatccctgagcgattctctggcctcaattcggggcacacggccaccttgaccatcagcagagcccaggccggggatgaggctgattattactgtcaggtgtgggacagcagtactgcggtgttcggcggagggaccaagctgaccgtcctcggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttca

SEQ ID NO: 2570 - DNA, 325 bp, Artificial Sequence
  Synthetic polynucleotide encoding artificial human antibody VL chain
ctctatgtgctgactcagccaccctcagtgtcagtggccccaggaaagacggccaggattacctgtgggggaaacaacattggaagtaaaagtgtgcactggtaccagcagaagccaggccaggcccctgtgctggtcatctatgatgatagcgaccggccctcagggatccctgagcgattctctggctccaactctgggaacacggccaccctgaccatcagcagggtcgaagccggggatgaggccgactattactgtcaggtgtgggatagtagtagtgatcatgtggtattcggcggagggaccaagctgaccgtccagg

SEQ ID NO: 2571 - DNA, 642 bp, Artificial Sequence
  Synthetic polynucleotide encoding artificial human antibody VL chain
tcctatgagctgacacagacaccctcggtgtcagtgtccccaggacagacggccaggatcacctgctctggagatgcattgccaaagcaatctgttaattggtaccagcagaggccaggccaggcccctgtggtggtgatatgtaaagacactgagaggccctcagggatccctgagcgattctctggctccacctcagggacaacagtcacgttgaccatcggtggagtccaggcagaagatgaggctgactattactgtcaatcagcagacagcagtggtttttatgtggtattcggcggagggaccaagctgaccgtcctaggtcagcccaaggctgccccctcggtcactctgttcccaccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttca

SEQ ID NO: 2572 - DNA, 636 bp, Artificial Sequence
  Synthetic polynucleotide encoding artificial human antibody VL chain
tcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagacgaggctgactattactgtcaatcagcagacagcagtagtcccgtgtttggcggagggaccaagctgaccgtcctaggtcagcccaaggctgccccctcggtcactctgttcccaccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttca

SEQ ID NO: 2573 - DNA, 639 bp, Artificial Sequence
  Synthetic polynucleotide encoding artificial human antibody VL chain
tcctatgagctgacacagccaccctcggtgtcagtgcccccaggacaaacggccaggatcacctgctctggagatgcattgccaaaaaaatatgcttattggtaccagcagaagtcaggccaggcccctgtgctggtcatctatgaggacaccaaacgaccctccgggatccctgacagattctctggctccagctcagggacaatggccaccttgactatcagtggggcccaggtggaggatgatgctgactactactgttactcaacagacagtagggctaccggggttttcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttca

SEQ ID NO: 2574 - DNA, 642 bp, Artificial Sequence
  Synthetic polynucleotide encoding artificial human antibody VL chain
gccgtccagatgacccagtctccatcctccctgtctgcatctgtgggagacagagtcaccatctcttgccgggcaagtcagaccattgacacctatttaaactggtatcaacagagaccaggaaaagcccctcagctcctgatctatgctgcatccagtttgcaaagtggggtcccttcaaggttcagtgccagtggatctgggacacatttcactctcatcatcaacagtctgcaacctgaagactttgcaacttactactgtcaacagagttacagtacccctcagacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2575 - DNA, 324 bp, Artificial Sequence
  Synthetic polynucleotide encoding artificial human antibody VL chain
gtgacatccagatgacccagtctccatcctccctgtctgcttctgtaggagacagagtcaccatcacttgccaggcgactcagggcattaccaactatttaaattggtatcagcaaaaaccagggaaagcccctaaggtcctgatctacgatgcatccaatttggaaacaggggtcccatcaaggttcagtggaaatggatctgggacacattttactttcaccatcagcagcctgcagcctgaagatatcgcaacatattactgtcaacagtatgaaaatctcccgctcactttcggcggagggaccaaggtggagatcaaac

SEQ ID NO: 2576 - DNA, 644 bp, Artificial Sequence
  Synthetic polynucleotide encoding artificial human antibody VL chain
gtgacatccagatgacccagtctccatcctccctgtctgcatctgtaggagacagagtcaccatcacttgccaggcgagtcaggacattagcacgtttttaaattggtatcagcagaaaccagggaaagcccctaagctcctgatctacgatgaatccaatttggaaacaggggtcccgtcaaggttcagtggaagtggatctgggacagattttactttcaccatcagcagcctgcagcctgaagatattgcaacatattactgtcaacagtttgataatctcccgctcactttcggcggagggaccaggttggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2577 - DNA, 331 bp, Artificial Sequence
  Synthetic polynucleotide encoding artificial human antibody VL chain
cagtctgccctgactcagcctcgctcagtgtccgggtctcctggacagtcagtcaccatctcctgcactggaaccagcagtgatattggtggttataactatgtctcctggtaccaacaacacccaggcaaagcccccaaatttgtgatttatgatgtcagtcagcggccctcaggggtccctgatcgcttctctggctccaagtctggcaacacggcctccctgaccatctctgggctccaggctgacgatgaggctgattattactgctcctcatatgcaggcagctacacttgggtgttcggcggagggaccaaggtgatcgtcctag

SEQ ID NO: 2578 - DNA, 317 bp, Artificial Sequence
  Synthetic polynucleotide encoding artificial human antibody VL chain
tcctatgagctgactcagccaccctcagtgtccgtgtccccaggacagacagccagcatcacctgctctggagataaattgggggataaatatgcttgctggtatcagcagaagccaggccagtcccctgtggtggtcatctatcaagataccaagcggccctcagggatccctgagcgattctctggctccaactctgggaacacagccactctgaccatcagcgggacccaggctatggatgaggctgactattactgtcaggcgtgggacagcagcactgtggtatttggcggagggaccaagctgaccgtcct

SEQ ID NO: 2579 - DNA, 331 bp, Artificial Sequence
  Synthetic polynucleotide encoding artificial human antibody VL chain
ccgtctgtgttgacgcagccgccctcactgtctgcggccccaggacagagggtcaccatctcctgctctggaagcacctccaacattggaaataattttgtatcctggtaccagcagctcccaggagcagcccccaaactcctcatttatgacaatgataagcgaccctcagagattcctgaccgattctctggctccaagtctggcacgtcagccaccctggccatcaccggactccagactggggacgaggccgattattattgcggaacatgggatagcagcctgggtgcttatgtcttcggaactgggaccaaggtcaccgtcctgg

SEQ ID NO: 2580 - DNA, 644 bp, Artificial Sequence
  Synthetic polynucleotide encoding artificial human antibody VL chain
gagaaattgtgttgacgcagtctccaggcacactgtctttgtctccaggggaaagagccaccctctcctgcagggccagtcagagtatcagcagcacctacttagtctggtaccagcagaaacctggccaggctcccaggctcctcatctatgctgcgtcctatagggccactggcatcccagacaggttcagtggcagtgggtctgggacagacttcattctcaccatcagcagactggagcctgaagattttgcagtatattactgtcagcagtatggtagctcactcactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2581 - DNA, 647 bp, Artificial Sequence
  Synthetic polynucleotide encoding artificial human antibody VL chain
gagaaattgagttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctctcactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaactctacgcctgcgaagtcacccatcagggcctgagctcgcccgtcacaaagagcttcaacaggggagagtgt

SEQ ID NO: 2582 - DNA, 648 bp, Artificial Sequence
  Synthetic polynucleotide encoding artificial human antibody VL chain
gcctctgccctgactcagcctgcctccgtgtctgggtctcctggacagtcgatcaccatctcctgcaatggaagcagcagtgacgttggcgattataactatgtctcctggtaccaacaacacccaggcaaagcccccaaactcatgatttatgacgtcagtaatcggccctcaggggtttctaatcgcttctctggctccaagtctggcaacacggcctccctgaccatctctgggctccaggctgaggacgaggctgattattactgcagctcatatacaagcagcaggagtctggtgttcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2583 - DNA, 644 bp, Artificial Sequence
  Synthetic polynucleotide encoding artificial human antibody VL chain
gtgacatccagatgacccagtctccatcctccctgtctgcatctgtaggagacaaagtcaccatgacctgccgggcaagtcagttcattagcgtctatgtaaattggtatcagcagaaaccagggaaagcccctaagctcctgatctatactgcgtcctctttggaaagtggggtctcatcaaggttcagtggcggcggatctgggacagatttcactctcacgatccgcagtctgcaacctgaagattttgcaatttactactgtcaacagacttacagcaccccgtggacgttcggcccagggacgagggtagaaattaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2584 - DNA, 642 bp, Artificial Sequence
  Synthetic polynucleotide encoding artificial human antibody VL chain
ggagaagtagtgatgacgcagtctccagccacgctgtctgtgtctccaggggaaagagccaccctctcctgcagggccagtcagagtgttagcagcaaggtagcctggtaccagcagagacctggccgggctcccaggctcctcatctatggtgcatccaccagggccactgatatcccagccaggttcagtggcagtgggtctgggacagagttcactctcaccatcagcagcctgcagtctgaagattttgcagtttattactgtcaacaatataataattggctcactttcggcggagggaccaaggtggaaatcaagcgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgg

SEQ ID NO: 2585 - DNA, 319 bp, Artificial Sequence
  Synthetic polynucleotide encoding artificial human antibody VL chain
tcctatgagctgacacagccatcctcagtgtcagtgtctccgggacagacagccaggatcacctgctcaggagatgtattggcaaaaaattatgctcggtggttccagcagaagccaggccaggcccctctgttggtgatttataaagacaatattcggccctcagggatccctgagcgattctccggctccagctcagggaccacagtcaccttgaccatcagcggggcccacgttgacgatgaggctgactattactgttactctacgcctgacaacaatggggtgttcggcggagggaccaagctgatcgtcctag

SEQ ID NO: 2586 - DNA, 648 bp, Artificial Sequence
  Synthetic polynucleotide encoding artificial human antibody VL chain
cagtctgccctgactcagcctgcctccgtgtctgggtctcctggacagtcgatcaccatctcctgcactgggaccagcagtgacgttggtgcttatccgtatgtctcctggtatcaacatcacccaggcagagcccccaaactcacgatttttgatgtcattaatcggccctcaggggtttctaatcgcttctctggctccaagtctggcaacacggcctccctgaccatctctgggctccaggctgaggacgaggctttttattactgcagctcatatacaacctccaacagtgtggtgttcggcggagggaccaaactgaccgtcctgagtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2587 - DNA, 647 bp, Artificial Sequence
  Synthetic polynucleotide encoding artificial human antibody VL chain
gagaaattgtgttgacacagtctccaggcaccctgtctttgtctccaggggaaagagccaccctctcctgcagggccagtcagagtttaagcagcggttacttagcctggtaccagcagaaacctggccaggctcccaggctcctcatctatggtgcatcctacagggccactgacatcccagacaggttcagtggcagtgggtctgggacagacttcactctcaccatcagcagactggagcctgaagatttcgcagtgtattactgtcagcagtatgataactcacctctcactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2588 - DNA, 340 bp, Artificial Sequence
  Synthetic polynucleotide encoding artificial human antibody VL chain
gggatcgtgatgacccagtctccagactccctggctgtgtctctgggcgagagggccaccatcaactgcaagtccagccagagtcttttatacaggtccaacgataagaactacttcgcttggtaccagcagaaaccaggacagcctcctaaactgctcatttactgggcgtctacccgggaatccggggtccctgaccgattcagtggcagcgggtcagggacagatttcactctcaccatcagcagcctgcaggctgaagatgtggcagtttattactgtcagcaatattggggtactccgtacacttttggccaggggaccaagctggagatcaaac

SEQ ID NO: 2589 - DNA, 648 bp, Artificial Sequence
  Synthetic polynucleotide encoding artificial human antibody VL chain
ccggctgtactgacgcaggcgccctcagtgtctggggccccagggcagagggtcaccatctcctgtactgggagcggctccaatatcggggctggttatgatgcacactggtatcaacaacttccaggaacagcccccaaactcctcatctatcgtaacaccaatcggccctctggggtccctgaccgattctctggctccaagtctggctcctcagcctccctggccatcactgggctccagcctgaggatgaggctgaatattattgtcagtcctatgacagtggcctgggggtggtattcggcggagggaccaaactgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2590 - DNA, 648 bp, Artificial Sequence
  Synthetic polynucleotide encoding artificial human antibody VL chain
cagtctgccctgactcagcctccctccgcgtccgggtctcctggacagtcagtcaccatctcctgcactggaaccagcagtgacgttggtggttatgaccatgtctcctggtaccaacagcacccaggcaaagcccccaaagtcatgatttatgaggtcactaagcggccctcaggggtccctgatcgcttctctggctccaagtctggcaacacggcctccctgaccgtctctgggctccaggctgaggatgaggctgaatattactgcagctcatatgcaggcatcaacaatttggtttttggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2591 - DNA, 644 bp, Artificial Sequence
  Synthetic polynucleotide encoding artificial human antibody VL chain
gtgacatccagatgacccagtctccttccaccctgtctgcatctgtaggcgacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagagttcactctcaccatcagcagcctgcagcctgatgattttgcaacttattactgccaacagtataatagttattctcagacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2592 - DNA, 642 bp, Artificial Sequence
  Synthetic polynucleotide encoding artificial human antibody VL chain
gaaatagtgatgacgcagtcgccagccaccctgtctgtgtctcccggcgaaagagccaccctctcctgcagggccagtcagagtattgtcaccaacttagcctggtttcagcagaaacctgcccaggctcccaggctcctcatctatggtgcatccaccagggccactgatgtcccagccagattcagtggcagtgggtctgggacagagttcactctcaccgtcagcagcctgcagtctgaagattttgcaatttatttctgtcagcagtatactgactggccgtacacttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2593 - DNA, 648 bp, Artificial Sequence
  Synthetic polynucleotide encoding artificial human antibody VL chain
ccccttgtgctgactcaatcgccctctgcctctgcctccctgggagcctcggtcaagctcacctgcactctgagtagtgggcacagcacctacgccatcgcatggcatcagcagcggccagagaagggccctcggtacttgatgaagcttaacagtgatggcagccacatcaagggggacgggatccctgctcgcttctcaggcgccagctctggggttgaccgctacctcatcatctccagttcacagtctgaggatgaggctgactattactgtcagacctggggcactgttggcgtgttcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttca

SEQ ID NO: 2594 - DNA, 645 bp, Artificial Sequence
  Synthetic polynucleotide encoding artificial human antibody VL chain
gaaattgtgttgacgcagtctccaggcaccctgtctttgtctccaggggaaagagccaccctctcctgcagggccggtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgtggacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2595 - DNA, 651 bp, Artificial Sequence
  Synthetic polynucleotide encoding artificial human antibody VL chain
cagtctgtgctgacgcagccgccctcagtgtctggggccccagggcagagggtcaccatcccctgcactgggagcagctccaacctcggggcaggttatgctgtacactggtaccagcagcttccagcaacaacccccaaactcctcatctatgctaacagcagtcgaccctcaggggtccctgaccgattctctggctccaggtctgacacctcagcctccctggccatcactgggctccaggctgaggatgaggctgattattactgccagtcttatgacagcagcctgagtggttatgtcttcggaactgggacctgggtcaccgtcctaagtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttca

SEQ ID NO: 2596 - DNA, 651 bp, Artificial Sequence
  Synthetic polynucleotide encoding artificial human antibody VL chain
cagtctgtgttgacgcagccgccctcagtgtctggggccccaggccagaggatcaccatctcctgcactggaggcagcaccaacatcgggacaatttatgatgttcactggtaccaacagcttcccggagcagcccccaaactcctcatctatggtaacagtcgtcgaccctcaggggtccctgaccgattctctgcctccaagtctggcacctcagcctccctggccatcagtgggctccggcctgaggatgaggcggattattactgccagtgttttgacaccagcctgactgcaaaggtgttcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2597 - DNA, 337 bp, Artificial Sequence
  Synthetic polynucleotide encoding artificial human antibody VL chain
gatattctgctgactcagtctccactcttcctgtccgtcacccctggagagccggcctccatctcctgcaggtctaatcagagcctcctttctagtaatggacatcatcttttggattggtacttccaaaaaccaggccagtctcctcaactcctgatgtttctgggttctactcgggcctccggggtccctgacaggttcagtggcagtgcatcaggcacagaatttacactgaaaatcagcacagtggaggcggaagattttggagtgtattactgcatgcaagctctacaagttcctcggacgttcggccgagggaccaaggtggaaatcaaac

SEQ ID NO: 2598 - DNA, 644 bp, Artificial Sequence
  Synthetic polynucleotide encoding artificial human antibody VL chain
gtgacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcacggttcagcggcagtggatctgggacagaattcactctcacaatcagcagcctgcagcctgaagattttgcaacttattactgtcaacaacttaatagttacccgctcactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaactctacgcctgcgaagtcacccatcagggcctgagctcgcccgtcacaaagagcttcaacaggggagagtta

SEQ ID NO: 2599 - DNA, 648 bp, Artificial Sequence
  Synthetic polynucleotide encoding artificial human antibody VL chain
ccggctgtgctgactcagccaccctcagcgtctgggacccccgggcagagggtcaccatctcttgttctggaagcaactccaacatcggaagtacttttgtatactggtaccagcagctcccaggaacggcccccaaactcctcatccatagtaataatcagcggccctcaggggtccctgaccgagtctctggctccaagtctggcacctcagcctccctggccatcagtgggctccggtccgaggatgaggctgattattactgtgcagcatgggatgacagcctgagtggtccggtgttcggcggagggaccaagctgaccgtcctaggtcagcccaaggctgccccctcggtcactctgttcccaccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttca

SEQ ID NO: 2600 - DNA, 657 bp, Artificial Sequence
  Synthetic polynucleotide encoding artificial human antibody VL chain
gatattgtgttgactcagtctccactctccctgcccgtcacccctggagagccggcctccatctcctgcaggtctagtcagagcctcctgcatagtaatggagtctactacttggattggtacctgctgaagccaggacagtctccacaactcgtgatctatatgggttcgagtcgggcctccggggtccctgacaggttcagtggcagtggatcaggcacggattttagactgaaaatcagcagagtggaggctgaggatgttggaatttattactgcatgcaagctctgcaaactccgtggacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgg

SEQ ID NO: 2601 - DNA, 648 bp, Artificial Sequence
  Synthetic polynucleotide encoding artificial human antibody VL chain
gtttcttctgagctgactcaggaccctgctgtgtctgtggccttgggacagacagtcaggatcacatgccaaggagacagcctcagaagctattttgcaacctggtatcagcagaagccaggacaggcccctgttcttgtcatctatggtaaaaacagccggccctcagggatcccagaccgattctctggctccacctcaggaaacacagcttccttgaccatctctggggctcaggcggaagatgaggctgactattactgtaactcccgggacagcagtgatgaccatctggaagtattcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2602 - DNA, 644 bp, Artificial Sequence
  Synthetic polynucleotide encoding artificial human antibody VL chain
gttacatccagatgacccagtctccttccaccctgtctgcatctgtaggagacagagtcaccatcacttgccgggccagtcagagtataagtagttggttggcctggtttcagcagaaaccagggaaagcccctaaactcctgatctataaggcgtctactttagaaagtggggtcccatcaagattcagcggcagtgaatctgggacagaattcactctcaccatcggcagcctgcagcctgatgattttgcaacttattactgtcaacagtataatagttacccgaggacgttcggccaagggaccaaggtggatatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2603 - DNA, 662 bp, Artificial Sequence
  Synthetic polynucleotide encoding artificial human antibody VL chain
gtgacatcgtgatgacccagtctccagactccctggctgtgactctgggcgagagggccaccatcaactgtaggtccagccagactgttttatacgactccaacaataaaaactacttagcttggtatcagcagaaaccaggacagcctcctaaactactcatttactgggcgtctattcgggaatctggggtccctgaccgattcagtggcagcgggtctgggacagatttcactctcaccatcaacaccctgcaggctgaagatgtggcaatttatttctgtcagcaatattttactactcctcgcacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtta

SEQ ID NO: 2604 - DNA, 651 bp, Artificial Sequence
  Synthetic polynucleotide encoding artificial human antibody VL chain
cccgctgtgctgactcagccaccctcagtgtctgggacccccgggcagagggtcaccatctcttgttctggaggcagcagcaacatcggaggtaagtatgtatactggtaccagcaactcccaggaacggcccccaaggttgtcatctacaggaataatcagcggccctcaggagtctctgaccgattctctggctccaagtctggcatttcagcctccctgaccatcagtgggctccggtccgaggatgaggctgtttattactgtgcagcatgggatgacggcctgggtggcctttatgtgttcggaactgggaccaaggtcaccgccctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttca

SEQ ID NO: 2605 - DNA, 639 bp, Artificial Sequence
  Synthetic polynucleotide encoding artificial human antibody VL chain
gacatccagatgacccagtctccttccaccctgtctgcatctgtaggagacagagtcaccatctcttgccgggccagtcagagtattagtgactggttggcctggtatcagcagaagccagggaaagcccctaagctcctgatctatgctgcatccattttacaaagtggggtcccatcaagattcagcggcagtggatctgggacagaattcactctcaccatcagcagcctgcagaccgatgattttgcaacttattactgccaacagtataatagggggtccactttcggccctgggaccaaagtggatatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgg

SEQ ID NO: 2606 - DNA, 642 bp, Artificial Sequence
  Synthetic polynucleotide encoding artificial human antibody VL chain
tcctatgtgctgcctcagccaccctcagtgtcagtggccccaggacagacggccaaaatcacctgtgggggaaacaaccctggaattaagagtgtgcactggtaccagcagaggccaggccaggcccccgtgctggtcatctatgacgatagcgaccggccctcagggatccctgagcgattctctggctccaactctgggaacacggtcaccctgaccatcagctgggtcgaagccggggatgaggccgactattactgtcaggtgtgggacaggaatagtcatcgtgtgattttcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2607 - DNA, 651 bp, Artificial Sequence
  Synthetic polynucleotide encoding artificial human antibody VL chain
ccctctgtgctgacgcagccgccctcagtgtctggggccccggggcagagggtcaccatctcctgcactgggagcacctccaacatcggggcagattatgatgtacactggtaccaacaacttccaagaacagcccccaaactcctcatctatgctaacaacaatcggccctcaggggtccctgaccggttctctggctccaagtctggcacctcagcctccctggccatcactgggctccaggctgaggatgaggctgattattactgccagtcctatgacaacagtctgagtgcttgggtgttcggcggagggaccaagttgaccgtcctaggtcagcccaaggctgccccctcggtcactctgttcccaccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttca

SEQ ID NO: 2608 - DNA, 642 bp, Artificial Sequence
  Synthetic polynucleotide encoding artificial human antibody VL chain
tcttctgagctgactcaggaccctgctgtgtctgtggccttgggacagacagtcaggatcacatgccaaggagacagcctcagaagcttttatggaagctggtaccagcagaagccaggacaggcccctgtacttgtcatctatggtgaaaacaaccggccctcagggatcccagaccgattctctggctccagctcaggaaacacagcttccttgaccatcactggggctcaggcggaagatgaggctgactattactgtaactcccgggacagcagtggtaaccattgggtgttcggcggagggaccaagctgaccgtcctaggtcagcccaaggctgccccctcggtcactctgttcccaccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttca

SEQ ID NO: 2609 - DNA, 651 bp, Artificial Sequence
  Synthetic polynucleotide encoding artificial human antibody VL chain
cagtctgccctgactcagcctgcctccgtgtctgggtctcctggacagtcgatcaccatctcctgcactggaatcagcagtgacgttgatggttataattatgtctcctggtaccaactctactcaggtaaagcccccaaactcataatttatgatgtcactaatcggccctcaggggtttctcatcgcttctctggctccaagtctggcaacacggcctccctgaccatctctgggctccaggctgaggacgaggctgattactactgcagctcatatataaggagcagcactcctgtggtattcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2610 - DNA, 662 bp, Artificial Sequence
  Synthetic polynucleotide encoding artificial human antibody VL chain
gggacatcgtgatgacccagtctccagactccctggctgtgtctctgggcgagagggccaccatcaactgcaagtccagccagagtgttttatacagctccgacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctggaggctgaagatgtggcagtttattactgtcagcagtattatgatactccctacacttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2611 - DNA, 648 bp, Artificial Sequence
  Synthetic polynucleotide encoding artificial human antibody VL chain
gcctctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcactctggtgttcggcggagggaccaagctgaccgtcctaggtcagcccaaggctgccccctcggtcactctgttcccaccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttca

SEQ ID NO: 2612 - DNA, 641 bp, Artificial Sequence
  Synthetic polynucleotide encoding artificial human antibody VL chain
gtgacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctctggacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2613 - DNA, 645 bp, Artificial Sequence
  Synthetic polynucleotide encoding artificial human antibody VL chain
ccctatgtgctgactcagccaccctcggtgtcagtggccccaggacagacggccaggattacctgtgggggaaacaacattggaagtaaaagtgtgcactggtaccagcagaagccaggccaggcccctgtgttggtcgtctatgatgatagtgaccggccctcagggatccctgagcgattctctggctccaactctgggaacacggccaccctgaccatcagcagggtcgaagccggggatgaggccgactattactgtcaggtgtgggatagtagtagtgatcatctttatgtcttcggaactgggaccaaggtcaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttca

SEQ ID NO: 2614 - DNA, 645 bp, Artificial Sequence
  Synthetic polynucleotide encoding artificial human antibody VL chain
gaaattgtcttggcgcagtctccaggcaccctatatttgtctccgggggaaagagccacgctctcctgcagggccagtcagagtgtaagaggcaattatttggcctggtaccagcagaggcctggccaggctccccggctcctcatctatggggcctccagcagggccactggcatcccagacaggttcggcggcagtgggtctgggacagacttcactctcaccatcaccagactgctgcctgaagattttgcagtgtactactgtcaccagtatggtagctcaccaaggacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2615 - DNA, 651 bp, Artificial Sequence
  Synthetic polynucleotide encoding artificial human antibody VL chain
cagtctgtgttgacgcagccgccctcagtgtctgcggccacgggacagaaggtcaccatctcctgctctggaggcagctccaacattgggagtaattatgtatcctggtaccaacaactcccaggaacagcccccaaacttctcatctttgaaaataataagcgaccctcagggattcctgaccgattctctggctccaagtctggcacgtcagccaccctgggcatcaccggactccagactggggacgaggccgattattactgcggaacatgggacagcagcctgactggtggttttgtcttcgggactgggaccaaggtcaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttca

SEQ ID NO: 2616 - DNA, 642 bp, Artificial Sequence
  Synthetic polynucleotide encoding artificial human antibody VL chain
tcctatgtcctgactcagcccccctcagtgtcagtggccccaggaaagacggccactatcgcctgtggggaaaacaacattggaagttacaatgtgaactggtaccaacagaggccaggccaggcccctgtattagtaatccattctgatagcgaccggccctcggggatctctgagcgattctctggctccaactctgggaacacggccaccctgaccatcagcagggtcgaagccggggatgaggccgactattactgtcaggtgtgggacacttctaatgatgtgggggtgttcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttca

SEQ ID NO: 2617 - DNA, 647 bp, Artificial Sequence
  Synthetic polynucleotide encoding artificial human antibody VL chain
gagaaattgtgttgacgcagtctccaggcaccctgtctttgtctccagggggaagagccaccctctcctgcagggccagtcagagggttagcagcaactacttagcctggtaccaacagaaacctggccaggctcccaggctcctcatctatggtccatccagcagggccactggcgtcccagacaggttcagtagcagtgggtctgggacagacttcactctcagcatcagcagactggagcctgaagattttgcagtgtatttctgtcagcagtatggtagctcacctccgactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2618 - DNA, 648 bp, Artificial Sequence
  Synthetic polynucleotide encoding artificial human antibody VL chain
gcctctgccctgactcagcctgcctccgtgtctgggtctcctggacagtcgatcaccatctcctgcactggaaccagcagtgatgttgggagttataaccttgtctcctggtaccaacaacacccaggcaaagcccccgaactcatgatttatgagggcagtaagcggccctcaggggtttctaatcgcttctctggctccaagtctggcaacacggcctccctgacaatctctggactccaggctgaggacgaggctgattattactgctgctcatatgcaggtagtagcaattgggtgttcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttca

SEQ ID NO: 2619 - DNA, 654 bp, Artificial Sequence
  Synthetic polynucleotide encoding artificial human antibody VL chain
gatgttgtaatgactcagtctccactctacctgcccgtcacccttggacagccggcctccatctcctgcagggctagtcaaagcctcgtatacagtgatggaaacacctacttgaattgggttcatcagaggccaggccaatctccaaggcgcctaatttacatggtttctcagcggggctctggggtcccagacagattcagcggcagcgggtcagacactgatttcacactgaaaatcagcagggtggaggctgaggatgttggggtttattactgcatgcaaggtacacactggtccgcttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2620 - DNA, 648 bp, Artificial Sequence
  Synthetic polynucleotide encoding artificial human antibody VL chain
ccctctgtgctgactcagccaccctcagcgtctgggacccccgggcagagggtcaccatctcttgttctggaagcagctccaacatcggaagtaattatgtatactggtaccagcagctcccaggaacggcccccaaactcctcatctataggaataatcagcggccctcaggggtccctgaccgattctctggctccaagtctggcacctcagcctccctggccatcagtgggctccggtccgaggatgaggctgattattactgtgcagcatgggatgacagcctgagtggtcaggtgttcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttca

SEQ ID NO: 2621 - DNA, 642 bp, Artificial Sequence
  Synthetic polynucleotide encoding artificial human antibody VL chain
gtttcttctgagctgactcaggaccctgctgtgtctgtggccttgggacagacagtcaggatcacatgccaaggagacagcctcagaagctattatgcaagctggtaccagcagaggccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggacagcagtggtaaccatgtcttcggaactgggaccaaggtcaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttca

SEQ ID NO: 2622 - DNA, 641 bp, Artificial Sequence
  Synthetic polynucleotide encoding artificial human antibody VL chain
gtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtactcccaccttcggccaagggacacgactggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2623 - DNA, 641 bp, Artificial Sequence
  Synthetic polynucleotide encoding artificial human antibody VL chain
cctatgtgctgactcagccaccctcggtgtccgtggccccaggacagacggccaggattacctgtgggggaaacaacattggatatagaaatgtgtactggtaccaccaaaagccaggccaggcccctgtgctggtcgtctatgatgatagcgaccggccctcagggatccctgagcgattctctggctccaactctgggaacacggccaccctgaccatcagcagggtcgaagccggggatgaggccgactatttttgtcaggtgtgggaaagtggtggtgatcatccggtgttcggcggagggaccaagttgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2624 - DNA, 644 bp, Artificial Sequence
  Synthetic polynucleotide encoding artificial human antibody VL chain
gtgacatccagatgacccagtctccatcctccctgtctgcatctgtaggagacagagtcaccatcacttgccgggcaagtcagggcattagaaatgatttaggctggtttcagcagaaaccagggaaagcccctaagcgcctcatctatgctgcatccaatttgccaagtggggtctcatcaaggttcagcggcagtggatctgggacagaattcactctcacaatcagcagcctgcagcctgaagattttgcaacgtattactgtctacagcataataattacccgttgacgttcggccaagggaccaaggtggaattcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2625 - DNA, 644 bp, Artificial Sequence
  Synthetic polynucleotide encoding artificial human antibody VL chain
gtgacatccagatgacccagtctccttccaccctgtctgcatctgtaggagacagagtcaccatcacttgccgggccagtcagagtattagtagctggttggcctggtatcagcagaaaccagggaaagcccctaagctcctgatctatgatgcctccagtttggaaagtggggtcccatcaaggttcagcggcagtggatctgggacagaattcactctcaccatcagcagcctgcagcctgatgattttgcaactttttactgccaacagtataatagttatccgtacacttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2626 - DNA, 659 bp, Artificial Sequence
  Synthetic polynucleotide encoding artificial human antibody VL chain
gggatattgtgatgactcagtctccactctccctgcccgtcacccctggagagccggcctccatctcctgcaggtccagtcagagcctccttcatagtaatggattcaactatttggattggtacctgcagaagccagggcagtctccacagctcctgatttatttgggttctaatcgggcctccggggtccctgacaggttcagtggcagtggatcaggcacagattttacactgaagatcagcagagtggaggctgaggatgttggggtttattactgcatgcaagctctacagatcccccggacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2627 - DNA, 636 bp, Artificial Sequence
  Synthetic polynucleotide encoding artificial human antibody VL chain
ccctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcaacgtccatgtcttcggaactgggaccaaggtcaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttca

SEQ ID NO: 2628 - DNA, 642 bp, Artificial Sequence
  Synthetic polynucleotide encoding artificial human antibody VL chain
tcctatgagctgacacagccaccctcggtgtcagtgtccccaggacaaacggccaggatcacctgctctggagatgcattgccaaaaaaatatgctttttggtaccagcagaagtcaggccaggcccctgtgttggtcatctatgaggacagcaaacgaccctccgggatccctgagagattctctggctccagctcagggacaatggccaccttgactatcagtggggcccaggtggaggatgaatctgactactactgttactcaacagacagcagtggtaatgtctgggtgttcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttca

SEQ ID NO: 2629 - DNA, 645 bp, Artificial Sequence
  Synthetic polynucleotide encoding artificial human antibody VL chain
gtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggacagcagtggtaacctttatgtcttcggaactgggaccaaggtcaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttca

SEQ ID NO: 2630 - DNA, 662 bp, Artificial Sequence
  Synthetic polynucleotide encoding artificial human antibody VL chain
gggacatcgcgatgacccagtctccagactccctggctgtgtctctgggcgagagggccaccatcaactgcaagtccagccagagtgttttatacagctccagcagtaagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtagtcctctcactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2631 - DNA, 660 bp, Artificial Sequence
  Synthetic polynucleotide encoding artificial human antibody VL chain
gatattgtgatgactcagtctccactctccctgcccgtcacccctggagagccggcctccatctcctgcaggtctagtcagagcctcctgcatagcaatggatacaactatttggattggtacctgcagaagccagggcagtctccacagctcctgatctatttgggttctaatcgggcctccggggtccctgacaggttcagtggcagtgggtcaggcacagattttacactgaaaatcagcagagtggaggctgacgatgttggggtttattactgcatgcaagctctacaaactcccccgtacacttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2632 - DNA, 648 bp, Artificial Sequence
  Synthetic polynucleotide encoding artificial human antibody VL chain
gcctctgccctgactcagcctgcctccgtgtctgggtctcctggacagtcgatcaccatctcctgcactggaaccagcagtgacgttggtggttataactatgtctcctggtaccaacagcacccaggcaaagccccccaactcatgatttttgacgtcagtaatcggccctcaggggtttctaatcgcttctctggctccaagtctggcgacacggcctccctgaccatctctgggctccaggctgaggacgaggctgattattactgcagctcatatacaagcagcagcacttgggtgttcggcggagggaccaagctgaccgtcctcggtcagcccaaggctgccccctcggtcactctgttcccaccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttca

SEQ ID NO: 2633 - DNA, 662 bp, Artificial Sequence
  Synthetic polynucleotide encoding artificial human antibody VL chain
gggacatcgtgatgacccagtctccagactccctggctgtgtctctgggcgagagggccaccatcaactgcaagtccagccagagtgttttatacagctccaacaataagaactacttaggttggtaccagcagaaaccaggagagcctcctaagctggtcattcactgggcatctacccgggaatccggggtccctgaccgattcagtggcagcgggtctgggacagatttcactctgaccatcagcagcctgcaggctgaagatgtggcagtttattactgtcagcaaagttacagtactccgtacacctttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2634 - DNA, 334 bp, Artificial Sequence
  Synthetic polynucleotide encoding artificial human antibody VL chain
cagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcaggtagtagcactccttgggtgttcggcggagggaccaagctgaccgtcctag

SEQ ID NO: 2635 - DNA, 642 bp, Artificial Sequence
  Synthetic polynucleotide encoding artificial human antibody VL chain
ccctatgagctgacacagccaccctcggtgtcactgtccccaggacaaacggccaggatcacctgctctggagatgctttgccaaaaaaatatgcttactggtaccagcagaagtcaggccaggcccctgtactggtcatctatgaggacagcaaacgaccctccgggatccctgagagattctctggctccagctcagggacaacggccaccttgactatcagtggggcccaggtggacgatgaaggtgactactactgttactcaccagacagcagtggtaatgtttgggtgttcggcggagggaccaagctgaccgtcctaggtcagcccaaggctgccccctcggtcactctgttcccaccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttca

SEQ ID NO: 2636 - DNA, 310 bp, Artificial Sequence
  Synthetic polynucleotide encoding artificial human antibody VL chain
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtctcccagccaggttcagtggcagtgggtctgggacagagttcactctcaccatcagcagcctgcagtctgaagattttgcagtttattactgtcagtcccggggcactttcggcggagggaccaaggtggagatcaaac

SEQ ID NO: 2637 - DNA, 329 bp, Artificial Sequence
  Synthetic polynucleotide encoding artificial human antibody VL chain
gaaattgtgttgacgcagtctccagtcaccctgtctttgtctccaggggaaagagccaccctctcctgcagggccagtcagagtgttagcagcagctacatagcctggtaccagcagaaacctggccaggctcccaggctcctcatctatggtgcatccaccagggccactggcatcccagacaggttcagtggcagtgggtctgggacagacttcactctcaccatcagcagactggagcctgaagattgtgcagtgttttactgtcagcagtatggtagctcacattacacttttggccaggggaccaagctggagatcaaacgaac

SEQ ID NO: 2638 - DNA, 645 bp, Artificial Sequence
  Synthetic polynucleotide encoding artificial human antibody VL chain
tcctatgtgctgactcagccaccctcagtgtcagtggccccaggaaagacggccaggattacctgtgggggagacaacattggaagtagaagtgtccactggtaccagcagaagccaggccaggcccctgtgctggtcatctattatgatagcgaccggccctcagggatccctgagcgattctctggctccaactctggcaacacggccaccctgaccatcagcagggtcgaagccggggatgaggccgactattactgtcaggtgtgggatagtagtagtgatcatccttgggtgttcggcggagggaccaagctgaccgtcctacgtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttca

SEQ ID NO: 2639 - DNA, 334 bp, Artificial Sequence
  Synthetic polynucleotide encoding artificial human antibody VL chain
cagtctgccctgactcagcctgcctccgtgtctgggtctcctggacagtcgatcaccatctcctgcactggcaccagcagtgatattgggacttataaccttgtctcctggtaccaacaacgcccaggcaaagcccccaaactcatcatttatgacgtcattaagcggccctcagggatttctgatcgcttctctggctccaagtctgacaacatggcctccctgacaatctctggcctccaggctgaggacgaggctcactattactgctgctcgtatagaagtagtacggctcccgtggtcttcggcggggggaccaaggtgaccgtcctag

SEQ ID NO: 2640 - DNA, 340 bp, Artificial Sequence
  Synthetic polynucleotide encoding artificial human antibody VL chain
ggcatcgtgatgacccagtctccagactccctggctgtgtctctgggcgagagggccaccatcaactgcaagtccagccagagtgttttatccacctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattttagtactccgtggacgttcggccaagggaccaaggtggaaatcaaac

SEQ ID NO: 2641 - DNA, 642 bp, Artificial Sequence
  Synthetic polynucleotide encoding artificial human antibody VL chain
tcctatgtgctgactcagccaccctcggtgtcagtggccccaggacagacggccaggattacctgtgggggaaacaacattggaagtaaaagtgtgcactggtaccaacagaagccaggccaggcccctgtgctggtcgtctatgatgatagcgaccggccctcagggatccctgagcgattctctggctccaactctggaaacacggccaccctgaccatcagcagggtcgaagccggggatgaggccgactattactgtcaggtgtgggatggttatagtgatccattggtattcggcggagggaccaagctgaccgtcctaggtcagcccaaggctgccccctcggtcactctgttcccaccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttca

SEQ ID NO: 2642 - DNA, 642 bp, Artificial Sequence
  Synthetic polynucleotide encoding artificial human antibody VL chain
gaggtccagatgacccagtctccatcctccctgtctgcatctgttggcgacagagtcaccatcacttgccgggcaagtcagcacattgccgggcgtctaaattggtatcagcagaaaccagggaaagccccaaaactcctgatccatagtgcatccagtgtgcaaagagaggtcccatcaaggttcggtggcagtggatttgggacagatttcactctcaccatctacagtctgcaagctgaagattttgcaacttacttctgtcaacagagttactatacccctcccactttcgccggagggaccagggtggatttgaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2643 - DNA, 651 bp, Artificial Sequence
  Synthetic polynucleotide encoding artificial human antibody VL chain
cggtctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatgggctttgggtgttcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttca

SEQ ID NO: 2644 - DNA, 651 bp, Artificial Sequence
  Synthetic polynucleotide encoding artificial human antibody VL chain
gattttctgctgactcagccccactctgtgtcggagtctccggggaagacggtaaccatctcctgcacccgcagcagtggcagcattgccagcaactatgtgcagtggtaccagcagcgcccgggcagttccccctccactgtgatctatgaagatcaccaaagaccctctggggtccctggtcggttctctggctccatcgacagctcctccaactctgcctccctcaccatctctggactgaagactgaggacgaggctgactacttctgtcagtcttctgacagcaacaatcatgtggtcttcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttca

SEQ ID NO: 2645 - DNA, 651 bp, Artificial Sequence
  Synthetic polynucleotide encoding artificial human antibody VL chain
cggtctgtgctgacgcagccgccctcagtgtctggggccccagggcagagggtcaccatctcctgcactgggagcagctccaacatcggggcacattatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggtgtgctattcggcggagggaccaaactgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2646 - DNA, 642 bp, Artificial Sequence
  Synthetic polynucleotide encoding artificial human antibody VL chain
gacatccagatgacccagtctccatcctccctgtctgcatctgtgggagacagagtcaccatcacttgccgggcaagtcagagcattagtagttatttaaattggtatcagcagaaaccagggaaagcccctaagttcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccccttcactttcggccctgggaccaaagtggatctcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2647 - DNA, 642 bp, Artificial Sequence
  Synthetic polynucleotide encoding artificial human antibody VL chain
gacatccagatgacccagtctccaccctccctgtctgcatctgtgggagacagagtcaccatcacttgccaggcgagtcaggacattagcaactatttaaattggtatcagcagaaaccagggaaaacccctaagctcctgatctacgctgcatccactttggaaacaggggtcccatcaaggttcagtggaagtggatctgggacagattttactttcaccatcaacagcctgcagcctgaagatattgcaacatattactgtcaacagtatgatagtctccctctcactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2648 - DNA, 650 bp, Artificial Sequence
  Synthetic polynucleotide encoding artificial human antibody VL chain
gagaaattgtgttgacgcagtctccaggcaccctgtctttgtctccagggcatagagccaccctctcctgcagggccagtcaagatgttgccagcacctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgttttattgtcagtactatggtggctcaccgggattcactttcggccctgggaccaaagtggatttcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2649 - DNA, 648 bp, Artificial Sequence
  Synthetic polynucleotide encoding artificial human antibody VL chain
cagtctgccctgactcagcctgcctccgtgtctgggtctcctggacagtcgatcaccatctcctgcactggaaccaccagtgatgttgggacttataaccttgtctcctggtaccaacaactcccaggcaaagcccccaaactcattatttatgaggtcactaagcggccctcaggagtttctaatcgcttctctgcctccaagtctggcagcacggcctccctgacaatctctgggctccaggctgaggacgaggctgattattactgctgctcatatgcaggtagtagcacttatgtcttcggaagtggggccagggtcaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttca

SEQ ID NO: 2650 - DNA, 650 bp, Artificial Sequence
  Synthetic polynucleotide encoding artificial human antibody VL chain
gagaaattgtgttgacgcagtctccaggcaccctgtctttgtctccaggggaaacagccaccctctcctgcagggccagtcagagtgttgccaacaactacttagcctggcatcagcagaagcctggccaggctcccagactcctcatctatggtgcatccaaaagggccgctggcatcccagaccggttcagtggcagtgggtctgggacagagttcactctcaccatcagcagactggagcctgaagattgtgcagtgtattactgtcaggagtatgttaaatcacctggattcgctttcggccctgggaccagagtggatatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2651 - DNA, 645 bp, Artificial Sequence
  Synthetic polynucleotide encoding artificial human antibody VL chain
gaaattgtgttgacgcagtctccagccaccctgtctttgtctccaggggaaagagccaccctctcctgcagggccagtcagagtgttagcagcaactacttagcctggtaccagcagaaacctggccaggctcccaggctcctcatccatggtgcatccagcagggccactggcttcccagacagattcagtggcagtgggtctgggacagacttcactctcaccatcaacagactggagcctgaagattttgcagtgtattattgtcagcagtatggtacttcacctcagacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2652 - DNA, 650 bp, Artificial Sequence
  Synthetic polynucleotide encoding artificial human antibody VL chain
ctcagactgtggtgacccaggagccatcgttctcagtgtcccctggagggacagtcacattcacttgtgcctggagttctggttcagtctccactagtttctacaccagctggtaccgccagaccccaggccaggctccacaaacgctcatctacaacacaaatcgtcgttcttctggggtccctgatcgcttctctggctccatccttgggaacaaagctgccctcaccatcacgggggcccaggcagatgatgactctgattattattgtatgttgtatatgggtagtggcatttcgctcttcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2653 - DNA, 654 bp, Artificial Sequence
  Synthetic polynucleotide encoding artificial human antibody VL chain
cagtctgtgctgacgcagccgccctcagtgtctggggccccagggcagagggtcaccatctcctgcactgggagcagctccaacatcggggcacaatatgatgtacactggtacaaggtaattccaggaacagcccccaaactcctcatctatggtaacgacaatcggccctcaggggtccctgaccgattctctggctccaagtctggcacctcagcctccctggccatcactgggctccaatctgaggatgaggctgattattactgccagtccaatgacatcagcctgagtggttctgtggtatttggcggagggactaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2654 - DNA, 651 bp, Artificial Sequence
  Synthetic polynucleotide encoding artificial human antibody VL chain
ccgtctgtactgacgcagccgccctcagtgtctggggccccagggcagagggtcaccatctcctgcactgggagcagctccaacatcggggcaggttacgatgtacactggtaccaacagcttccaggaacagcccccaaactcctcatctatgctaacaccaatcgaccctcaggggtccctgaccgattctctggctccaagtctggcacctcagcctccctggccatcactgggctccaggctgaagatgaggctgattattactgccaatcctatgacaatagcctgagtgggggggtgttcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2655 - DNA, 647 bp, Artificial Sequence
  Synthetic polynucleotide encoding artificial human antibody VL chain
gaaaaattgtgttgacgcagtctcccggcaccctgtctttgtctccaggggaaagggccaccctctcctgcagggccagtcagagtgttagcagcagttacttagcctggtaccagcagagacctggccagtctcccaggctcctcatctatgagacttccaccagggccactggcatcccagacaggttcagtggcagtgggtctgggacagacttcactctcaccatcagcggactggagcctgaagattttgcagtctattactgtcagcagtttgatatttcacccttcactttcggccctgggaccaaagtggatgtcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2656 - DNA, 648 bp, Artificial Sequence
  Synthetic polynucleotide encoding artificial human antibody VL chain
cagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagctccttggtgttcggcggagggaccaaggtgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttca

SEQ ID NO: 2657 - DNA, 331 bp, Artificial Sequence
  Synthetic polynucleotide encoding artificial human antibody VL chain
cagtctgccctgactcagcctgcctccgtgtctggctctcctgggcagtcgatcaccatctcctgcactggaaccagcagtgatattgggggttatgaccttgtctcctggtaccaacaccacccaggcaaagcccccaaactcgtgatttctgagggcagtaagcggccctcaggggtttctaatcgcttctttggctccaagtctggcaacacggcctccctgacaatctctggcctccaggctgaggacgaggctgattattactgctgctcatttacaggtactagcacttttgtcttcggaactgggaccaaggtcaccgtcctag

SEQ ID NO: 2658 - DNA, 340 bp, Artificial Sequence
  Synthetic polynucleotide encoding artificial human antibody VL chain
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagacttcactctcaccatcagcagcctagagcctgaagattttgcagtttattactgtcagcaatattatagtactccgtacacttttggccaggggaccaagctggagatcaaac

SEQ ID NO: 2659 - DNA, 648 bp, Artificial Sequence
  Synthetic polynucleotide encoding artificial human antibody VL chain
cagtctgtgctgactcagccaccctcagcgtctgggacccccgggcagagggtcaccatctcttgttctggaagcagctccaacatcggaagtaatactgttaactggtaccagcagttcccaggaacggcccccaaactcctcatctacagtaataatcaccggcccttaggggtccctgaccgattctctggctccaagtctggcacctcagcctccctggccatcagtgaggtccgctctgaggatgaggctgattattattgtgcaacatgggatgacagcctgaatggaggggtgttcggcgcagggaccaagctgaccgtcgtaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttca

SEQ ID NO: 2660 - DNA, 645 bp, Artificial Sequence
  Synthetic polynucleotide encoding artificial human antibody VL chain
ccagctgtggtgactcaggagccctcactgactgtgtccccaggagggacagtcactctcacctgtggctccagcactggagtagtcaccactggtcattatccctactggttccagcagaagcctggccaagcccccacgacactgatttttgatacaagcaacaaacactcctggacccctgcccgcttctcaggctccctccttgggggcaaagctgccctgaccctttctgctgcgcagcctgaagatgaggctgactattactgctggctcatctctggtggtgcccctgtattcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2661 - DNA, 334 bp, Artificial Sequence
  Synthetic polynucleotide encoding artificial human antibody VL chain
cagtctgtgctgacgcagccgccctcagtgtctggggccccagggcagagagtcaccatctcctgcgctgggagctactccaacatcggggcaggttatgatgtacactggtaccgccaacttccaggaacagcccccacactcctcatctatagtaacaacaatcggccctcaggggtctctgaccgattctctggctccaaatctggcacctcagcctccctggccatcactgggctccaggctgaggatgaggctgattattactgccagtcctttgacagcagcctgagtcgttctgtcttcggaactgggaccaaggtcaccgtcctag

SEQ ID NO: 2662 - DNA, 324 bp, Artificial Sequence
  Synthetic polynucleotide encoding artificial human antibody VL chain
gagaaattgtattgacacagtctccagccaccctgtctttctctccaggggacagagccaccctctcctgcagggccagtcagaatattaacaggttcttagcctggtatcaacagaaaccgggccagactcccaggctcctcatctatgatgcatccactcgggccactggcatccctgcccggttcagtggcagtgggtctgggacagacttcagtctcatcatcagcagcctagagcctgaagattttgcgatttattactgccagcagcgtaacaactggcctatcactttcggccctgggaccaaagtggatgtcaaac

SEQ ID NO: 2663 - DNA, 642 bp, Artificial Sequence
  Synthetic polynucleotide encoding artificial human antibody VL chain
gccatccaaatgacccagtctccatcctccctgtctgcatctgtaggagacagagtcaccatcacttgccgggcaagtcagggcattagaaatgatttaggctggtatcagcagaaaccagggaaagcccctaagctcctgatctatgctgcatccagtttacaaagtggggtcccatcaaggttcagcggcagtggatctggcacagatttcactctcaccatcagcagcctgcagcctgaagattttgcaacttattactgtctacaagattacaattaccctccgacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaactctacgcctgcgaagtcacccatcagggcctgagctcgcccgtcacaaagagcttcaacaggggagagtgt

SEQ ID NO: 2664 - DNA, 324 bp, Artificial Sequence
  Synthetic polynucleotide encoding artificial human antibody VL chain
tcttctgagctgactcaggaccctgctgtgtctgtggccttgggacagacagtcaggatcacatgccaaggagacagcctcagaacggattatgcaacctggtaccaacagaagccaggacaggcccctatacttgtcttctatggtgaggacaaccggccctcagggatcccagaccgattctctggctccagctcaggaaacacagcttcgttgaccatcactggggctcaggcggaagatgaggctgactattactgtaactcccgggacagcagcggtcaccattgggtgttcggcggagggaccaaactgaccgtccta

SEQ ID NO: 2665 - DNA, 342 bp, Artificial Sequence
  Synthetic polynucleotide encoding artificial human antibody VL chain
gggacatcgtgatgacccagtctccggactccctggccgtgtctctgggcgagagggccaccctcaactgcaagtccagccagagtgttttatccagctacaacaataaggactacttagcttggttccagcagaaaccaggacagcctcctcagttgctcttttactgggcatctacccggaaaaccggagtccctgaccgattcagtggcagcgggtctgggactgatttcactctcaccatcagcagcctgcagactgaagatgtggcagtttattactgtcagcaatattattctactccatacacttttggccaggggaccaagctggagatcaaac

SEQ ID NO: 2666 - DNA, 660 bp, Artificial Sequence
  Synthetic polynucleotide encoding artificial human antibody VL chain
gatgttgtgatgactcagtctccactctccctgcccgttacccttggacaggcggcctccatctcctgcaggtctagtcaaagcctcgtatacagtgatggaaacacctacttgaattggtttcagcagaggcccggccaatctccaaggcgcctaatttataaggtttctaaccgggagtctggggtcccagacagattcagcggcagtgggtcaggcactgatttcacactgcaaatcagcagggtggaggctgaggatgttgggatttattactgcatgcaaggtgcacactggcctccaatcaccttcggccaagggacacgactggagattaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2667 - DNA, 322 bp, Artificial Sequence
  Synthetic polynucleotide encoding artificial human antibody VL chain
tcctatgagctgacacagccaccctcggtgtcagtgtccccaggacaaacggccaggatcacctgctctggagatgcattgccaaaaaaatatgttttttggtaccagcagaggtcaggccaggcccctgtgttagtcatctatgaagacagtaaacgaccctccgggatccctgacagattctctggctccagctcagggacactggccaccctcactatcagtggcgcccaggtggaggatgaggctgactactactgttactcaacagacactattggaaattgggtgttcggcggagggaccaggctgaccgtcctag

SEQ ID NO: 2668 - DNA, 642 bp, Artificial Sequence
  Synthetic polynucleotide encoding artificial human antibody VL chain
ctctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatagtagtagtgatcattggattttcggcggagggaccaagctgaccgtcctaggtcagcccaaggctgccccctcggtcactctgttcccaccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttca

SEQ ID NO: 2669 - DNA, 644 bp, Artificial Sequence
  Synthetic polynucleotide encoding artificial human antibody VL chain
gtgacatccagatgacccagtctccatcctccctgtctgcatctgttggagacagagtcaccatcacttgccgggcaagtcagagcattagcacctatttaaattggtatcagcagaaaccagggaaagcccctaagctcctgatctatgctgcttccaatttgcagagtggggtcccatcaacgttcagtggcagtggatctgggacagatttcactctcaccatcagcagtctgcaacctgaagattttgcaacttactactgtcaacagagttacagtccccctctcactttcggcggggggaccacggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2670 - DNA, 645 bp, Artificial Sequence
  Synthetic polynucleotide encoding artificial human antibody VL chain
gaaatagtgatgacgcagtctccagccaccctgtctgtgtctcagggggaaagagccaccctctcctgcagggccagtcagagtgttggcagcgacttagcctggtaccagcagaaacctggccaggctcccaggctcctcatctatgatgcttccgccagggccactgatatcccagccaggttcagtggcagtgggtctgagacagagttcactctcaccatcagcagcctgcagtctgaagattttgcagtttattactgtcagcattatagtgactggcgagcactcactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2671 - DNA, 660 bp, Artificial Sequence
  Synthetic polynucleotide encoding artificial human antibody VL chain
ggcatcgtgatgacccagtctccagactccctggctgtgtctctgggcgagagggccaccatcaactgcaggtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtctattactgtcaacaatattatggtcctctgtggacgttcggccaagggaccagggtggaaatcagacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2672 - DNA, 642 bp, Artificial Sequence
  Synthetic polynucleotide encoding artificial human antibody VL chain
tccgatgagctgacacagccaccctcggtgtcagtgtccccaggacagacggccaggatcacctgctctggagatgcattggcaaaggaatatgcttattggtaccagcaaaagtcaggccaggcccctgtattggtgatctctaaagacacggagaggccctcagggatccctgcgcgattttctggctccagttcagggacaacagtcacgttgaccatcagtggagtccagtctgatgacgaggctgactattactgtcaatcagcagacagcagtcttacttattggctcttcggcggagggaccaagctgaccgtcctacgtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttca

SEQ ID NO: 2673 - DNA, 319 bp, Artificial Sequence
  Synthetic polynucleotide encoding artificial human antibody VL chain
gacatccagatgacccaggctccttccaccctgtctgcatctgttggagacagagtcagcatcacttgccgggccagtcagaatattcgcgacttcttggcctggtatcagcagaaaccagggagagcccctgacctcctcatctatcgggcatctactttagaaaaaggggtgtcggcgaggttcagcggcagtgggtctgggacagaattcactctaaccatcaccggcctgcagcctgatgattttgcaacatattactgccaacaatattccgattactccactttcggcggagggaccagggtggagatcaaac

SEQ ID NO: 2674 - DNA, 660 bp, Artificial Sequence
  Synthetic polynucleotide encoding artificial human antibody VL chain
gacatcgtgatgacccagtctccagactccctggctgtgtctctgggcgagagggccaccatcacctgcaagtccagccagactattttatacagctccaacaataagaactatttagcttggtaccagcagaaaccaggacagcctcctaaactactcatttactgggcatctacccgggaatccggggtccctgaccggttcagtggcagcgggtctgggacagatttcactctcaccatcagcagcctgcaggctgaagatgtggcagtttattactgtcaccaatattatactactcctttcactttcggccctgggaccactgtggatatcagacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2675 - DNA, 636 bp, Artificial Sequence
  Synthetic polynucleotide encoding artificial human antibody VL chain
tcctatgagctgactcagccaccctcagtgtccgtgtccccaggacagacagccagcatcacctgctctggagataaattggggaataaatatgtttgctggtatcagcagaagccaggccagtcccctgtgttggtcatctatcaggataccaagcggccctcagggatccctgagcgattctctggctccaagtctgggaacacagccactctgaccatcagcgggacccaggctctggatgaggctgactattactgtcaggcgtgggacagcagcactgcagaattcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2676 - DNA, 648 bp, Artificial Sequence
  Synthetic polynucleotide encoding artificial human antibody VL chain
cggtctgtgctgactcagccaccctcagcgtctgggactcccgggcagacggtcaccatctcttgttctggtagcaggtccaacatcgggagtaattttgtgtattggtaccaacacctcccaggatcggcccccaaaacgaccatccattctaatactcagcggccccccggggtccctgatcgattttctggctccaagtctggcacctcagcctccctggccatcagtgggctccggtctgaagatgaggctgattattactgtgtgacatgggatgacgacctgcatggttgggtgttcggcggagggaccaggctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttca

SEQ ID NO: 2677 - DNA, 654 bp, Artificial Sequence
  Synthetic polynucleotide encoding artificial human antibody VL chain
cggtctgtgttgacgcagccgccctcagtgtctgcggccccaggacagaaggtcatcatctcctgctctggaagcagctccaacattgggaataactatgtttcctggtaccagcaattcctaggaacagcccccaaactcctcatttatgacactgataagcgaccctcagggattcctgaccgattctctggctccaagtctggcacgtcagccaccctgggcattaccgggctccagactggggacgaggcccattattactgcgcaacgtgggatagcagcctgcgtgctggccctgtagtattcggcggagggacgaaattgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaaatacgcggccagcagctatctgagcctgacgcctgagcagtggaagtcccacagaagctacagctgccaggtcacgcatgaagggagcaccgtggagaagacagtggcccctacagaatgttca

SEQ ID NO: 2678 - DNA, 642 bp, Artificial Sequence
  Synthetic polynucleotide encoding artificial human antibody VL chain
gacatccagatgacccaatctccttccaccctgtctgcatctgtaggagacagagtcaccatcacttgccgggccagccagagtgttagtttctggttggcctggtatcagcagaaaccagggaaagcccctaacctcctgatcagtaaggcgtctactttagaaagtggagtcccctcaagatttagcggcagtggctctgggacagaattcactctcaccatcagcagcctgcagcctgatgatttcgcaacttattactgccaacagtacaatgcttacccggtcactttcggcggggggaccaaggtggagatcagacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2679 - DNA, 660 bp, Artificial Sequence
  Synthetic polynucleotide encoding artificial human antibody VL chain
ggcatcgtgatgatccagtctccagactccctggctgtgtctctgggcgagagggccaccatcaactgcaagtccagccagagtgtcttctacagctccaacaataagaactacttagcttggtaccagcagaaaccaggacagcctcctaaactgctcatttactgggcatctacccgggaatccggggtccctgaccgattcagtggcagcgggtctgggacagatttcactctcaccctcaccagcctgcaggctgaagatgtggcagtttattactgtcaacaatattatagtactccgtggacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2680 - DNA, 662 bp, Artificial Sequence
  Synthetic polynucleotide encoding artificial human antibody VL chain
gggacatcgtgatgacccagtctccagactccctggctgtgtctctgggcgagagggccgccatcaactgcaagtccagccagagtgttttatacagctccaacaataagaactacttagcttggtaccagcagagaccaggacagcctcctaagctgctcattcactgggcatctatgcgggaatccggggtccctgaccgattcagtggcagcgggtctgggacagatttcactctcaccatcagcagcctgcaggctgaagatgtggcaatttattactgtcagcaatattatagtcctcctctcactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2681 - DNA, 330 bp, Artificial Sequence
  Synthetic polynucleotide encoding artificial human antibody VL chain
cagtctgccctgactcagcctgcctccgtgtctgggtctcctggacagtcgatcaccatctcttgcactggaagcagcaatgacattggtcgttataagtatgtctcctggttccaacatcacccaggcagagcccccaaactcataatttatgaggtcaataatcggccctcagggctttctcatcgcttctctggctccaagtctggcaacacggcctccctgaccatctctgggctccaggctgaggacgaggctgattattactgctgctcatatacaagcagcctcacttatgtcttcggaactgggaccgcggtcaccgtccta

SEQ ID NO: 2682 - DNA, 657 bp, Artificial Sequence
  Synthetic polynucleotide encoding artificial human antibody VL chain
gatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcaaggtacacactggccgtacacttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2683 - DNA, 636 bp, Artificial Sequence
  Synthetic polynucleotide encoding artificial human antibody VL chain
ccctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcagcacttatgtcttcggaactgggaccaaggtcaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttca

SEQ ID NO: 2684 - DNA, 648 bp, Artificial Sequence
  Synthetic polynucleotide encoding artificial human antibody VL chain
gaaaatgtgttgacgcagtctccaggcaccctgtctttgtctccaggggaaagagccaccctctcctgcagggccagtcagagggttaacagcaactacttagcctggtaccagcagaaatctggccaggctcccaggctcctcatctatggtgcatccagcagggccactggtatcccagacaggttcagtggcagtgggtctgggacagacttcactctcaccatcagcagactggagcctgaagattttgcagtgtattactgtcagcagtatggtggctcacctctattcactttcggccctgggaccaaagtggatatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaactctacgcctgcgaagtcacccatcagggcctgagctcgcccgtcacaaagagcttcaacaggggagagtgt

SEQ ID NO: 2685 - DNA, 319 bp, Artificial Sequence
  Synthetic polynucleotide encoding artificial human antibody VL chain
ccctatgaactgactcagccaccctcagtgtccgtgtccccaggacagacagccagcatcgcctgctctggagataatttgggaaataaatatgcttggtggtatcgacagaagccaggccagtcccctgtcctggtcatgtataaagataacaagcggccctcagggatccctgagcgattctctggctccaactctgggaacacagccactctgaccatcagcgggacccaggctatggatgaggctgactattactgtcagacgtgggacagcagcactgtgatattcggcggagggaccaagctgaccgtccaag

SEQ ID NO: 2686 - DNA, 659 bp, Artificial Sequence
  Synthetic polynucleotide encoding artificial human antibody VL chain
gggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccgtacacttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2687 - DNA, 648 bp, Artificial Sequence
  Synthetic polynucleotide encoding artificial human antibody VL chain
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagtctgagtgctggcgtcttcggaactgggaccaaggtcaccgtcctaggtcagcccaaggccaaccccactgtcactctgttcccgccctcctctgaggagctccaagccaacaaggccacactagtgtgtctgatcagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttca

SEQ ID NO: 2688 - DNA, 641 bp, Artificial Sequence
  Synthetic polynucleotide encoding artificial human antibody VL chain
gtgacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttattggacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2689 - DNA, 644 bp, Artificial Sequence
  Synthetic polynucleotide encoding artificial human antibody VL chain
gtgacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttatccgtggacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2690 - DNA, 654 bp, Artificial Sequence
  Synthetic polynucleotide encoding artificial human antibody VL chain
ccagctgtgctgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggttcaggggtgttcggcggagggaccaagctgaccgtcctaggtcagcccaaggctgccccctcggtcactctgttcccaccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttca

SEQ ID NO: 2691 - DNA, 639 bp, Artificial Sequence
  Synthetic polynucleotide encoding artificial human antibody VL chain
tcctatgagctgacacagccaccctcggtgtcagtgtccccaggacagacggccaggatcacctgctctggagatgcattgccaaagcaatatgcttattggtaccagcagaagccaggccaggcccctgtgttggtgatatataaagacagtgagaggccctcagggatccctgagcgattctctggctccagctcagggacaacagtcacgttgaccatcagtggagtccaggcagaagacgaggctgactattactgtcaatcagcagacagcagtggtacttatgtcttcggaactgggaccaaggtcaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttca

SEQ ID NO: 2692 - DNA, 308 bp, Artificial Sequence
  Synthetic polynucleotide encoding artificial human antibody VL chain
gacatccagatgacccagtctccatcttccctgtctgcatctgtcggagacagagtcaccttcacttgtcgggcgagtcagaatattcgcaacaatttagcctggtatcagctcaaaccagggaaagccccgcagctcctgatctattctgcttccagtttggagactggggtcccttcaaggttcagcggctctggatctggaacagatttcactctcgccatcagcagcctgcagcctgaagattttgcgacttactattgtcaacaggctcacggtttcccaatcacttttgggcaggggagcaa

SEQ ID NO: 2693 - DNA, 319 bp, Artificial Sequence
  Synthetic polynucleotide encoding artificial human antibody VL chain
gaaatagtgatgacgcagtctccagccaccctgtctgtgtctcccggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcaatttattactgtcagcagtataatagctggcccgctttcggcggagggaccaaggtggagatcaaac

SEQ ID NO: 2694 - DNA, 642 bp, Artificial Sequence
  Synthetic polynucleotide encoding artificial human antibody VL chain
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccgtcagcagtctacaacctgaagactttgcaacttactactgtcaacagagttacaataccccgtacacttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2695 - DNA, 644 bp, Artificial Sequence
  Synthetic polynucleotide encoding artificial human antibody VL chain
gtgacatccagatgacccagtctccatcctccctgtctgcatctgtaggagacagagtcaccatcacttgccgggcaagtcagagcattagcacctatttaaattggtatcagcagaaaccagggatggcccctaagctcctgatctatgctgcatccactttgcaaagtggggtcccatcaaggttcagtggcagtggatctgcgacagattacactctcaccatcagcagtctgcaacctgaagatttcgcgacttactactgtcaacagagttacaataccccgctcactttcggcggagggaccaaggtggacatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaactctacgcctgcgaagtcacccatcagggcctgagctcgcccgtcacaaagagcttcaacaggggagagtgt

SEQ ID NO: 2696 - DNA, 648 bp, Artificial Sequence
  Synthetic polynucleotide encoding artificial human antibody VL chain
gaaattgtgttgacgcagtctccaggcaccctgtctttgtctccaggggaaagagccaccctctcctgcagggccagtcagagtgttaccagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctccgaacagttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2697 - DNA, 325 bp, Artificial Sequence
  Synthetic polynucleotide encoding artificial human antibody VL chain
tcctatgtgctgactcagccaccctcagtgtcagtggccccaggaaagacggccaggattacctgtgggggaaacaacattggaagtaaaagtgtgcactggtaccagcagaagccaggccaggcccctgtgctggtcatctattatgatagagacaggccctcagggatccctgagcgattctctggctccaactctgggaacacggccaccctgaccatcagcagggtcgaagccggggatgaggccgactattactgtcaggtgtgggatagtagtagtgatcatccggtattcggcggagggaccaagctgaccgtcctag

SEQ ID NO: 2698 - DNA, 651 bp, Artificial Sequence
  Synthetic polynucleotide encoding artificial human antibody VL chain
aattttatgctgactcagccccactctgtgtcggagtctccggggaagacggtaaccatctcctgcacccgcagcagtggcagcattgccgacaagtatgtccactggtaccggcagcgcccgggcagctcccccaccattgtgatctatgaggataaacaaaggccctctggggtccctgatcgggtctctggcgccatcgacacctcctccaactctgcctccctcaccatctctggactgaagactgaggacgaggctgactactactgtcagtcttatgatagcaacactcattgggtgttcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttca

SEQ ID NO: 2699 - DNA, 657 bp, Artificial Sequence
  Synthetic polynucleotide encoding artificial human antibody VL chain
gatattgtgatgactcagtctccactctccctgcccgtcacccctggagagccggcctccatctcctgcaggtctagtcagagcctcctacatagtaatggatacaactatttggattggtacctgcagaagccagggcagtctccacagctcctgatctatttgggttctaatcgggcctccggggtccctgacaggttcagtggtagtggatcaggcacagattttacactgaaaatcagcagagtggaggctgaggatgttggggtttattactgcatgcaagctctagaaactcctcgcactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2700 - DNA, 641 bp, Artificial Sequence
  Synthetic polynucleotide encoding artificial human antibody VL chain
gtgacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttattcgacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2701 - DNA, 657 bp, Artificial Sequence
  Synthetic polynucleotide encoding artificial human antibody VL chain
ggaattgcaatgactcagtctccacgctccctgcccgtcacccctggagagccggcctccatctcctgcaggtctagtcagagcctcctgtatcgtgatggagagcactatttggattggtacctacagaagccagggcagtctccacacctcctgatctactcgggatctaatcgggcctccggggtccctgacaggttcagtggcagtggatcaggcacagattttacactaataatcagcagagtggaggctgaggatgctggggtctattactgcatgcaagctctacaacctccgtacactttcggccaggggaccaagctggagatcacacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaactctacgcctgcgaagtcacccatcagggcctgagctcgcccgtcacaaagagcttcaacaggggagagtgt

SEQ ID NO: 2702 - DNA, 647 bp, Artificial Sequence
  Synthetic polynucleotide encoding artificial human antibody VL chain
gtgacatccagatgacccagtctccatcctccctgcctgcatctgtaggagacagagtcaccatcacttgccgggcaagtcagagcattagtagctatttaaattggtatcaaaagaaaccagggaaagcccctaagctcctgatcgatgctgcatccagtttgcaaagtggggtcccatcaaggttcagtggcagtggatctgggacagatttcactctcaccatcagcagtctgcaacctgaagattttgcaacttactactgtcaacagagttacagtacccctccgtggacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2703 - DNA, 660 bp, Artificial Sequence
  Synthetic polynucleotide encoding artificial human antibody VL chain
gacatcgtgatgacccagtctccagactccctgtctctgtctctgggcgagagggccaccatcaactgcaagtccagccagagtcttttatacagttccaactataagaactacttagcttggtaccaacagaaaccaggacagcctcctaaattgctcatttactgggcatctacccgggagtccggggtccctgaccgattcagtggcagcgggtctgggacagatttcactctcaccatcagcagcctgcaggctgaagatgtggcagtttattactgtcagcaatattatcttgttcccgtcaccttcggccaagggacacgactggacattaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2704 - DNA, 651 bp, Artificial Sequence
  Synthetic polynucleotide encoding artificial human antibody VL chain
gcctctgtgctgactcagccaccctcagcgtctgggacccccgggcagagggtcaccatctcttgttctggaagcagctccaacatcggaagtaattatgtatactggtaccagcagctcccaggaacggcccccaaactcctcatctataggaataatcagcggccctcaggggtccctgaccgattctctggctccaagtctggcacctcagcctccctggccatcagtgggctccggtccgaggatgaggctgattattactgtgcagcatgggatgacagcctgagtggcccttatgtcttcggaactgggaccaaggtcaccgtcctaggtcagcccaaggccaaccccactgtcactctgttcccgccctcctctgaggagcttcaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttca

SEQ ID NO: 2705 - DNA, 651 bp, Artificial Sequence
  Synthetic polynucleotide encoding artificial human antibody VL chain
cagtctgccctgactcagcctccctccgcgtccgggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatttttatgtcttcggaactgggaccaaggtcaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttca

SEQ ID NO: 2706 - DNA, 654 bp, Artificial Sequence
  Synthetic polynucleotide encoding artificial human antibody VL chain
cagtctgtgctgacgcagccgccctcagtgtctggggccccagggcagagggtcaccatctcctgcactgggagcaactccaacatcggggcaggttatgatgtacactggtatcagcagcttccaggagcagcccccaaactcctcatctatggtaacggcaatcggccctcaggggtccctgaccgattctctggctccaagtctgacacctcagcctccctggccatcactgggctccaggctgacgatgaggctgattattactgccagtcctatgacagcagcctgagtggttcaatgatattcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2707 - DNA, 660 bp, Artificial Sequence
  Synthetic polynucleotide encoding artificial human antibody VL chain
ctccctgtgctgactcagccaccttcctcctccgcatctcctggagaatccgccagactcacctgcaccttgcccagtgacatcaatgttactaactacaacatatactggtaccagcagaagccagggagccctcccaggtatctcctgtaccagtactcagactcagataagggccaggtctctggagtccccagccgcttctctggatccaaagatgcttcagccaatacagggattttactcatctccgggctccagtctgaggatgaggctgactattactgtatgatttggtcaagccttgtggtattcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2708 - DNA, 659 bp, Artificial Sequence
  Synthetic polynucleotide encoding artificial human antibody VL chain
gggatattgtgatgactcagtctccactctccctgcccgtcacccctggagagccggcctccatctcctgcaggtctagtcagagcctcctgcatagtgatggatacaactatttggattggttcctgcagaagccagggcagtctccacagctcctcatctatttgggttcttatcgggcctccggggtccctgacaggttcagtggcagtggctcaggcacagattttacactgaaaatcaccagagtggaggctgaggatgttggggtttattactgcatgcaagctctacaaactccgtggacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2709 - DNA, 642 bp, Artificial Sequence
  Synthetic polynucleotide encoding artificial human antibody VL chain
gtcatccaaatgacccagtctccatcctccctgtctgcatctgtaggagacagagtcaccatcgcttgccgggcaagtcagggcattagaaatgatttaggctggtatcagcagaaaccagggagagcccctaaactcctgatctatgctgcatccactttacaaagtggggtcccatcaaggttcagcggcagtggatctggcacagatttcactctcaccatctacagcctgcagcctgaagattttgcaacttattactgtctacaaaattacaattacccttggacgttcggccaagggaccaaggtggagatccaaggaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2710 - DNA, 659 bp, Artificial Sequence
  Synthetic polynucleotide encoding artificial human antibody VL chain
cggatattgtgatgacccagactccactctctctgtccgtcacccctggacagccggcctccatctcctgcaagtctagtcagagcctcctgcatagtgatggaaagacctatttgtattggtacctgcagaagccaggccagtctccacagctcctaatctatgaagtttccagccggttctctggagtgccagataggttcagtggcagcgggtcagggacagatttcacactgaaaatcagccgggtggaggctgaggatgttggggtttattactgcatgcaaggtatacaccttcctaggacttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2711 - DNA, 24 bp, Artificial Sequence
  Synthetic polynucleotide encoding artificial human antibody CDR-H1 region
gaagtgacgttcaacacttatggc

SEQ ID NO: 2712 - DNA, 24 bp, Artificial Sequence
  Synthetic polynucleotide encoding artificial human antibody CDR-H1 region
ggattcacctttagtagctattgg

SEQ ID NO: 2713 - DNA, 24 bp, Artificial Sequence
  Synthetic polynucleotide encoding artificial human antibody CDR-H1 region
ggattcacctttgaagattatgcc

SEQ ID NO: 2714 - DNA, 30 bp, Artificial Sequence
  Synthetic polynucleotide encoding artificial human antibody CDR-H1 region
gggttctcactcagcactagtggagtgggt

SEQ ID NO: 2715 - DNA, 24 bp, Artificial Sequence
  Synthetic polynucleotide encoding artificial human antibody CDR-H1 region
ggatataccttcaccacctactat

SEQ ID NO: 2716 - DNA, 24 bp, Artificial Sequence
  Synthetic polynucleotide encoding artificial human antibody CDR-H1 region
ggattcgtctttgatgattatgcc

SEQ ID NO: 2717 - DNA, 24 bp, Artificial Sequence
  Synthetic polynucleotide encoding artificial human antibody CDR-H1 region
ggttacacctttaccaactatggt

SEQ ID NO: 2718 - DNA, 24 bp, Artificial Sequence
  Synthetic polynucleotide encoding artificial human antibody CDR-H1 region
ggattcacctttgatgattatgcc

SEQ ID NO: 2719 - DNA, 24 bp, Artificial Sequence
  Synthetic polynucleotide encoding artificial human antibody CDR-H1 region
ggattcacttttagttactatggc

SEQ ID NO: 2720 - DNA, 24 bp, Artificial Sequence
  Synthetic polynucleotide encoding artificial human antibody CDR-H1 region
ggattcccctttggtgattatgcc

SEQ ID NO: 2721 - DNA, 24 bp, Artificial Sequence
  Synthetic polynucleotide encoding artificial human antibody CDR-H1 region
ggttacatcgatatcaacaacggc

SEQ ID NO: 2722 - DNA, 24 bp, Artificial Sequence
  Synthetic polynucleotide encoding artificial human antibody CDR-H1 region
ggattcaccttcactcgccatggt

SEQ ID NO: 2723 - DNA, 24 bp, Artificial Sequence
  Synthetic polynucleotide encoding artificial human antibody CDR-H1 region
cgattcacctttagcagctatgcc

SEQ ID NO: 2724 - DNA, 30 bp, Artificial Sequence
  Synthetic polynucleotide encoding artificial human antibody CDR-H1 region
ggggacggtgtctctagcaacagtgctagt

SEQ ID NO: 2725 - DNA, 24 bp, Artificial Sequence
  Synthetic polynucleotide encoding artificial human antibody CDR-H1 region
ggattcgccttcagtagtaatggc

SEQ ID NO: 2726 - DNA, 24 bp, Artificial Sequence
  Synthetic polynucleotide encoding artificial human antibody CDR-H1 region
ggaatcaccttcagtagctatgac

SEQ ID NO: 2727 - DNA, 24 bp, Artificial Sequence
  Synthetic polynucleotide encoding artificial human antibody CDR-H1 region
ggttacaactttaccaactatggt

SEQ ID NO: 2728 - DNA, 24 bp, Artificial Sequence
  Synthetic polynucleotide encoding artificial human antibody CDR-H1 region
ggattcagcttcaggagttatgaa

SEQ ID NO: 2729 - DNA, 24 bp, Artificial Sequence
  Synthetic polynucleotide encoding artificial human antibody CDR-H1 region
ggatacatcttcactagctatgct

SEQ ID NO: 2730 - DNA, 27 bp, Artificial Sequence
  Synthetic polynucleotide encoding artificial human antibody CDR-H1 region
ggttacttaatcagtagtggctactac

SEQ ID NO: 2731 - DNA, 30 bp, Artificial Sequence
  Synthetic polynucleotide encoding artificial human antibody CDR-H1 region
gggttctcactcaacactagtggagtgggt

SEQ ID NO: 2732 - DNA, 24 bp, Artificial Sequence
  Synthetic polynucleotide encoding artificial human antibody CDR-H1 region
ggattcaccttcagcaactatagc

SEQ ID NO: 2733 - DNA, 24 bp, Artificial Sequence
  Synthetic polynucleotide encoding artificial human antibody CDR-H1 region
ggattcaccttcagtagctatagc

SEQ ID NO: 2734 - DNA, 24 bp, Artificial Sequence
  Synthetic polynucleotide encoding artificial human antibody CDR-H1 region
ggtgactccatgagtttttactat

SEQ ID NO: 2735 - DNA, 30 bp, Artificial Sequence
  Synthetic polynucleotide encoding artificial human antibody CDR-H1 region
ggtggctccatcagcagtggtagttactac

SEQ ID NO: 2736 - DNA, 24 bp, Artificial Sequence
  Synthetic polynucleotide encoding artificial human antibody CDR-H1 region
ggatttagtttcagtagttatagc

SEQ ID NO: 2737 - DNA, 30 bp, Artificial Sequence
  Synthetic polynucleotide encoding artificial human antibody CDR-H1 region
ggtggctccatcagcagaagtccttacttc

SEQ ID NO: 2738 - DNA, 24 bp, Artificial Sequence
  Synthetic polynucleotide encoding artificial human antibody CDR-H1 region
ggattcaccttcactagttatggc

SEQ ID NO: 2739 - DNA, 24 bp, Artificial Sequence
  Synthetic polynucleotide encoding artificial human antibody CDR-H1 region
agtggctccagtggtagttattac

SEQ ID NO: 2740 - DNA, 24 bp, Artificial Sequence
  Synthetic polynucleotide encoding artificial human antibody CDR-H1 region
ggatacaacttcagggactactat

SEQ ID NO: 2741 - DNA, 30 bp, Artificial Sequence
  Synthetic polynucleotide encoding artificial human antibody CDR-H1 region
ggtggctccatcaacagtggtgattaccac

SEQ ID NO: 2742 - DNA, 30 bp, Artificial Sequence
  Synthetic polynucleotide encoding artificial human antibody CDR-H1 region
ggtggctccatcagcagtagtggttactac

SEQ ID NO: 2743 - DNA, 24 bp, Artificial Sequence
  Synthetic polynucleotide encoding artificial human antibody CDR-H1 region
ggattcaccttcagtagctatggc

SEQ ID NO: 2744 - DNA, 30 bp, Artificial Sequence
  Synthetic polynucleotide encoding artificial human antibody CDR-H1 region
gggttctcactcaccactagtggagtgggt

SEQ ID NO: 2745 - DNA, 24 bp, Artificial Sequence
  Synthetic polynucleotide encoding artificial human antibody CDR-H1 region
ggattcaccttcagtacatatgaa

SEQ ID NO: 2746 - DNA, 24 bp, Artificial Sequence
  Synthetic polynucleotide encoding artificial human antibody CDR-H1 region
ggaggcaccttcagcagctatgct

SEQ ID NO: 2747 - DNA, 30 bp, Artificial Sequence
  Synthetic polynucleotide encoding artificial human antibody CDR-H1 region
ggtggctccatcagcagtgataattactac

SEQ ID NO: 2748 - DNA, 24 bp, Artificial Sequence
  Synthetic polynucleotide encoding artificial human antibody CDR-H1 region
ggtgcctccatcagtagttactac

SEQ ID NO: 2749 - DNA, 24 bp, Artificial Sequence
  Synthetic polynucleotide encoding artificial human antibody CDR-H1 region
ggaaacaccttcactacctatact

SEQ ID NO: 2750 - DNA, 24 bp, Artificial Sequence
  Synthetic polynucleotide encoding artificial human antibody CDR-H1 region
ggattcacctttagcagctatgcc

SEQ ID NO: 2751 - DNA, 24 bp, Artificial Sequence
  Synthetic polynucleotide encoding artificial human antibody CDR-H1 region
ggattcacctttgatgattatggc

SEQ ID NO: 2752 - DNA, 24 bp, Artificial Sequence
  Synthetic polynucleotide encoding artificial human antibody CDR-H1 region
ggattcaccttcagtagctatggc

SEQ ID NO: 2753 - DNA, 30 bp, Artificial Sequence
  Synthetic polynucleotide encoding artificial human antibody CDR-H1 region
ggtggctccatcagcagtggtggttactac

SEQ ID NO: 2754 - DNA, 24 bp, Artificial Sequence
  Synthetic polynucleotide encoding artificial human antibody CDR-H1 region
ggatacaccttcaccggctactat

SEQ ID NO: 2755 - DNA, 24 bp, Artificial Sequence
  Synthetic polynucleotide encoding artificial human antibody CDR-H1 region
ggattcaccttcagtagctacgac

SEQ ID NO: 2756 - DNA, 24 bp, Artificial Sequence
  Synthetic polynucleotide encoding artificial human antibody CDR-H1 region
ggattcaccttcaggagttatggc

SEQ ID NO: 2757 - DNA, 24 bp, Artificial Sequence
  Synthetic polynucleotide encoding artificial human antibody CDR-H1 region
ggattcaccttcagtgactactac

SEQ ID NO: 2758 - DNA, 24 bp, Artificial Sequence
  Synthetic polynucleotide encoding artificial human antibody CDR-H1 region
ggattcaccttcagtagttatcac

SEQ ID NO: 2759 - DNA, 24 bp, Artificial Sequence
  Synthetic polynucleotide encoding artificial human antibody CDR-H1 region
ggattcaccttcagtagctatgct

SEQ ID NO: 2760 - DNA, 24 bp, Artificial Sequence
  Synthetic polynucleotide encoding artificial human antibody CDR-H1 region
ggattcacccttgaagagtttgcc

SEQ ID NO: 2761 - DNA, 24 bp, Artificial Sequence
  Synthetic polynucleotide encoding artificial human antibody CDR-H1 region
ggtggctccatcagtgattactac

SEQ ID NO: 2762 - DNA, 24 bp, Artificial Sequence
  Synthetic polynucleotide encoding artificial human antibody CDR-H1 region
ggaggcaccttcagcagctatgct

SEQ ID NO: 2763 - DNA, 24 bp, Artificial Sequence
  Synthetic polynucleotide encoding artificial human antibody CDR-H1 region
ggttacacctttagcagctacggt

SEQ ID NO: 2764 - DNA, 24 bp, Artificial Sequence
  Synthetic polynucleotide encoding artificial human antibody CDR-H1 region
ggattcaccttccggagttatgaa

SEQ ID NO: 2765 - DNA, 24 bp, Artificial Sequence
  Synthetic polynucleotide encoding artificial human antibody CDR-H1 region
ggaggcaccttcagcagctatgct

SEQ ID NO: 2766 - DNA, 24 bp, Artificial Sequence
  Synthetic polynucleotide encoding artificial human antibody CDR-H1 region
ggagacagcttcaacaagtacttt

SEQ ID NO: 2767 - DNA, 24 bp, Artificial Sequence
  Synthetic polynucleotide encoding artificial human antibody CDR-H1 region
ggtttcacattcagtacctatggc

SEQ ID NO: 2768 - DNA, 24 bp, Artificial Sequence
  Synthetic polynucleotide encoding artificial human antibody CDR-H1 region
ggattcgcctttagcagctatgcc

SEQ ID NO: 2769 - DNA, 24 bp, Artificial Sequence
  Synthetic polynucleotide encoding artificial human antibody CDR-H1 region
ggattcaccttcagtaatcatgct

SEQ ID NO: 2770 - DNA, 24 bp, Artificial Sequence
  Synthetic polynucleotide encoding artificial human antibody CDR-H1 region
ggattcaccttcagtagtcatggc

SEQ ID NO: 2771 - DNA, 30 bp, Artificial Sequence
  Synthetic polynucleotide encoding artificial human antibody CDR-H1 region
ggtggctccgtcgacaatgttgattcctac

SEQ ID NO: 2772 - DNA, 24 bp, Artificial Sequence
  Synthetic polynucleotide encoding artificial human antibody CDR-H1 region
ggatacagctttaccacctactgg

SEQ ID NO: 2773 - DNA, 30 bp, Artificial Sequence
  Synthetic polynucleotide encoding artificial human antibody CDR-H1 region
ggtgactccatcagcagtgggagttactat

SEQ ID NO: 2774 - DNA, 30 bp, Artificial Sequence
  Synthetic polynucleotide encoding artificial human antibody CDR-H1 region
ggggacagtgtctctagcaacagtgctgct

SEQ ID NO: 2775 - DNA, 24 bp, Artificial Sequence
  Synthetic polynucleotide encoding artificial human antibody CDR-H1 region
ggatacaccctcagtgaattatcc

SEQ ID NO: 2776 - DNA, 24 bp, Artificial Sequence
  Synthetic polynucleotide encoding artificial human antibody CDR-H1 region
ggattcaccttcagtagctatagc

SEQ ID NO: 2777 - DNA, 24 bp, Artificial Sequence
  Synthetic polynucleotide encoding artificial human antibody CDR-H1 region
ggattcacctttagcaactatgcc

SEQ ID NO: 2778 - DNA, 24 bp, Artificial Sequence
  Synthetic polynucleotide encoding artificial human antibody CDR-H1 region
ggaggccccttcagcagctatact

SEQ ID NO: 2779 - DNA, 30 bp, Artificial Sequence
  Synthetic polynucleotide encoding artificial human antibody CDR-H1 region
ggtggctccgtcaacactggtacttcctac

SEQ ID NO: 2780 - DNA, 24 bp, Artificial Sequence
  Synthetic polynucleotide encoding artificial human antibody CDR-H1 region
ggattccatttcggcagtcacggc

SEQ ID NO: 2781 - DNA, 30 bp, Artificial Sequence
  Synthetic polynucleotide encoding artificial human antibody CDR-H1 region
ggtggctccatcaccactggtagttattac

SEQ ID NO: 2782 - DNA, 24 bp, Artificial Sequence
  Synthetic polynucleotide encoding artificial human antibody CDR-H1 region
ggattcacctttgatgattatgcc

SEQ ID NO: 2783 - DNA, 24 bp, Artificial Sequence
  Synthetic polynucleotide encoding artificial human antibody CDR-H1 region
ggtgcctccatgaataattactac

SEQ ID NO: 2784 - DNA, 30 bp, Artificial Sequence
  Synthetic polynucleotide encoding artificial human antibody CDR-H1 region
gggttctcactcaccactactgacgtgggt

SEQ ID NO: 2785 - DNA, 24 bp, Artificial Sequence
  Synthetic polynucleotide encoding artificial human antibody CDR-H1 region
ggattcaccttcagtagctattcc

SEQ ID NO: 2786 - DNA, 24 bp, Artificial Sequence
  Synthetic polynucleotide encoding artificial human antibody CDR-H1 region
ggatacaactttatcagccactgg

SEQ ID NO: 2787 - DNA, 24 bp, Artificial Sequence
  Synthetic polynucleotide encoding artificial human antibody CDR-H1 region
ggatacagctttaccagcttctgg

SEQ ID NO: 2788 - DNA, 24 bp, Artificial Sequence
  Synthetic polynucleotide encoding artificial human antibody CDR-H1 region
ggtggctccatcgatagttattac

SEQ ID NO: 2789 - DNA, 24 bp, Artificial Sequence
  Synthetic polynucleotide encoding artificial human antibody CDR-H1 region
ggaggcatcttcagttactttgct

SEQ ID NO: 2790 - DNA, 24 bp, Artificial Sequence
  Synthetic polynucleotide encoding artificial human antibody CDR-H1 region
gaattcagctttcaatatttttcc

SEQ ID NO: 2791 - DNA, 27 bp, Artificial Sequence
  Synthetic polynucleotide encoding artificial human antibody CDR-H1 region
ggttacacccttaacaatgatgtcgct

SEQ ID NO: 2792 - DNA, 24 bp, Artificial Sequence
  Synthetic polynucleotide encoding artificial human antibody CDR-H1 region
ggattcaggtttaattactattgg

SEQ ID NO: 2793 - DNA, 30 bp, Artificial Sequence
  Synthetic polynucleotide encoding artificial human antibody CDR-H1 region
ggtggctccatcagtggtgataaaaacttc

SEQ ID NO: 2794 - DNA, 24 bp, Artificial Sequence
  Synthetic polynucleotide encoding artificial human antibody CDR-H1 region
ggattcacattcagtgattatgaa

SEQ ID NO: 2795 - DNA, 24 bp, Artificial Sequence
  Synthetic polynucleotide encoding artificial human antibody CDR-H1 region
ggattcccccctaggagttttgcc

SEQ ID NO: 2796 - DNA, 24 bp, Artificial Sequence
  Synthetic polynucleotide encoding artificial human antibody CDR-H1 region
ggattcaccttcagcaactatggg

SEQ ID NO: 2797 - DNA, 24 bp, Artificial Sequence
  Synthetic polynucleotide encoding artificial human antibody CDR-H1 region
ggattcacctttgatgattatacc

SEQ ID NO: 2798 - DNA, 24 bp, Artificial Sequence
  Synthetic polynucleotide encoding artificial human antibody CDR-H1 region
ggtgacacctttcccaactatgtt

SEQ ID NO: 2799 - DNA, 24 bp, Artificial Sequence
  Synthetic polynucleotide encoding artificial human antibody CDR-H1 region
ggattcacatttgatgattatgcc

SEQ ID NO: 2800 - DNA, 24 bp, Artificial Sequence
  Synthetic polynucleotide encoding artificial human antibody CDR-H1 region
ggattcacctttagcagctatgcc

SEQ ID NO: 2801 - DNA, 24 bp, Artificial Sequence
  Synthetic polynucleotide encoding artificial human antibody CDR-H1 region
ggattcaccttcagtaactatgac

SEQ ID NO: 2802 - DNA, 24 bp, Artificial Sequence
  Synthetic polynucleotide encoding artificial human antibody CDR-H1 region
ggattcaccttcagtccctatagt

SEQ ID NO: 2803 - DNA, 30 bp, Artificial Sequence
  Synthetic polynucleotide encoding artificial human antibody CDR-H1 region
ggtggctccatcaccagtggtagttacttc

SEQ ID NO: 2804 - DNA, 30 bp, Artificial Sequence
  Synthetic polynucleotide encoding artificial human antibody CDR-H1 region
ggtggctccgtcagcagtagtagttactac

SEQ ID NO: 2805 - DNA, 24 bp, Artificial Sequence
  Synthetic polynucleotide encoding artificial human antibody CDR-H1 region
ggattcaccttcagtaactatgac

SEQ ID NO: 2806 - DNA, 24 bp, Artificial Sequence
  Synthetic polynucleotide encoding artificial human antibody CDR-H1 region
ggctacgcctttatcggtaactgg

SEQ ID NO: 2807 - DNA, 30 bp, Artificial Sequence
  Synthetic polynucleotide encoding artificial human antibody CDR-H1 region
ggattcaccttttcctttagcagttatgcc

SEQ ID NO: 2808 - DNA, 24 bp, Artificial Sequence
  Synthetic polynucleotide encoding artificial human antibody CDR-H1 region
ggattcaccttcaataattatgaa

SEQ ID NO: 2809 - DNA, 24 bp, Artificial Sequence
  Synthetic polynucleotide encoding artificial human antibody CDR-H1 region
ggattcacctttagtagcaattgg

SEQ ID NO: 2810 - DNA, 30 bp, Artificial Sequence; identical to SEQ ID NO: 2753
  Synthetic polynucleotide encoding artificial human antibody CDR-H1 region

SEQ ID NO: 2811 - DNA, 24 bp, Artificial Sequence
  Synthetic polynucleotide encoding artificial human antibody CDR-H1 region
ggattcacgttcagtagctatggc

SEQ ID NO: 2812 - DNA, 24 bp, Artificial Sequence
  Synthetic polynucleotide encoding artificial human antibody CDR-H1 region
ggattcaccttcagtgactactac

SEQ ID NO: 2813 - DNA, 30 bp, Artificial Sequence
  Synthetic polynucleotide encoding artificial human antibody CDR-H1 region
ggtggctccatcagcagtggtggttacccc

SEQ ID NO: 2814 - DNA, 24 bp, Artificial Sequence
  Synthetic polynucleotide encoding artificial human antibody CDR-H1 region
ggtggctccatcagtatttactac

SEQ ID NO: 2815 - DNA, 24 bp, Artificial Sequence
  Synthetic polynucleotide encoding artificial human antibody CDR-H1 region
aatagctccatcagtagttactac

SEQ ID NO: 2816 - DNA, 24 bp, Artificial Sequence
  Synthetic polynucleotide encoding artificial human antibody CDR-H1 region
ggattcacctttaatagctattgg

SEQ ID NO: 2817 - DNA, 24 bp, Artificial Sequence
  Synthetic polynucleotide encoding artificial human antibody CDR-H1 region
ggattcacctttgatgattatgcc

SEQ ID NO: 2818 - DNA, 24 bp, Artificial Sequence
  Synthetic polynucleotide encoding artificial human antibody CDR-H1 region
ggttacaggtttaacgcctactgg

SEQ ID NO: 2819 - DNA, 30 bp, Artificial Sequence
  Synthetic polynucleotide encoding artificial human antibody CDR-H1 region
ggggacagtgtctctagtaccagtggtgct

SEQ ID NO: 2820 - DNA, 30 bp, Artificial Sequence; identical to SEQ ID NO: 2774
  Synthetic polynucleotide encoding artificial human antibody CDR-H1 region

SEQ ID NO: 2821 - DNA, 24 bp, Artificial Sequence
  Synthetic polynucleotide encoding artificial human antibody CDR-H1 region
ggtggctccatcagtagttactac

SEQ ID NO: 2822 - DNA, 24 bp, Artificial Sequence
  Synthetic polynucleotide encoding artificial human antibody CDR-H1 region
ggatacagctttaccagctactgg

SEQ ID NO: 2823 - DNA, 24 bp, Artificial Sequence
  Synthetic polynucleotide encoding artificial human antibody CDR-H1 region
ggattcaccttcagtagctatggc

SEQ ID NO: 2824 - DNA, 24 bp, Artificial Sequence
  Synthetic polynucleotide encoding artificial human antibody CDR-H1 region
gggttcactttcagatcctacagc

SEQ ID NO: 2825 - DNA, 24 bp, Artificial Sequence
  Synthetic polynucleotide encoding artificial human antibody CDR-H1 region
ggaggcaccttcagcagttatact

SEQ ID NO: 2826 - DNA, 24 bp, Artificial Sequence
  Synthetic polynucleotide encoding artificial human antibody CDR-H1 region
ggattcagcttcagcagatataat

SEQ ID NO: 2827 - DNA, 24 bp, Artificial Sequence
  Synthetic polynucleotide encoding artificial human antibody CDR-H1 region
ggattcaccttcactaattatgcc

SEQ ID NO: 2828 - DNA, 24 bp, Artificial Sequence
  Synthetic polynucleotide encoding artificial human antibody CDR-H1 region
ggattctccttcagtagttttggc

SEQ ID NO: 2829 - DNA, 24 bp, Artificial Sequence
  Synthetic polynucleotide encoding artificial human antibody CDR-H1 region
ggattcacatttagctcgtatgcc

SEQ ID NO: 2830 - DNA, 24 bp, Artificial Sequence
  Synthetic polynucleotide encoding artificial human antibody CDR-H1 region
ggattcaccttcagtagtcatggc

SEQ ID NO: 2831 - DNA, 24 bp, Artificial Sequence
  Synthetic polynucleotide encoding artificial human antibody CDR-H1 region
ggattcagctttagtacctattgg

SEQ ID NO: 2832 - DNA, 24 bp, Artificial Sequence
  Synthetic polynucleotide encoding artificial human antibody CDR-H1 region
ggattcaccttcaataactactgg

SEQ ID NO: 2833 - DNA, 24 bp, Artificial Sequence
  Synthetic polynucleotide encoding artificial human antibody CDR-H1 region
ggatttactttcagtcacggctgg

SEQ ID NO: 2834 - DNA, 24 bp, Artificial Sequence
  Synthetic polynucleotide encoding artificial human antibody CDR-H1 region
ggtggctccatcagaaatgactac

SEQ ID NO: 2835 - DNA, 24 bp, Artificial Sequence
  Synthetic polynucleotide encoding artificial human antibody CDR-H1 region
ggaggcaccttcagcagctatgct

SEQ ID NO: 2836 - DNA, 30 bp, Artificial Sequence
  Synthetic polynucleotide encoding artificial human antibody CDR-H1 region
ggtggctccatcagcagtagtaattacttc

SEQ ID NO: 2837 - DNA, 24 bp, Artificial Sequence
  Synthetic polynucleotide encoding artificial human antibody CDR-H1 region
ggatttaccttcagtgactactgg

SEQ ID NO: 2838 - DNA, 30 bp, Artificial Sequence
  Synthetic polynucleotide encoding artificial human antibody CDR-H1 region
gatgtctccatcatcagtagtttctattac

SEQ ID NO: 2839 - DNA, 30 bp, Artificial Sequence
  Synthetic polynucleotide encoding artificial human antibody CDR-H1 region
ggtgcctccgtttccagtggttcttactac

SEQ ID NO: 2840 - DNA, 24 bp, Artificial Sequence
  Synthetic polynucleotide encoding artificial human antibody CDR-H1 region
ggaggcaccttcagcggctatggc

SEQ ID NO: 2841 - DNA, 24 bp, Artificial Sequence
  Synthetic polynucleotide encoding artificial human antibody CDR-H1 region
ggattcaccttcagtagctactgg

SEQ ID NO: 2842 - DNA, 30 bp, Artificial Sequence
  Synthetic polynucleotide encoding artificial human antibody CDR-H1 region
ggtggctccatcagcagtggagattactac

SEQ ID NO: 2843 - DNA, 24 bp, Artificial Sequence
  Synthetic polynucleotide encoding artificial human antibody CDR-H1 region
ggattcacctttagcagctatgcc

SEQ ID NO: 2844 - DNA, 24 bp, Artificial Sequence
  Synthetic polynucleotide encoding artificial human antibody CDR-H1 region
ggattcacctttagcagctatgcc

SEQ ID NO: 2845 - DNA, 24 bp, Artificial Sequence
  Synthetic polynucleotide encoding artificial human antibody CDR-H1 region
ggattcaccttgagcagctatgct

SEQ ID NO: 2846 - DNA, 30 bp, Artificial Sequence
  Synthetic polynucleotide encoding artificial human antibody CDR-H1 region
ggtggctccatcagcagtggtggttactcc

SEQ ID NO: 2847 - DNA, 24 bp, Artificial Sequence
  Synthetic polynucleotide encoding artificial human antibody CDR-H1 region
ggattcaccttcagtaactctgct

SEQ ID NO: 2848 - DNA, 24 bp, Artificial Sequence
  Synthetic polynucleotide encoding artificial human antibody CDR-H1 region
ggatacaccttcaccagtcactat

SEQ ID NO: 2849 - DNA, 24 bp, Artificial Sequence
  Synthetic polynucleotide encoding artificial human antibody CDR-H1 region
ggattcaccttcagcgcctactgg

SEQ ID NO: 2850 - DNA, 24 bp, Artificial Sequence
  Synthetic polynucleotide encoding artificial human antibody CDR-H1 region
ggatactccctcactgaaatctcc

SEQ ID NO: 2851 - DNA, 30 bp, Artificial Sequence
  Synthetic polynucleotide encoding artificial human antibody CDR-H1 region
ggtggctccatcaggagcagtgctcccttc

SEQ ID NO: 2852 - DNA, 24 bp, Artificial Sequence
  Synthetic polynucleotide encoding artificial human antibody CDR-H1 region
ggttacatctttaccacctatgtt

SEQ ID NO: 2853 - DNA, 24 bp, Artificial Sequence
  Synthetic polynucleotide encoding artificial human antibody CDR-H1 region
ggattcacgtttgatgattatgcc

SEQ ID NO: 2854 - DNA, 24 bp, Artificial Sequence
  Synthetic polynucleotide encoding artificial human antibody CDR-H1 region
ggattcaccttcaataattactgg

SEQ ID NO: 2855 - DNA, 24 bp, Artificial Sequence
  Synthetic polynucleotide encoding artificial human antibody CDR-H1 region
ggtgactccgtcagtagtttctac

SEQ ID NO: 2856 - DNA, 24 bp, Artificial Sequence
  Synthetic polynucleotide encoding artificial human antibody CDR-H1 region
ggatataattttaatgatgatcgg

SEQ ID NO: 2857 - DNA, 24 bp, Artificial Sequence
  Synthetic polynucleotide encoding artificial human antibody CDR-H1 region
ggattcaccgtcagtaccaactac

SEQ ID NO: 2858 - DNA, 24 bp, Artificial Sequence
  Synthetic polynucleotide encoding artificial human antibody CDR-H1 region
ggattcacgttcagtgaccactac

SEQ ID NO: 2859 - DNA, 24 bp, Artificial Sequence
  Synthetic polynucleotide encoding artificial human antibody CDR-H1 region
ggattcaccttccgtgattatggc

SEQ ID NO: 2860 - DNA, 24 bp, Artificial Sequence
  Synthetic polynucleotide encoding artificial human antibody CDR-H1 region
ggattcgacatcaggagttatacc

SEQ ID NO: 2861 - DNA, 24 bp, Artificial Sequence
  Synthetic polynucleotide encoding artificial human antibody CDR-H1 region
ggatacaccttcaccgactactat

SEQ ID NO: 2862 - DNA, 24 bp, Artificial Sequence
  Synthetic polynucleotide encoding artificial human antibody CDR-H1 region
ggattcacctttagcaactatgcc

SEQ ID NO: 2863 - DNA, 24 bp, Artificial Sequence
  Synthetic polynucleotide encoding artificial human antibody CDR-H1 region
ggattcaacttcaattcttataca

SEQ ID NO: 2864 - DNA, 24 bp, Artificial Sequence
  Synthetic polynucleotide encoding artificial human antibody CDR-H1 region
ggattcacatttgatgattatgcc

SEQ ID NO: 2865 - DNA, 24 bp, Artificial Sequence
  Synthetic polynucleotide encoding artificial human antibody CDR-H1 region
ggaggcaccttcagcagctatggt

SEQ ID NO: 2866 - DNA, 24 bp, Artificial Sequence
  Synthetic polynucleotide encoding artificial human antibody CDR-H1 region
ggattaacctttaacagatttgcc

SEQ ID NO: 2867 - DNA, 27 bp, Artificial Sequence
  Synthetic polynucleotide encoding artificial human antibody CDR-H1 region
ggctactccattagcactgcttactac

SEQ ID NO: 2868 - DNA, 24 bp, Artificial Sequence
  Synthetic polynucleotide encoding artificial human antibody CDR-H1 region
ggaggcaacgtcagaagttatagc

SEQ ID NO: 2869 - DNA, 24 bp, Artificial Sequence
  Synthetic polynucleotide encoding artificial human antibody CDR-H1 region
ggtgactccatcagtagtaactac

SEQ ID NO: 2870 - DNA, 24 bp, Artificial Sequence
  Synthetic polynucleotide encoding artificial human antibody CDR-H1 region
ggttacaggttttccaactttggg

SEQ ID NO: 2871 - DNA, 24 bp, Artificial Sequence
  Synthetic polynucleotide encoding artificial human antibody CDR-H1 region
ggatacacgttcactaattatgct

SEQ ID NO: 2872 - DNA, 30 bp, Artificial Sequence
  Synthetic polynucleotide encoding artificial human antibody CDR-H1 region
ggtgactccatcagcagcagtagctacttc

SEQ ID NO: 2873 - DNA, 24 bp, Artificial Sequence
  Synthetic polynucleotide encoding artificial human antibody CDR-H1 region
ggattcaccttcagtaactatggc

SEQ ID NO: 2874 - DNA, 24 bp, Artificial Sequence
  Synthetic polynucleotide encoding artificial human antibody CDR-H1 region
ggaggctccttcaacacctatgca

SEQ ID NO: 2875 - DNA, 24 bp, Artificial Sequence
  Synthetic polynucleotide encoding artificial human antibody CDR-H1 region
ggagacaccttcacctcttttgcc

SEQ ID NO: 2876 - DNA, 30 bp, Artificial Sequence
  Synthetic polynucleotide encoding artificial human antibody CDR-H1 region
ggtgactccatcagtaacggtgattattgc

SEQ ID NO: 2877 - DNA, 24 bp, Artificial Sequence
  Synthetic polynucleotide encoding artificial human antibody CDR-H1 region
ggattcacctttagaagctattgg

SEQ ID NO: 2878 - DNA, 24 bp, Artificial Sequence
  Synthetic polynucleotide encoding artificial human antibody CDR-H1 region
ggattcacctacgacagttatgtc

SEQ ID NO: 2879 - DNA, 30 bp, Artificial Sequence
  Synthetic polynucleotide encoding artificial human antibody CDR-H1 region
agtggctccgtcagcagtggtagtcactac

SEQ ID NO: 2880 - DNA, 24 bp, Artificial Sequence
  Synthetic polynucleotide encoding artificial human antibody CDR-H1 region
ggatacagcttcaccggctattat

SEQ ID NO: 2881 - DNA, 24 bp, Artificial Sequence
  Synthetic polynucleotide encoding artificial human antibody CDR-H1 region
ggattcaccttcagtaactatggc

SEQ ID NO: 2882 - DNA, 24 bp, Artificial Sequence
  Synthetic polynucleotide encoding artificial human antibody CDR-H1 region
ggattcaccttcagtaactataac

SEQ ID NO: 2883 - DNA, 30 bp, Artificial Sequence
  Synthetic polynucleotide encoding artificial human antibody CDR-H1 region
ggtggctccatcagcagtagtagttactac

SEQ ID NO: 2884 - DNA, 24 bp, Artificial Sequence
  Synthetic polynucleotide encoding artificial human antibody CDR-H1 region
ggtttcactttcagtaacgcctgg

SEQ ID NO: 2885 - DNA, 24 bp, Artificial Sequence
  Synthetic polynucleotide encoding artificial human antibody CDR-H1 region
ggatacaccttcaccaactacttt

SEQ ID NO: 2886 - DNA, 24 bp, Artificial Sequence
  Synthetic polynucleotide encoding artificial human antibody CDR-H1 region
ggaggcaccttcaacaactatggt

SEQ ID NO: 2887 - DNA, 24 bp, Artificial Sequence
  Synthetic polynucleotide encoding artificial human antibody CDR-H1 region
ggattcaccttcagtagttatgag

SEQ ID NO: 2888 - DNA, 24 bp, Artificial Sequence
  Synthetic polynucleotide encoding artificial human antibody CDR-H1 region
ggattcaccttcacgacctatgct

SEQ ID NO: 2889 - DNA, 24 bp, Artificial Sequence
  Synthetic polynucleotide encoding artificial human antibody CDR-H1 region
ggatacacctttaccagctactgg

SEQ ID NO: 2890 - DNA, 24 bp, Artificial Sequence
  Synthetic polynucleotide encoding artificial human antibody CDR-H1 region
ggactcaccttcagcatttatagc

SEQ ID NO: 2891 - DNA, 30 bp, Artificial Sequence
  Synthetic polynucleotide encoding artificial human antibody CDR-H1 region
gggttctcactcagcaatgctagaatgggt

SEQ ID NO: 2892 - DNA, 24 bp, Artificial Sequence
  Synthetic polynucleotide encoding artificial human antibody CDR-H1 region
ggatacaccttcaccgtctactat

SEQ ID NO: 2893 - DNA, 24 bp, Artificial Sequence
  Synthetic polynucleotide encoding artificial human antibody CDR-H1 region
ggttacacctttaccagctatggt

SEQ ID NO: 2894 - DNA, 30 bp, Artificial Sequence
  Synthetic polynucleotide encoding artificial human antibody CDR-H1 region
ggggacagtgtctctagcaccagtgctgct

SEQ ID NO: 2895 - DNA, 27 bp, Artificial Sequence
  Synthetic polynucleotide encoding artificial human antibody CDR-H1 region
ggtggctccatcagcagtagtaactgc

SEQ ID NO: 2896 - DNA, 24 bp, Artificial Sequence
  Synthetic polynucleotide encoding artificial human antibody CDR-H1 region
gggttcaccgtcagtagcaactac

SEQ ID NO: 2897 - DNA, 24 bp, Artificial Sequence
  Synthetic polynucleotide encoding artificial human antibody CDR-H1 region
ggatacaccttcaccacctactac

SEQ ID NO: 2898 - DNA, 30 bp, Artificial Sequence
  Synthetic polynucleotide encoding artificial human antibody CDR-H1 region
ggtggctccgtcagcagtggtagttactac

SEQ ID NO: 2899 - DNA, 30 bp, Artificial Sequence
  Synthetic polynucleotide encoding artificial human antibody CDR-H1 region
ggtggctccatcagcagtagtttcttctac

SEQ ID NO: 2900 - DNA, 24 bp, Artificial Sequence
  Synthetic polynucleotide encoding artificial human antibody CDR-H1 region
ggattcaccttcagtagctatgct

SEQ ID NO: 2901 - DNA, 24 bp, Artificial Sequence
  Synthetic polynucleotide encoding artificial human antibody CDR-H1 region
ggattcacctttagcacctatgtc

SEQ ID NO: 2902 - DNA, 30 bp, Artificial Sequence; identical to SEQ ID NO: 2883
  Synthetic polynucleotide encoding artificial human antibody CDR-H1 region

SEQ ID NO: 2903 - DNA, 24 bp, Artificial Sequence
  Synthetic polynucleotide encoding artificial human antibody CDR-H1 region
ggatacaccttcaccggctactat

SEQ ID NO: 2904 - DNA, 24 bp, Artificial Sequence
  Synthetic polynucleotide encoding artificial human antibody CDR-H1 region
ggatacagctttaccagctactgg

SEQ ID NO: 2905 - DNA, 24 bp, Artificial Sequence
  Synthetic polynucleotide encoding artificial human antibody CDR-H1 region
ggatacagctttaccacctactgg

SEQ ID NO: 2906 - DNA, 24 bp, Artificial Sequence
  Synthetic polynucleotide encoding artificial human antibody CDR-H1 region
ggattcacctttagaatctatgcc

SEQ ID NO: 2907 - DNA, 24 bp, Artificial Sequence
  Synthetic polynucleotide encoding artificial human antibody CDR-H1 region
ggatacaccttcaccagctactat

SEQ ID NO: 2908 - DNA, 24 bp, Artificial Sequence
  Synthetic polynucleotide encoding artificial human antibody CDR-H1 region
ggattagacttcagggactactat

SEQ ID NO: 2909 - DNA, 24 bp, Artificial Sequence
  Synthetic polynucleotide encoding artificial human antibody CDR-H1 region
ggattcacctttatcagttatgcc

SEQ ID NO: 2910 - DNA, 24 bp, Artificial Sequence
  Synthetic polynucleotide encoding artificial human antibody CDR-H1 region
ggatacaccttcactagtcatgcc

SEQ ID NO: 2911 - DNA, 24 bp, Artificial Sequence
  Synthetic polynucleotide encoding artificial human antibody CDR-H1 region
ggatacaccttcactaactatgct

SEQ ID NO: 2912 - DNA, 24 bp, Artificial Sequence
  Synthetic polynucleotide encoding artificial human antibody CDR-H1 region
ggattcaccttcagtaactttgct

SEQ ID NO: 2913 - DNA, 24 bp, Artificial Sequence
  Synthetic polynucleotide encoding artificial human antibody CDR-H1 region
ggattcaccttcagtcactacgcc

SEQ ID NO: 2914 - DNA, 24 bp, Artificial Sequence
  Synthetic polynucleotide encoding artificial human antibody CDR-H1 region
ggattcaccttcagtagctatagc

SEQ ID NO: 2915 - DNA, 30 bp, Artificial Sequence
  Synthetic polynucleotide encoding artificial human antibody CDR-H1 region
gggttctcactcagtactaatggagtgggt

SEQ ID NO: 2916 - DNA, 30 bp, Artificial Sequence
  Synthetic polynucleotide encoding artificial human antibody CDR-H1 region
gggttgtcactcagcactagtggagtggct

SEQ ID NO: 2917 - DNA, 30 bp, Artificial Sequence
  Synthetic polynucleotide encoding artificial human antibody CDR-H1 region
ggtggctccatcagcagcggtggttactgc

SEQ ID NO: 2918 - DNA, 24 bp, Artificial Sequence
  Synthetic polynucleotide encoding artificial human antibody CDR-H1 region
ggattcacctttagtagctattgg

SEQ ID NO: 2919 - DNA, 24 bp, Artificial Sequence
  Synthetic polynucleotide encoding artificial human antibody CDR-H1 region
agaggcaccttcagcaaccatgct

SEQ ID NO: 2920 - DNA, 24 bp, Artificial Sequence
  Synthetic polynucleotide encoding artificial human antibody CDR-H1 region
ggaggcaccttcaacttctatgct

SEQ ID NO: 2921 - DNA, 24 bp, Artificial Sequence
  Synthetic polynucleotide encoding artificial human antibody CDR-H1 region
ggatataacttcattgacaatgct

SEQ ID NO: 2922 - DNA, 24 bp, Artificial Sequence
  Synthetic polynucleotide encoding artificial human antibody CDR-H1 region
ggttacacttttacccactatggt

SEQ ID NO: 2923 - DNA, 24 bp, Artificial Sequence
  Synthetic polynucleotide encoding artificial human antibody CDR-H1 region
ggattcacctttagcaactatgcc

SEQ ID NO: 2924 - DNA, 24 bp, Artificial Sequence
  Synthetic polynucleotide encoding artificial human antibody CDR-H1 region
ggatacaccttcagcagctactat

SEQ ID NO: 2925 - DNA, 24 bp, Artificial Sequence
  Synthetic polynucleotide encoding artificial human antibody CDR-H1 region
ggatacaactttagtcgctactgg

SEQ ID NO: 2926 - DNA, 24 bp, Artificial Sequence
  Synthetic polynucleotide encoding artificial human antibody CDR-H1 region
ggattcaccttcaatagatatggc

SEQ ID NO: 2927 - DNA, 24 bp, Artificial Sequence
  Synthetic polynucleotide encoding artificial human antibody CDR-H1 region
ggatacagctttaccagcttctgg

SEQ ID NO: 2928 - DNA, 24 bp, Artificial Sequence
  Synthetic polynucleotide encoding artificial human antibody CDR-H1 region
ggattcaccctggatgattatgtc

SEQ ID NO: 2929 - DNA, 30 bp, Artificial Sequence
  Synthetic polynucleotide encoding artificial human antibody CDR-H1 region
ggtgactccatcagtagtagcggtttcttc

SEQ ID NO: 2930 - DNA, 24 bp, Artificial Sequence
  Synthetic polynucleotide encoding artificial human antibody CDR-H1 region
ggaggccccttcaagacctaccct

SEQ ID NO: 2931 - DNA, 24 bp, Artificial Sequence
  Synthetic polynucleotide encoding artificial human antibody CDR-H1 region
ggattcacctttggtgataatgct

SEQ ID NO: 2932 - DNA, 24 bp, Artificial Sequence
  Synthetic polynucleotide encoding artificial human antibody CDR-H1 region
ggttacacctttagtaattacggt

SEQ ID NO: 2933 - DNA, 24 bp, Artificial Sequence
  Synthetic polynucleotide encoding artificial human antibody CDR-H1 region
ggattcgactttacttcgtattgg

SEQ ID NO: 2934 - DNA, 24 bp, Artificial Sequence
  Synthetic polynucleotide encoding artificial human antibody CDR-H1 region
ggattcaccttcagtagctatagc

SEQ ID NO: 2935 - DNA, 30 bp, Artificial Sequence
  Synthetic polynucleotide encoding artificial human antibody CDR-H1 region
ggtgtctccatcggcaccagtagttactat

SEQ ID NO: 2936 - DNA, 24 bp, Artificial Sequence
  Synthetic polynucleotide encoding artificial human antibody CDR-H1 region
ggtgactccttcagtgattactac

SEQ ID NO: 2937 - DNA, 24 bp, Artificial Sequence
  Synthetic polynucleotide encoding artificial human antibody CDR-H1 region
ggattcaccttcagtaattatgcc

SEQ ID NO: 2938 - DNA, 24 bp, Artificial Sequence
  Synthetic polynucleotide encoding artificial human antibody CDR-H1 region
ggttacagatttaccagcaatggt

SEQ ID NO: 2939 - DNA, 24 bp, Artificial Sequence
  Synthetic polynucleotide encoding artificial human antibody CDR-H1 region
ggattcacctttgatgattatggc

SEQ ID NO: 2940 - DNA, 24 bp, Artificial Sequence
  Synthetic polynucleotide encoding artificial human antibody CDR-H1 region
ggattcagtttcagtgcctatggc

SEQ ID NO: 2941 - DNA, 24 bp, Artificial Sequence
  Synthetic polynucleotide encoding artificial human antibody CDR-H1 region
gaattcacctttagcgcctatgcc

SEQ ID NO: 2942 - DNA, 24 bp, Artificial Sequence
  Synthetic polynucleotide encoding artificial human antibody CDR-H1 region
ggtttcactttcagtaacgcctgg

SEQ ID NO: 2943 - DNA, 24 bp, Artificial Sequence
  Synthetic polynucleotide encoding artificial human antibody CDR-H1 region
ggactcaccttcagtgactatggc

SEQ ID NO: 2944 - DNA, 24 bp, Artificial Sequence
  Synthetic polynucleotide encoding artificial human antibody CDR-H1 region
ggttacgtctttaccagctttggg

SEQ ID NO: 2945 - DNA, 24 bp, Artificial Sequence
  Synthetic polynucleotide encoding artificial human antibody CDR-H1 region
ggattcaccttcgaagacttcggc

SEQ ID NO: 2946 - DNA, 24 bp, Artificial Sequence
  Synthetic polynucleotide encoding artificial human antibody CDR-H1 region
ggattcaccctcagtacctatggc

SEQ ID NO: 2947 - DNA, 24 bp, Artificial Sequence
  Synthetic polynucleotide encoding artificial human antibody CDR-H1 region
ggatataccttcagtaactatgct

SEQ ID NO: 2948 - DNA, 24 bp, Artificial Sequence
  Synthetic polynucleotide encoding artificial human antibody CDR-H1 region
ggatacagcttttccacctactgg

SEQ ID NO: 2949 - DNA, 30 bp, Artificial Sequence
  Synthetic polynucleotide encoding artificial human antibody CDR-H1 region
gggttctcactcaccacatatggagtgggt

SEQ ID NO: 2950 - DNA, 24 bp, Artificial Sequence
  Synthetic polynucleotide encoding artificial human antibody CDR-H1 region
ggattcaccttcagtgcttatggc

SEQ ID NO: 2951 - DNA, 24 bp, Artificial Sequence
  Synthetic polynucleotide encoding artificial human antibody CDR-H1 region
ggaggcaccttcagcgaatatggt

SEQ ID NO: 2952 - DNA, 30 bp, Artificial Sequence
  Synthetic polynucleotide encoding artificial human antibody CDR-H1 region
ggtgcctccgtcaacagtgggactcacttc

SEQ ID NO: 2953 - DNA, 24 bp, Artificial Sequence
  Synthetic polynucleotide encoding artificial human antibody CDR-H1 region
ggattcaccttcagtagctatgct

SEQ ID NO: 2954 - DNA, 24 bp, Artificial Sequence
  Synthetic polynucleotide encoding artificial human antibody CDR-H1 region
ggattcaccttcagtagctatagc

SEQ ID NO: 2955 - DNA, 30 bp, Artificial Sequence
  Synthetic polynucleotide encoding artificial human antibody CDR-H1 region
ggtgactccatcagcaggagtaattactac

SEQ ID NO: 2956 - DNA, 24 bp, Artificial Sequence
  Synthetic polynucleotide encoding artificial human antibody CDR-H1 region
ggattcacctttagtaagttttgg

SEQ ID NO: 2957 - DNA, 30 bp, Artificial Sequence
  Synthetic polynucleotide encoding artificial human antibody CDR-H1 region
gggttctctctgaccactactggagtgggt

SEQ ID NO: 2958 - DNA, 24 bp, Artificial Sequence
  Synthetic polynucleotide encoding artificial human antibody CDR-H1 region
ggattcatcttcagtagctatggc

SEQ ID NO: 2959 - DNA, 24 bp, Artificial Sequence
  Synthetic polynucleotide encoding artificial human antibody CDR-H1 region
ggattcaccttcagtagttatgaa

SEQ ID NO: 2960 - DNA, 24 bp, Artificial Sequence
  Synthetic polynucleotide encoding artificial human antibody CDR-H1 region
ggattcaccttcagtagctatagc

SEQ ID NO: 2961 - DNA, 30 bp, Artificial Sequence
  Synthetic polynucleotide encoding artificial human antibody CDR-H1 region
gggttctcactcagcactagtggaatgtgt

SEQ ID NO: 2962 - DNA, 24 bp, Artificial Sequence
  Synthetic polynucleotide encoding artificial human antibody CDR-H1 region
ggattcacctttagtagctattgg

SEQ ID NO: 2963 - DNA, 24 bp, Artificial Sequence
  Synthetic polynucleotide encoding artificial human antibody CDR-H1 region
ggattcacctttgccagctatggc

SEQ ID NO: 2964 - DNA, 24 bp, Artificial Sequence
  Synthetic polynucleotide encoding artificial human antibody CDR-H1 region
ggattcaccttcagtagctatagt

SEQ ID NO: 2965 - DNA, 24 bp, Artificial Sequence
  Synthetic polynucleotide encoding artificial human antibody CDR-H1 region
ggatacatcttcaccggctccttt

SEQ ID NO: 2966 - DNA, 30 bp, Artificial Sequence
  Synthetic polynucleotide encoding artificial human antibody CDR-H1 region
ggtggctccatcagcagtggtacttactac

SEQ ID NO: 2967 - DNA, 24 bp, Artificial Sequence
  Synthetic polynucleotide encoding artificial human antibody CDR-H1 region
ggatacagctttaccaactactgg

SEQ ID NO: 2968 - DNA, 24 bp, Artificial Sequence
  Synthetic polynucleotide encoding artificial human antibody CDR-H1 region
ggattcactttcagtaacgcctgg

SEQ ID NO: 2969 - DNA, 24 bp, Artificial Sequence
  Synthetic polynucleotide encoding artificial human antibody CDR-H1 region
ggattccccttcagtacctatgct

SEQ ID NO: 2970 - DNA, 24 bp, Artificial Sequence
  Synthetic polynucleotide encoding artificial human antibody CDR-H1 region
ggtttctccttcagtggctcttct

SEQ ID NO: 2971 - DNA, 24 bp, Artificial Sequence
  Synthetic polynucleotide encoding artificial human antibody CDR-H1 region
ggtggctccatcagtagttattac

SEQ ID NO: 2972 - DNA, 24 bp, Artificial Sequence
  Synthetic polynucleotide encoding artificial human antibody CDR-H1 region
ggattcacctttggtgattatgct

SEQ ID NO: 2973 - DNA, 24 bp, Artificial Sequence
  Synthetic polynucleotide encoding artificial human antibody CDR-H1 region
ggattcaccctcagtaactatggc

SEQ ID NO: 2974 - DNA, 24 bp, Artificial Sequence
  Synthetic polynucleotide encoding artificial human antibody CDR-H1 region
ggattcagcatcactacccatagc

SEQ ID NO: 2975 - DNA, 24 bp, Artificial Sequence
  Synthetic polynucleotide encoding artificial human antibody CDR-H1 region
ggattcaccttcagtagttatgag

SEQ ID NO: 2976 - DNA, 24 bp, Artificial Sequence
  Synthetic polynucleotide encoding artificial human antibody CDR-H1 region
ggattcaccttcagtagctatagc

SEQ ID NO: 2977 - DNA, 24 bp, Artificial Sequence
  Synthetic polynucleotide encoding artificial human antibody CDR-H1 region
gggttcagcgtcagtagcaagtac

SEQ ID NO: 2978 - DNA, 24 bp, Artificial Sequence
  Synthetic polynucleotide encoding artificial human antibody CDR-H1 region
ggatacagctttaccaactactgg

SEQ ID NO: 2979 - DNA, 24 bp, Artificial Sequence
  Synthetic polynucleotide encoding artificial human antibody CDR-H1 region
gggttcaccttcagtggctctgct

SEQ ID NO: 2980 - DNA, 24 bp, Artificial Sequence
  Synthetic polynucleotide encoding artificial human antibody CDR-H1 region
ggattcaccttcagtgactatggc

SEQ ID NO: 2981 - DNA, 24 bp, Artificial Sequence
  Synthetic polynucleotide encoding artificial human antibody CDR-H1 region
ggatacaccttcaataactatggc

SEQ ID NO: 2982 - DNA, 18 bp, Artificial Sequence
  Synthetic polynucleotide encoding artificial human antibody CDR-L1 region
cagggtgttagcagctac

SEQ ID NO: 2983 - DNA, 18 bp, Artificial Sequence
  Synthetic polynucleotide encoding artificial human antibody CDR-L1 region
cagagcattggcagctat

SEQ ID NO: 2984 - DNA, 18 bp, Artificial Sequence
  Synthetic polynucleotide encoding artificial human antibody CDR-L1 region
cagggtattgacgtctgg

SEQ ID NO: 2985 - DNA, 24 bp, Artificial Sequence
  Synthetic polynucleotide encoding artificial human antibody CDR-L1 region
agttccaacatcggaagtaattat

SEQ ID NO: 2986 - DNA, 18 bp, Artificial Sequence
  Synthetic polynucleotide encoding artificial human antibody CDR-L1 region
agcctcagaaactattat

SEQ ID NO: 2987 - DNA, 18 bp, Artificial Sequence
  Synthetic polynucleotide encoding artificial human antibody CDR-L1 region
aacattggaattaaaagt

SEQ ID NO: 2988 - DNA, 18 bp, Artificial Sequence
  Synthetic polynucleotide encoding artificial human antibody CDR-L1 region
cagagcataagcagttat

SEQ ID NO: 2989 - DNA, 21 bp, Artificial Sequence
  Synthetic polynucleotide encoding artificial human antibody CDR-L1 region
cagagtgttagcagcagctac

SEQ ID NO: 2990 - DNA, 24 bp, Artificial Sequence
  Synthetic polynucleotide encoding artificial human antibody CDR-L1 region
agtggcaacattgccagctactat

SEQ ID NO: 2991 - DNA, 21 bp, Artificial Sequence
  Synthetic polynucleotide encoding artificial human antibody CDR-L1 region
cagagtgttagcagcagttac

SEQ ID NO: 2992 - DNA, 24 bp, Artificial Sequence
  Synthetic polynucleotide encoding artificial human antibody CDR-L1 region
agctccaatattgagaataatgat

SEQ ID NO: 2993 - DNA, 33 bp, Artificial Sequence
  Synthetic polynucleotide encoding artificial human antibody CDR-L1 region
caaagcctcgtacacagtgatggaaacacctac

SEQ ID NO: 2994 - DNA, 24 bp, Artificial Sequence
  Synthetic polynucleotide encoding artificial human antibody CDR-L1 region
agctccaatatcgggagaaattat

SEQ ID NO: 2995 - DNA, 24 bp, Artificial Sequence
  Synthetic polynucleotide encoding artificial human antibody CDR-L1 region
atctccaacatcggaagtaatcct

SEQ ID NO: 2996 - DNA, 18 bp, Artificial Sequence
  Synthetic polynucleotide encoding artificial human antibody CDR-L1 region
cagaatgttaacttcaac

SEQ ID NO: 2997 - DNA, 21 bp, Artificial Sequence
  Synthetic polynucleotide encoding artificial human antibody CDR-L1 region
cagagtgttagcagcagctcc

SEQ ID NO: 2998 - DNA, 18 bp, Artificial Sequence
  Synthetic polynucleotide encoding artificial human antibody CDR-L1 region
gctttgccaaagcaatat

SEQ ID NO: 2999 - DNA, 18 bp, Artificial Sequence
  Synthetic polynucleotide encoding artificial human antibody CDR-L1 region
cagagtgttagcagctac

SEQ ID NO: 3000 - DNA, 18 bp, Artificial Sequence
  Synthetic polynucleotide encoding artificial human antibody CDR-L1 region
cagagtgttggcagctac

SEQ ID NO: 3001 - DNA, 18 bp, Artificial Sequence
  Synthetic polynucleotide encoding artificial human antibody CDR-L1 region
caggccattgccaactct

SEQ ID NO: 3002 - DNA, 36 bp, Artificial Sequence
  Synthetic polynucleotide encoding artificial human antibody CDR-L1 region
cagagtgttttatacagctccaacaatgagaactac

SEQ ID NO: 3003 - DNA, 18 bp, Artificial Sequence
  Synthetic polynucleotide encoding artificial human antibody CDR-L1 region
cacaacattaacacctat

SEQ ID NO: 3004 - DNA, 27 bp, Artificial Sequence
  Synthetic polynucleotide encoding artificial human antibody CDR-L1 region
agcagtgacgttggtggttataactat

SEQ ID NO: 3005 - DNA, 24 bp, Artificial Sequence
  Synthetic polynucleotide encoding artificial human antibody CDR-L1 region
agcgccaacatcggaaagaattat

SEQ ID NO: 3006 - DNA, 18 bp, Artificial Sequence
  Synthetic polynucleotide encoding artificial human antibody CDR-L1 region
cagagcattagcacttat

SEQ ID NO: 3007 - DNA, 18 bp, Artificial Sequence
  Synthetic polynucleotide encoding artificial human antibody CDR-L1 region
cagagcattaagaactat

SEQ ID NO: 3008 - DNA, 27 bp, Artificial Sequence
  Synthetic polynucleotide encoding artificial human antibody CDR-L1 region
agctccaacatcggggcaggttatgat

SEQ ID NO: 3009 - DNA, 18 bp, Artificial Sequence
  Synthetic polynucleotide encoding artificial human antibody CDR-L1 region
aacattggaagtaaaact

SEQ ID NO: 3010 - DNA, 18 bp, Artificial Sequence
  Synthetic polynucleotide encoding artificial human antibody CDR-L1 region
caggatattagcaactgg

SEQ ID NO: 3011 - DNA, 18 bp, Artificial Sequence
  Synthetic polynucleotide encoding artificial human antibody CDR-L1 region
gcattgccaaacgaaaat

SEQ ID NO: 3012 - DNA, 27 bp, Artificial Sequence
  Synthetic polynucleotide encoding artificial human antibody CDR-L1 region
accagtgacattggtagttatgaccgt

SEQ ID NO: 3013 - DNA, 24 bp, Artificial Sequence
  Synthetic polynucleotide encoding artificial human antibody CDR-L1 region
agctccaacattgggaacaattat

SEQ ID NO: 3014 - DNA, 33 bp, Artificial Sequence
  Synthetic polynucleotide encoding artificial human antibody CDR-L1 region
caaagcctcgtatacagtgatggaaacacctac

SEQ ID NO: 3015 - DNA, 21 bp, Artificial Sequence
  Synthetic polynucleotide encoding artificial human antibody CDR-L1 region
cagagtattagaagcagctac

SEQ ID NO: 3016 - DNA, 27 bp, Artificial Sequence
  Synthetic polynucleotide encoding artificial human antibody CDR-L1 region
acctccaacatcggggctggttatgat

SEQ ID NO: 3017 - DNA, 18 bp, Artificial Sequence
  Synthetic polynucleotide encoding artificial human antibody CDR-L1 region
cagagcattagcagctat

SEQ ID NO: 3018 - DNA, 36 bp, Artificial Sequence
  Synthetic polynucleotide encoding artificial human antibody CDR-L1 region
cagaatgttttatacagttccaacaataaaaactac

SEQ ID NO: 3019 - DNA, 27 bp, Artificial Sequence
  Synthetic polynucleotide encoding artificial human antibody CDR-L1 region
agctccaacatcggggcaggttatgat

SEQ ID NO: 3020 - DNA, 24 bp, Artificial Sequence
  Synthetic polynucleotide encoding artificial human antibody CDR-L1 region
agtggcagcattgccagcagctat

SEQ ID NO: 3021 - DNA, 18 bp, Artificial Sequence
  Synthetic polynucleotide encoding artificial human antibody CDR-L1 region
cagagcattagcagctat

SEQ ID NO: 3022 - DNA, 18 bp, Artificial Sequence
  Synthetic polynucleotide encoding artificial human antibody CDR-L1 region
aacattggaagtaaaagt

SEQ ID NO: 3023 - DNA, 27 bp, Artificial Sequence
  Synthetic polynucleotide encoding artificial human antibody CDR-L1 region
agcagtgacgttggtggttataactat

SEQ ID NO: 3024 - DNA, 18 bp, Artificial Sequence
  Synthetic polynucleotide encoding artificial human antibody CDR-L1 region
cagagcattagcagctat

SEQ ID NO: 3025 - DNA, 18 bp, Artificial Sequence
  Synthetic polynucleotide encoding artificial human antibody CDR-L1 region
cagggcattaacagtgcc

SEQ ID NO: 3026 - DNA, 18 bp, Artificial Sequence
  Synthetic polynucleotide encoding artificial human antibody CDR-L1 region
agcctcagaaggtattat

SEQ ID NO: 3027 - DNA, 18 bp, Artificial Sequence
  Synthetic polynucleotide encoding artificial human antibody CDR-L1 region
cagggtattaggaattgg

SEQ ID NO: 3028 - DNA, 18 bp, Artificial Sequence
  Synthetic polynucleotide encoding artificial human antibody CDR-L1 region
cagagcgttggcacctat

SEQ ID NO: 3029 - DNA, 21 bp, Artificial Sequence
  Synthetic polynucleotide encoding artificial human antibody CDR-L1 region
cagagcgttagcagtaattac

SEQ ID NO: 3030 - DNA, 21 bp, Artificial Sequence
  Synthetic polynucleotide encoding artificial human antibody CDR-L1 region
cagagtgttagcagcaggtac

SEQ ID NO: 3031 - DNA, 18 bp, Artificial Sequence
  Synthetic polynucleotide encoding artificial human antibody CDR-L1 region
cagagtgttggcagctcc

SEQ ID NO: 3032 - DNA, 18 bp, Artificial Sequence
  Synthetic polynucleotide encoding artificial human antibody CDR-L1 region
cagagtattagtagctgg

SEQ ID NO: 3033 - DNA, 18 bp, Artificial Sequence
  Synthetic polynucleotide encoding artificial human antibody CDR-L1 region
aacattggaagtaaaagt

SEQ ID NO: 3034 - DNA, 18 bp, Artificial Sequence
  Synthetic polynucleotide encoding artificial human antibody CDR-L1 region
cagagtgttagcacctac

SEQ ID NO: 3035 - DNA, 33 bp, Artificial Sequence
  Synthetic polynucleotide encoding artificial human antibody CDR-L1 region
cagagcctcctgcatagtaatggatacaactat

SEQ ID NO: 3036 - DNA, 18 bp, Artificial Sequence
  Synthetic polynucleotide encoding artificial human antibody CDR-L1 region
cagagtattagtagctgg

SEQ ID NO: 3037 - DNA, 27 bp, Artificial Sequence
  Synthetic polynucleotide encoding artificial human antibody CDR-L1 region
tctggctcagtctcaactggaaactac

SEQ ID NO: 3038 - DNA, 21 bp, Artificial Sequence
  Synthetic polynucleotide encoding artificial human antibody CDR-L1 region
cagagtgttagcagcagctac

SEQ ID NO: 3039 - DNA, 18 bp, Artificial Sequence
  Synthetic polynucleotide encoding artificial human antibody CDR-L1 region
aacattggaagtaagagt

SEQ ID NO: 3040 - DNA, 18 bp, Artificial Sequence
  Synthetic polynucleotide encoding artificial human antibody CDR-L1 region
cagagtattagtaggtgg

SEQ ID NO: 3041 - DNA, 18 bp, Artificial Sequence
  Synthetic polynucleotide encoding artificial human antibody CDR-L1 region
caagacattgatgatgat

SEQ ID NO: 3042 - DNA, 21 bp, Artificial Sequence
  Synthetic polynucleotide encoding artificial human antibody CDR-L1 region
cagagtattggcgccgcctac

SEQ ID NO: 3043 - DNA, 18 bp, Artificial Sequence
  Synthetic polynucleotide encoding artificial human antibody CDR-L1 region
gcattgccaaaaaaatat

SEQ ID NO: 3044 - DNA, 33 bp, Artificial Sequence
  Synthetic polynucleotide encoding artificial human antibody CDR-L1 region
cagagcctcctgcatagtgatggatacaactat

SEQ ID NO: 3045 - DNA, 27 bp, Artificial Sequence
  Synthetic polynucleotide encoding artificial human antibody CDR-L1 region
agcagtgacgttggtggttataactat

SEQ ID NO: 3046 - DNA, 18 bp, Artificial Sequence
  Synthetic polynucleotide encoding artificial human antibody CDR-L1 region
cagagtattagcagtaac

SEQ ID NO: 3047 - DNA, 27 bp, Artificial Sequence
  Synthetic polynucleotide encoding artificial human antibody CDR-L1 region
agcagtgacgttggtggttataactat

SEQ ID NO: 3048 - DNA, 33 bp, Artificial Sequence
  Synthetic polynucleotide encoding artificial human antibody CDR-L1 region
cagcgcctcctgcatagtgatggaaagacctat

SEQ ID NO: 3049 - DNA, 21 bp, Artificial Sequence
  Synthetic polynucleotide encoding artificial human antibody CDR-L1 region
cagagtgtcagcagtagcttc

SEQ ID NO: 3050 - DNA, 18 bp, Artificial Sequence
  Synthetic polynucleotide encoding artificial human antibody CDR-L1 region
caggacgttgacacttat

SEQ ID NO: 3051 - DNA, 24 bp, Artificial Sequence
  Synthetic polynucleotide encoding artificial human antibody CDR-L1 region
agctccaatattgggaaatattct

SEQ ID NO: 3052 - DNA, 18 bp, Artificial Sequence
  Synthetic polynucleotide encoding artificial human antibody CDR-L1 region
cagagtgttggtagctcc

SEQ ID NO: 3053 - DNA, 21 bp, Artificial Sequence
  Synthetic polynucleotide encoding artificial human antibody CDR-L1 region
cagagtgttagcagcagctac

SEQ ID NO: 3054 - DNA, 18 bp, Artificial Sequence
  Synthetic polynucleotide encoding artificial human antibody CDR-L1 region
cagagtattagtgtctgg

SEQ ID NO: 3055 - DNA, 18 bp, Artificial Sequence
  Synthetic polynucleotide encoding artificial human antibody CDR-L1 region
agtctcagaaggtattat

SEQ ID NO: 3056 - DNA, 18 bp, Artificial Sequence
  Synthetic polynucleotide encoding artificial human antibody CDR-L1 region
cagagcattagcagctat

SEQ ID NO: 3057 - DNA, 21 bp, Artificial Sequence
  Synthetic polynucleotide encoding artificial human antibody CDR-L1 region
cagagtgttagcagcagctac

SEQ ID NO: 3058 - DNA, 24 bp, Artificial Sequence
  Synthetic polynucleotide encoding artificial human antibody CDR-L1 region
agctccaacattgacaataattat

SEQ ID NO: 3059 - DNA, 18 bp, Artificial Sequence
  Synthetic polynucleotide encoding artificial human antibody CDR-L1 region
cagaccattagcacctac

SEQ ID NO: 3060 - DNA, 36 bp, Artificial Sequence
  Synthetic polynucleotide encoding artificial human antibody CDR-L1 region
cagactgttttacacagttccaacaataggaactac

SEQ ID NO: 3061 - DNA, 18 bp, Artificial Sequence
  Synthetic polynucleotide encoding artificial human antibody CDR-L1 region
cagagtgttgacggcaac

SEQ ID NO: 3062 - DNA, 18 bp, Artificial Sequence
  Synthetic polynucleotide encoding artificial human antibody CDR-L1 region
cagagcattagcaactat

SEQ ID NO: 3063 - DNA, 27 bp, Artificial Sequence
  Synthetic polynucleotide encoding artificial human antibody CDR-L1 region
agctccaacatcggggcaggttatgat

SEQ ID NO: 3064 - DNA, 18 bp, Artificial Sequence
  Synthetic polynucleotide encoding artificial human antibody CDR-L1 region
cagagtgtgagcaccaac

SEQ ID NO: 3065 - DNA, 18 bp, Artificial Sequence
  Synthetic polynucleotide encoding artificial human antibody CDR-L1 region
cagagtgtgagtggctac

SEQ ID NO: 3066 - DNA, 24 bp, Artificial Sequence
  Synthetic polynucleotide encoding artificial human antibody CDR-L1 region
aggtccaacgtcgccagtcatgct

SEQ ID NO: 3067 - DNA, 36 bp, Artificial Sequence
  Synthetic polynucleotide encoding artificial human antibody CDR-L1 region
cagagcctcttggacagtgatgatggaaaaacctat

SEQ ID NO: 3068 - DNA, 18 bp, Artificial Sequence
  Synthetic polynucleotide encoding artificial human antibody CDR-L1 region
aaattgggggataaatat

SEQ ID NO: 3069 - DNA, 18 bp, Artificial Sequence
  Synthetic polynucleotide encoding artificial human antibody CDR-L1 region
aaattgggggatatatgt

SEQ ID NO: 3070 - DNA, 36 bp, Artificial Sequence
  Synthetic polynucleotide encoding artificial human antibody CDR-L1 region
cagagtcttttctatagctccaacaataagaactac

SEQ ID NO: 3071 - DNA, 18 bp, Artificial Sequence
  Synthetic polynucleotide encoding artificial human antibody CDR-L1 region
cagagtgttagcagctac

SEQ ID NO: 3072 - DNA, 18 bp, Artificial Sequence
  Synthetic polynucleotide encoding artificial human antibody CDR-L1 region
cagagtgttagcaactat

SEQ ID NO: 3073 - DNA, 33 bp, Artificial Sequence
  Synthetic polynucleotide encoding artificial human antibody CDR-L1 region
cagagcctcctacagagtaatggaaacaactat

SEQ ID NO: 3074 - DNA, 18 bp, Artificial Sequence
  Synthetic polynucleotide encoding artificial human antibody CDR-L1 region
cagagtattagtggctgg

SEQ ID NO: 3075 - DNA, 24 bp, Artificial Sequence
  Synthetic polynucleotide encoding artificial human antibody CDR-L1 region
agctccaacattggaaataattat

SEQ ID NO: 3076 - DNA, 18 bp, Artificial Sequence
  Synthetic polynucleotide encoding artificial human antibody CDR-L1 region
cagagtgttagcaactat

SEQ ID NO: 3077 - DNA, 33 bp, Artificial Sequence
  Synthetic polynucleotide encoding artificial human antibody CDR-L1 region
cagagcctccttcgtcgtgatggaaacaactat

SEQ ID NO: 3078 - DNA, 27 bp, Artificial Sequence
  Synthetic polynucleotide encoding artificial human antibody CDR-L1 region
agcagtgacgttggtggttttaactat

SEQ ID NO: 3079 - DNA, 33 bp, Artificial Sequence; identical to SEQ ID NO: 3014
  Synthetic polynucleotide encoding artificial human antibody CDR-L1 region

SEQ ID NO: 3080 - DNA, 18 bp, Artificial Sequence
  Synthetic polynucleotide encoding artificial human antibody CDR-L1 region
cagagtattagcagctat

SEQ ID NO: 3081 - DNA, 18 bp, Artificial Sequence
  Synthetic polynucleotide encoding artificial human antibody CDR-L1 region
caggacattagcaactat

SEQ ID NO: 3082 - DNA, 18 bp, Artificial Sequence
  Synthetic polynucleotide encoding artificial human antibody CDR-L1 region
aacattggaagtaaaagt

SEQ ID NO: 3083 - DNA, 18 bp, Artificial Sequence
  Synthetic polynucleotide encoding artificial human antibody CDR-L1 region
caggtcattagcgattat

SEQ ID NO: 3084 - DNA, 18 bp, Artificial Sequence
  Synthetic polynucleotide encoding artificial human antibody CDR-L1 region
cagagcattagcacttat

SEQ ID NO: 3085 - DNA, 18 bp, Artificial Sequence
  Synthetic polynucleotide encoding artificial human antibody CDR-L1 region
cagagaattagtaactgg

SEQ ID NO: 3086 - DNA, 33 bp, Artificial Sequence
  Synthetic polynucleotide encoding artificial human antibody CDR-L1 region
cagagcctcctgaatcctgatggaaagacctat

SEQ ID NO: 3087 - DNA, 18 bp, Artificial Sequence
  Synthetic polynucleotide encoding artificial human antibody CDR-L1 region
cagagcattagcggctat

SEQ ID NO: 3088 - DNA, 27 bp, Artificial Sequence
  Synthetic polynucleotide encoding artificial human antibody CDR-L1 region
agctccaacgtcggggcagattatgat

SEQ ID NO: 3089 - DNA, 18 bp, Artificial Sequence
  Synthetic polynucleotide encoding artificial human antibody CDR-L1 region
cagagtgttagcagctcc

SEQ ID NO: 3090 - DNA, 21 bp, Artificial Sequence
  Synthetic polynucleotide encoding artificial human antibody CDR-L1 region
cagagttttgacggcaagtcc

SEQ ID NO: 3091 - DNA, 36 bp, Artificial Sequence
  Synthetic polynucleotide encoding artificial human antibody CDR-L1 region
cagagtattttatacagctccaacaataaggactcc

SEQ ID NO: 3092 - DNA, 21 bp, Artificial Sequence
  Synthetic polynucleotide encoding artificial human antibody CDR-L1 region
cagagtgttagcggcagccac

SEQ ID NO: 3093 - DNA, 27 bp, Artificial Sequence
  Synthetic polynucleotide encoding artificial human antibody CDR-L1 region
agcagtgacgttggtggttataactat

SEQ ID NO: 3094 - DNA, 18 bp, Artificial Sequence
  Synthetic polynucleotide encoding artificial human antibody CDR-L1 region
gcattgccaaaaaaatat

SEQ ID NO: 3095 - DNA, 18 bp, Artificial Sequence
  Synthetic polynucleotide encoding artificial human antibody CDR-L1 region
cagagtgttagcagcaac

SEQ ID NO: 3096 - DNA, 21 bp, Artificial Sequence
  Synthetic polynucleotide encoding artificial human antibody CDR-L1 region
cagagtgttagcagcagctac

SEQ ID NO: 3097 - DNA, 27 bp, Artificial Sequence
  Synthetic polynucleotide encoding artificial human antibody CDR-L1 region
agcagtgacgttggtctttataacttt

SEQ ID NO: 3098 - DNA, 27 bp, Artificial Sequence
  Synthetic polynucleotide encoding artificial human antibody CDR-L1 region
aactccaacatcggggcaggttattat

SEQ ID NO: 3099 - DNA, 21 bp, Artificial Sequence
  Synthetic polynucleotide encoding artificial human antibody CDR-L1 region
cagagtgttaccagcagctac

SEQ ID NO: 3100 - DNA, 24 bp, Artificial Sequence
  Synthetic polynucleotide encoding artificial human antibody CDR-L1 region
agctccaacatcggagataatttt

SEQ ID NO: 3101 - DNA, 18 bp, Artificial Sequence
  Synthetic polynucleotide encoding artificial human antibody CDR-L1 region
caagacattgacgatgat

SEQ ID NO: 3102 - DNA, 18 bp, Artificial Sequence
  Synthetic polynucleotide encoding artificial human antibody CDR-L1 region
cagagtgttggtagctgg

SEQ ID NO: 3103 - DNA, 18 bp, Artificial Sequence
  Synthetic polynucleotide encoding artificial human antibody CDR-L1 region
caggacattagcagtttt

SEQ ID NO: 3104 - DNA, 18 bp, Artificial Sequence
  Synthetic polynucleotide encoding artificial human antibody CDR-L1 region
agcctcagagactattct

SEQ ID NO: 3105 - DNA, 18 bp, Artificial Sequence
  Synthetic polynucleotide encoding artificial human antibody CDR-L1 region
cagagtgttagcgcctac

SEQ ID NO: 3106 - DNA, 18 bp, Artificial Sequence
  Synthetic polynucleotide encoding artificial human antibody CDR-L1 region
aacattggaagtaaaagt

SEQ ID NO: 3107 - DNA, 27 bp, Artificial Sequence
  Synthetic polynucleotide encoding artificial human antibody CDR-L1 region
agcagtgatgttggaaattataacctt

SEQ ID NO: 3108 - DNA, 18 bp, Artificial Sequence
  Synthetic polynucleotide encoding artificial human antibody CDR-L1 region
cagagtgtcagaagccac

SEQ ID NO: 3109 - DNA, 18 bp, Artificial Sequence
  Synthetic polynucleotide encoding artificial human antibody CDR-L1 region
agcctcagaagttattat

SEQ ID NO: 3110 - DNA, 21 bp, Artificial Sequence
  Synthetic polynucleotide encoding artificial human antibody CDR-L1 region
caggctattgtcagcaattac

SEQ ID NO: 3111 - DNA, 18 bp, Artificial Sequence
  Synthetic polynucleotide encoding artificial human antibody CDR-L1 region
aacattggaaagaaagat

SEQ ID NO: 3112 - DNA, 18 bp, Artificial Sequence
  Synthetic polynucleotide encoding artificial human antibody CDR-L1 region
aacattggaagtaaaagt

SEQ ID NO: 3113 - DNA, 18 bp, Artificial Sequence
  Synthetic polynucleotide encoding artificial human antibody CDR-L1 region
gcattgccaaagcaatct

SEQ ID NO: 3114 - DNA, 18 bp, Artificial Sequence
  Synthetic polynucleotide encoding artificial human antibody CDR-L1 region
gcattgccaaagcaatat

SEQ ID NO: 3115 - DNA, 18 bp, Artificial Sequence
  Synthetic polynucleotide encoding artificial human antibody CDR-L1 region
gcattgccaaaaaaatat

SEQ ID NO: 3116 - DNA, 18 bp, Artificial Sequence
  Synthetic polynucleotide encoding artificial human antibody CDR-L1 region
cagaccattgacacctat

SEQ ID NO: 3117 - DNA, 18 bp, Artificial Sequence
  Synthetic polynucleotide encoding artificial human antibody CDR-L1 region
cagggcattaccaactat

SEQ ID NO: 3118 - DNA, 18 bp, Artificial Sequence
  Synthetic polynucleotide encoding artificial human antibody CDR-L1 region
caggacattagcacgttt

SEQ ID NO: 3119 - DNA, 27 bp, Artificial Sequence
  Synthetic polynucleotide encoding artificial human antibody CDR-L1 region
agcagtgatattggtggttataactat

SEQ ID NO: 3120 - DNA, 18 bp, Artificial Sequence
  Synthetic polynucleotide encoding artificial human antibody CDR-L1 region
aaattgggggataaatat

SEQ ID NO: 3121 - DNA, 24 bp, Artificial Sequence
  Synthetic polynucleotide encoding artificial human antibody CDR-L1 region
acctccaacattggaaataatttt

SEQ ID NO: 3122 - DNA, 21 bp, Artificial Sequence
  Synthetic polynucleotide encoding artificial human antibody CDR-L1 region
cagagtatcagcagcacctac

SEQ ID NO: 3123 - DNA, 21 bp, Artificial Sequence
  Synthetic polynucleotide encoding artificial human antibody CDR-L1 region
cagagtgttagcagcagctac

SEQ ID NO: 3124 - DNA, 27 bp, Artificial Sequence
  Synthetic polynucleotide encoding artificial human antibody CDR-L1 region
agcagtgacgttggcgattataactat

SEQ ID NO: 3125 - DNA, 18 bp, Artificial Sequence
  Synthetic polynucleotide encoding artificial human antibody CDR-L1 region
cagttcattagcgtctat

SEQ ID NO: 3126 - DNA, 18 bp, Artificial Sequence
  Synthetic polynucleotide encoding artificial human antibody CDR-L1 region
cagagtgttagcagcaag

SEQ ID NO: 3127 - DNA, 18 bp, Artificial Sequence
  Synthetic polynucleotide encoding artificial human antibody CDR-L1 region
gtattggcaaaaaattat

SEQ ID NO: 3128 - DNA, 27 bp, Artificial Sequence
  Synthetic polynucleotide encoding artificial human antibody CDR-L1 region
agcagtgacgttggtgcttatccgtat

SEQ ID NO: 3129 - DNA, 21 bp, Artificial Sequence
  Synthetic polynucleotide encoding artificial human antibody CDR-L1 region
cagagtttaagcagcggttac

SEQ ID NO: 3130 - DNA, 36 bp, Artificial Sequence
  Synthetic polynucleotide encoding artificial human antibody CDR-L1 region
cagagtcttttatacaggtccaacgataagaactac

SEQ ID NO: 3131 - DNA, 27 bp, Artificial Sequence
  Synthetic polynucleotide encoding artificial human antibody CDR-L1 region
ggctccaatatcggggctggttatgat

SEQ ID NO: 3132 - DNA, 27 bp, Artificial Sequence
  Synthetic polynucleotide encoding artificial human antibody CDR-L1 region
agcagtgacgttggtggttatgaccat

SEQ ID NO: 3133 - DNA, 18 bp, Artificial Sequence
  Synthetic polynucleotide encoding artificial human antibody CDR-L1 region
cagagtattagtagctgg

SEQ ID NO: 3134 - DNA, 18 bp, Artificial Sequence
  Synthetic polynucleotide encoding artificial human antibody CDR-L1 region
cagagtattgtcaccaac

SEQ ID NO: 3135 - DNA, 21 bp, Artificial Sequence
  Synthetic polynucleotide encoding artificial human antibody CDR-L1 region
agtgggcacagcacctacgcc

SEQ ID NO: 3136 - DNA, 21 bp, Artificial Sequence
  Synthetic polynucleotide encoding artificial human antibody CDR-L1 region
cagagtgttagcagcagctac

SEQ ID NO: 3137 - DNA, 27 bp, Artificial Sequence
  Synthetic polynucleotide encoding artificial human antibody CDR-L1 region
agctccaacctcggggcaggttatgct

SEQ ID NO: 3138 - DNA, 27 bp, Artificial Sequence
  Synthetic polynucleotide encoding artificial human antibody CDR-L1 region
agcaccaacatcgggacaatttatgat

SEQ ID NO: 3139 - DNA, 33 bp, Artificial Sequence
  Synthetic polynucleotide encoding artificial human antibody CDR-L1 region
cagagcctcctttctagtaatggacatcatctt

SEQ ID NO: 3140 - DNA, 18 bp, Artificial Sequence
  Synthetic polynucleotide encoding artificial human antibody CDR-L1 region
cagggcattagcagttat

SEQ ID NO: 3141 - DNA, 24 bp, Artificial Sequence
  Synthetic polynucleotide encoding artificial human antibody CDR-L1 region
aactccaacatcggaagtactttt

SEQ ID NO: 3142 - DNA, 33 bp, Artificial Sequence
  Synthetic polynucleotide encoding artificial human antibody CDR-L1 region
cagagcctcctgcatagtaatggagtctactac

SEQ ID NO: 3143 - DNA, 18 bp, Artificial Sequence
  Synthetic polynucleotide encoding artificial human antibody CDR-L1 region
agcctcagaagctatttt

SEQ ID NO: 3144 - DNA, 18 bp, Artificial Sequence
  Synthetic polynucleotide encoding artificial human antibody CDR-L1 region
cagagtataagtagttgg

SEQ ID NO: 3145 - DNA, 36 bp, Artificial Sequence
  Synthetic polynucleotide encoding artificial human antibody CDR-L1 region
cagactgttttatacgactccaacaataaaaactac

SEQ ID NO: 3146 - DNA, 24 bp, Artificial Sequence
  Synthetic polynucleotide encoding artificial human antibody CDR-L1 region
agcagcaacatcggaggtaagtat

SEQ ID NO: 3147 - DNA, 18 bp, Artificial Sequence
  Synthetic polynucleotide encoding artificial human antibody CDR-L1 region
cagagtattagtgactgg

SEQ ID NO: 3148 - DNA, 18 bp, Artificial Sequence
  Synthetic polynucleotide encoding artificial human antibody CDR-L1 region
aaccctggaattaagagt

SEQ ID NO: 3149 - DNA, 27 bp, Artificial Sequence
  Synthetic polynucleotide encoding artificial human antibody CDR-L1 region
acctccaacatcggggcagattatgat

SEQ ID NO: 3150 - DNA, 18 bp, Artificial Sequence
  Synthetic polynucleotide encoding artificial human antibody CDR-L1 region
agcctcagaagcttttat

SEQ ID NO: 3151 - DNA, 27 bp, Artificial Sequence
  Synthetic polynucleotide encoding artificial human antibody CDR-L1 region
agcagtgacgttgatggttataattat

SEQ ID NO: 3152 - DNA, 36 bp, Artificial Sequence
  Synthetic polynucleotide encoding artificial human antibody CDR-L1 region
cagagtgttttatacagctccgacaataagaactac

SEQ ID NO: 3153 - DNA, 27 bp, Artificial Sequence
  Synthetic polynucleotide encoding artificial human antibody CDR-L1 region
agcagtgacgttggtggttataactat

SEQ ID NO: 3154 - DNA, 18 bp, Artificial Sequence
  Synthetic polynucleotide encoding artificial human antibody CDR-L1 region
caggacattagcaactat

SEQ ID NO: 3155 - DNA, 18 bp, Artificial Sequence
  Synthetic polynucleotide encoding artificial human antibody CDR-L1 region
aacattggaagtaaaagt

SEQ ID NO: 3156 - DNA, 21 bp, Artificial Sequence
  Synthetic polynucleotide encoding artificial human antibody CDR-L1 region
cagagtgtaagaggcaattat

SEQ ID NO: 3157 - DNA, 24 bp, Artificial Sequence
  Synthetic polynucleotide encoding artificial human antibody CDR-L1 region
agctccaacattgggagtaattat

SEQ ID NO: 3158 - DNA, 18 bp, Artificial Sequence
  Synthetic polynucleotide encoding artificial human antibody CDR-L1 region
aacattggaagttacaat

SEQ ID NO: 3159 - DNA, 21 bp, Artificial Sequence
  Synthetic polynucleotide encoding artificial human antibody CDR-L1 region
cagagggttagcagcaactac

SEQ ID NO: 3160 - DNA, 27 bp, Artificial Sequence
  Synthetic polynucleotide encoding artificial human antibody CDR-L1 region
agcagtgatgttgggagttataacctt

SEQ ID NO: 3161 - DNA, 33 bp, Artificial Sequence; identical to SEQ ID NO: 3014
  Synthetic polynucleotide encoding artificial human antibody CDR-L1 region

SEQ ID NO: 3162 - DNA, 24 bp, Artificial Sequence
  Synthetic polynucleotide encoding artificial human antibody CDR-L1 region
agctccaacatcggaagtaattat

SEQ ID NO: 3163 - DNA, 18 bp, Artificial Sequence
  Synthetic polynucleotide encoding artificial human antibody CDR-L1 region
agcctcagaagctattat

SEQ ID NO: 3164 - DNA, 18 bp, Artificial Sequence
  Synthetic polynucleotide encoding artificial human antibody CDR-L1 region
cagagcattagcagctat

SEQ ID NO: 3165 - DNA, 18 bp, Artificial Sequence
  Synthetic polynucleotide encoding artificial human antibody CDR-L1 region
aacattggatatagaaat

SEQ ID NO: 3166 - DNA, 18 bp, Artificial Sequence
  Synthetic polynucleotide encoding artificial human antibody CDR-L1 region
cagggcattagaaatgat

SEQ ID NO: 3167 - DNA, 18 bp, Artificial Sequence
  Synthetic polynucleotide encoding artificial human antibody CDR-L1 region
cagagtattagtagctgg

SEQ ID NO: 3168 - DNA, 33 bp, Artificial Sequence
  Synthetic polynucleotide encoding artificial human antibody CDR-L1 region
cagagcctccttcatagtaatggattcaactat

SEQ ID NO: 3169 - DNA, 18 bp, Artificial Sequence
  Synthetic polynucleotide encoding artificial human antibody CDR-L1 region
aaattgggggataaatat

SEQ ID NO: 3170 - DNA, 18 bp, Artificial Sequence
  Synthetic polynucleotide encoding artificial human antibody CDR-L1 region
gcattgccaaaaaaatat

SEQ ID NO: 3171 - DNA, 18 bp, Artificial Sequence
  Synthetic polynucleotide encoding artificial human antibody CDR-L1 region
agcctcagaagctattat

SEQ ID NO: 3172 - DNA, 36 bp, Artificial Sequence
  Synthetic polynucleotide encoding artificial human antibody CDR-L1 region
cagagtgttttatacagctccagcagtaagaactac

SEQ ID NO: 3173 - DNA, 33 bp, Artificial Sequence
  Synthetic polynucleotide encoding artificial human antibody CDR-L1 region
cagagcctcctgcatagcaatggatacaactat

SEQ ID NO: 3174 - DNA, 27 bp, Artificial Sequence
  Synthetic polynucleotide encoding artificial human antibody CDR-L1 region
agcagtgacgttggtggttataactat

SEQ ID NO: 3175 - DNA, 36 bp, Artificial Sequence
  Synthetic polynucleotide encoding artificial human antibody CDR-L1 region
cagagtgttttatacagctccaacaataagaactac

SEQ ID NO: 3176 - DNA, 27 bp, Artificial Sequence
  Synthetic polynucleotide encoding artificial human antibody CDR-L1 region
agcagtgatgttgggagttataacctt

SEQ ID NO: 3177 - DNA, 18 bp, Artificial Sequence
  Synthetic polynucleotide encoding artificial human antibody CDR-L1 region
gctttgccaaaaaaatat

SEQ ID NO: 3178 - DNA, 18 bp, Artificial Sequence
  Synthetic polynucleotide encoding artificial human antibody CDR-L1 region
cagagtgttagcagcaac

SEQ ID NO: 3179 - DNA, 21 bp, Artificial Sequence
  Synthetic polynucleotide encoding artificial human antibody CDR-L1 region
cagagtgttagcagcagctac

SEQ ID NO: 3180 - DNA, 18 bp, Artificial Sequence
  Synthetic polynucleotide encoding artificial human antibody CDR-L1 region
aacattggaagtagaagt

SEQ ID NO: 3181 - DNA, 27 bp, Artificial Sequence
  Synthetic polynucleotide encoding artificial human antibody CDR-L1 region
agcagtgatattgggacttataacctt

SEQ ID NO: 3182 - DNA, 36 bp, Artificial Sequence
  Synthetic polynucleotide encoding artificial human antibody CDR-L1 region
cagagtgttttatccacctccaacaataagaactac

SEQ ID NO: 3183 - DNA, 18 bp, Artificial Sequence
  Synthetic polynucleotide encoding artificial human antibody CDR-L1 region
aacattggaagtaaaagt

SEQ ID NO: 3184 - DNA, 18 bp, Artificial Sequence
  Synthetic polynucleotide encoding artificial human antibody CDR-L1 region
cagcacattgccgggcgt

SEQ ID NO: 3185 - DNA, 24 bp, Artificial Sequence
  Synthetic polynucleotide encoding artificial human antibody CDR-L1 region
agctccaacatcggaagtaatact

SEQ ID NO: 3186 - DNA, 24 bp, Artificial Sequence
  Synthetic polynucleotide encoding artificial human antibody CDR-L1 region
agtggcagcattgccagcaactat

SEQ ID NO: 3187 - DNA, 27 bp, Artificial Sequence
  Synthetic polynucleotide encoding artificial human antibody CDR-L1 region
agctccaacatcggggcacattatgat

SEQ ID NO: 3188 - DNA, 18 bp, Artificial Sequence
  Synthetic polynucleotide encoding artificial human antibody CDR-L1 region
cagagcattagtagttat

SEQ ID NO: 3189 - DNA, 18 bp, Artificial Sequence
  Synthetic polynucleotide encoding artificial human antibody CDR-L1 region
caggacattagcaactat

SEQ ID NO: 3190 - DNA, 21 bp, Artificial Sequence
  Synthetic polynucleotide encoding artificial human antibody CDR-L1 region
caagatgttgccagcacctac

SEQ ID NO: 3191 - DNA, 27 bp, Artificial Sequence
  Synthetic polynucleotide encoding artificial human antibody CDR-L1 region
accagtgatgttgggacttataacctt

SEQ ID NO: 3192 - DNA, 21 bp, Artificial Sequence
  Synthetic polynucleotide encoding artificial human antibody CDR-L1 region
cagagtgttgccaacaactac

SEQ ID NO: 3193 - DNA, 21 bp, Artificial Sequence
  Synthetic polynucleotide encoding artificial human antibody CDR-L1 region
cagagtgttagcagcaactac

SEQ ID NO: 3194 - DNA, 27 bp, Artificial Sequence
  Synthetic polynucleotide encoding artificial human antibody CDR-L1 region
tctggttcagtctccactagtttctac

SEQ ID NO: 3195 - DNA, 27 bp, Artificial Sequence
  Synthetic polynucleotide encoding artificial human antibody CDR-L1 region
agctccaacatcggggcacaatatgat

SEQ ID NO: 3196 - DNA, 27 bp, Artificial Sequence
  Synthetic polynucleotide encoding artificial human antibody CDR-L1 region
agctccaacatcggggcaggttacgat

SEQ ID NO: 3197 - DNA, 21 bp, Artificial Sequence
  Synthetic polynucleotide encoding artificial human antibody CDR-L1 region
cagagtgttagcagcagttac

SEQ ID NO: 3198 - DNA, 27 bp, Artificial Sequence
  Synthetic polynucleotide encoding artificial human antibody CDR-L1 region
agcagtgacgttggtggttataactat

SEQ ID NO: 3199 - DNA, 27 bp, Artificial Sequence
  Synthetic polynucleotide encoding artificial human antibody CDR-L1 region
agcagtgatattgggggttatgacctt

SEQ ID NO: 3200 - DNA, 36 bp, Artificial Sequence; identical to SEQ ID NO: 3175
  Synthetic polynucleotide encoding artificial human antibody CDR-L1 region

SEQ ID NO: 3201 - DNA, 24 bp, Artificial Sequence
  Synthetic polynucleotide encoding artificial human antibody CDR-L1 region
agctccaacatcggaagtaatact

SEQ ID NO: 3202 - DNA, 27 bp, Artificial Sequence
  Synthetic polynucleotide encoding artificial human antibody CDR-L1 region
actggagtagtcaccactggtcattat

SEQ ID NO: 3203 - DNA, 27 bp, Artificial Sequence
  Synthetic polynucleotide encoding artificial human antibody CDR-L1 region
tactccaacatcggggcaggttatgat

SEQ ID NO: 3204 - DNA, 18 bp, Artificial Sequence
  Synthetic polynucleotide encoding artificial human antibody CDR-L1 region
cagaatattaacaggttc

SEQ ID NO: 3205 - DNA, 18 bp, Artificial Sequence
  Synthetic polynucleotide encoding artificial human antibody CDR-L1 region
cagggcattagaaatgat

SEQ ID NO: 3206 - DNA, 18 bp, Artificial Sequence
  Synthetic polynucleotide encoding artificial human antibody CDR-L1 region
agcctcagaacggattat

SEQ ID NO: 3207 - DNA, 36 bp, Artificial Sequence
  Synthetic polynucleotide encoding artificial human antibody CDR-L1 region
cagagtgttttatccagctacaacaataaggactac

SEQ ID NO: 3208 - DNA, 33 bp, Artificial Sequence; identical to SEQ ID NO: 3014
  Synthetic polynucleotide encoding artificial human antibody CDR-L1 region

SEQ ID NO: 3209 - DNA, 18 bp, Artificial Sequence
  Synthetic polynucleotide encoding artificial human antibody CDR-L1 region
gcattgccaaaaaaatat

SEQ ID NO: 3210 - DNA, 18 bp, Artificial Sequence
  Synthetic polynucleotide encoding artificial human antibody CDR-L1 region
aacattggaagtaaaagt

SEQ ID NO: 3211 - DNA, 18 bp, Artificial Sequence
  Synthetic polynucleotide encoding artificial human antibody CDR-L1 region
cagagcattagcacctat

SEQ ID NO: 3212 - DNA, 18 bp, Artificial Sequence
  Synthetic polynucleotide encoding artificial human antibody CDR-L1 region
cagagtgttggcagcgac

SEQ ID NO: 3213 - DNA, 36 bp, Artificial Sequence; identical to SEQ ID NO: 3175
  Synthetic polynucleotide encoding artificial human antibody CDR-L1 region

SEQ ID NO: 3214 - DNA, 18 bp, Artificial Sequence
  Synthetic polynucleotide encoding artificial human antibody CDR-L1 region
gcattggcaaaggaatat

SEQ ID NO: 3215 - DNA, 18 bp, Artificial Sequence
  Synthetic polynucleotide encoding artificial human antibody CDR-L1 region
cagaatattcgcgacttc

SEQ ID NO: 3216 - DNA, 36 bp, Artificial Sequence
  Synthetic polynucleotide encoding artificial human antibody CDR-L1 region
cagactattttatacagctccaacaataagaactat

SEQ ID NO: 3217 - DNA, 18 bp, Artificial Sequence
  Synthetic polynucleotide encoding artificial human antibody CDR-L1 region
aaattggggaataaatat

SEQ ID NO: 3218 - DNA, 24 bp, Artificial Sequence
  Synthetic polynucleotide encoding artificial human antibody CDR-L1 region
aggtccaacatcgggagtaatttt

SEQ ID NO: 3219 - DNA, 24 bp, Artificial Sequence
  Synthetic polynucleotide encoding artificial human antibody CDR-L1 region
agctccaacattgggaataactat

SEQ ID NO: 3220 - DNA, 18 bp, Artificial Sequence
  Synthetic polynucleotide encoding artificial human antibody CDR-L1 region
cagagtgttagtttctgg

SEQ ID NO: 3221 - DNA, 36 bp, Artificial Sequence
  Synthetic polynucleotide encoding artificial human antibody CDR-L1 region
cagagtgtcttctacagctccaacaataagaactac

SEQ ID NO: 3222 - DNA, 36 bp, Artificial Sequence; identical to SEQ ID NO: 3175
  Synthetic polynucleotide encoding artificial human antibody CDR-L1 region

SEQ ID NO: 3223 - DNA, 27 bp, Artificial Sequence
  Synthetic polynucleotide encoding artificial human antibody CDR-L1 region
agcaatgacattggtcgttataagtat

SEQ ID NO: 3224 - DNA, 33 bp, Artificial Sequence; identical to SEQ ID NO: 3014
  Synthetic polynucleotide encoding artificial human antibody CDR-L1 region

SEQ ID NO: 3225 - DNA, 18 bp, Artificial Sequence
  Synthetic polynucleotide encoding artificial human antibody CDR-L1 region
aaattgggggataaatat

SEQ ID NO: 3226 - DNA, 21 bp, Artificial Sequence
  Synthetic polynucleotide encoding artificial human antibody CDR-L1 region
cagagggttaacagcaactac

SEQ ID NO: 3227 - DNA, 18 bp, Artificial Sequence
  Synthetic polynucleotide encoding artificial human antibody CDR-L1 region
aatttgggaaataaatat

SEQ ID NO: 3228 - DNA, 33 bp, Artificial Sequence; identical to SEQ ID NO: 3035
  Synthetic polynucleotide encoding artificial human antibody CDR-L1 region

SEQ ID NO: 3229 - DNA, 24 bp, Artificial Sequence
  Synthetic polynucleotide encoding artificial human antibody CDR-L1 region
agctccaacattgggaataattat

SEQ ID NO: 3230 - DNA, 18 bp, Artificial Sequence
  Synthetic polynucleotide encoding artificial human antibody CDR-L1 region
cagagtattagtagctgg

SEQ ID NO: 3231 - DNA, 18 bp, Artificial Sequence
  Synthetic polynucleotide encoding artificial human antibody CDR-L1 region
cagagtattagtagctgg

SEQ ID NO: 3232 - DNA, 27 bp, Artificial Sequence
  Synthetic polynucleotide encoding artificial human antibody CDR-L1 region
agctccaacatcggggcaggttatgat

SEQ ID NO: 3233 - DNA, 18 bp, Artificial Sequence
  Synthetic polynucleotide encoding artificial human antibody CDR-L1 region
gcattgccaaagcaatat

SEQ ID NO: 3234 - DNA, 18 bp, Artificial Sequence
  Synthetic polynucleotide encoding artificial human antibody CDR-L1 region
cagaatattcgcaacaat

SEQ ID NO: 3235 - DNA, 18 bp, Artificial Sequence
  Synthetic polynucleotide encoding artificial human antibody CDR-L1 region
cagagtgttagcagcaac

SEQ ID NO: 3236 - DNA, 18 bp, Artificial Sequence
  Synthetic polynucleotide encoding artificial human antibody CDR-L1 region
cagagcattagcagctat

SEQ ID NO: 3237 - DNA, 18 bp, Artificial Sequence
  Synthetic polynucleotide encoding artificial human antibody CDR-L1 region
cagagcattagcacctat

SEQ ID NO: 3238 - DNA, 21 bp, Artificial Sequence
  Synthetic polynucleotide encoding artificial human antibody CDR-L1 region
cagagtgttaccagcagctac

SEQ ID NO: 3239 - DNA, 18 bp, Artificial Sequence
  Synthetic polynucleotide encoding artificial human antibody CDR-L1 region
aacattggaagtaaaagt

SEQ ID NO: 3240 - DNA, 24 bp, Artificial Sequence
  Synthetic polynucleotide encoding artificial human antibody CDR-L1 region
agtggcagcattgccgacaagtat

SEQ ID NO: 3241 - DNA, 33 bp, Artificial Sequence
  Synthetic polynucleotide encoding artificial human antibody CDR-L1 region
cagagcctcctacatagtaatggatacaactat

SEQ ID NO: 3242 - DNA, 18 bp, Artificial Sequence
  Synthetic polynucleotide encoding artificial human antibody CDR-L1 region
cagagtattagtagctgg

SEQ ID NO: 3243 - DNA, 33 bp, Artificial Sequence
  Synthetic polynucleotide encoding artificial human antibody CDR-L1 region
cagagcctcctgtatcgtgatggagagcactat

SEQ ID NO: 3244 - DNA, 18 bp, Artificial Sequence
  Synthetic polynucleotide encoding artificial human antibody CDR-L1 region
cagagcattagtagctat

SEQ ID NO: 3245 - DNA, 36 bp, Artificial Sequence
  Synthetic polynucleotide encoding artificial human antibody CDR-L1 region
cagagtcttttatacagttccaactataagaactac

SEQ ID NO: 3246 - DNA, 24 bp, Artificial Sequence
  Synthetic polynucleotide encoding artificial human antibody CDR-L1 region
agctccaacatcggaagtaattat

SEQ ID NO: 3247 - DNA, 27 bp, Artificial Sequence
  Synthetic polynucleotide encoding artificial human antibody CDR-L1 region
agcagtgacgttggtggttataactat

SEQ ID NO: 3248 - DNA, 27 bp, Artificial Sequence
  Synthetic polynucleotide encoding artificial human antibody CDR-L1 region
aactccaacatcggggcaggttatgat

SEQ ID NO: 3249 - DNA, 27 bp, Artificial Sequence
  Synthetic polynucleotide encoding artificial human antibody CDR-L1 region
agtgacatcaatgttactaactacaac

SEQ ID NO: 3250 - DNA, 33 bp, Artificial Sequence; identical to SEQ ID NO: 3044
  Synthetic polynucleotide encoding artificial human antibody CDR-L1 region

SEQ ID NO: 3251 - DNA, 18 bp, Artificial Sequence
  Synthetic polynucleotide encoding artificial human antibody CDR-L1 region
cagggcattagaaatgat

SEQ ID NO: 3252 - DNA, 33 bp, Artificial Sequence
  Synthetic polynucleotide encoding artificial human antibody CDR-L1 region
cagagcctcctgcatagtgatggaaagacctat

SEQ ID NO: 3253 - DNA, 24 bp, Artificial Sequence
  Synthetic polynucleotide encoding artificial human antibody CDR-H2 region
atgagtgggggtggtggtagtata

SEQ ID NO: 3254 - DNA, 24 bp, Artificial Sequence
  Synthetic polynucleotide encoding artificial human antibody CDR-H2 region
ataaagcaagatggaagtgagaaa

SEQ ID NO: 3255 - DNA, 24 bp, Artificial Sequence
  Synthetic polynucleotide encoding artificial human antibody CDR-H2 region
attagttggaacagtgggaacata

SEQ ID NO: 3256 - DNA, 21 bp, Artificial Sequence
  Synthetic polynucleotide encoding artificial human antibody CDR-H2 region
atttattgggatgatgataag

SEQ ID NO: 3257 - DNA, 24 bp, Artificial Sequence
  Synthetic polynucleotide encoding artificial human antibody CDR-H2 region
atcaacactagtggtggaagcaca

SEQ ID NO: 3258 - DNA, 24 bp, Artificial Sequence
  Synthetic polynucleotide encoding artificial human antibody CDR-H2 region
attagttggaatagtgttagtata

SEQ ID NO: 3259 - DNA, 24 bp, Artificial Sequence
  Synthetic polynucleotide encoding artificial human antibody CDR-H2 region
atcaccacttacaatcgtgacaca

SEQ ID NO: 3260 - DNA, 24 bp, Artificial Sequence
  Synthetic polynucleotide encoding artificial human antibody CDR-H2 region
attagtggggatggtggtggcaca

SEQ ID NO: 3261 - DNA, 24 bp, Artificial Sequence
  Synthetic polynucleotide encoding artificial human antibody CDR-H2 region
atacggtatgatggaagaaataaa

SEQ ID NO: 3262 - DNA, 24 bp, Artificial Sequence
  Synthetic polynucleotide encoding artificial human antibody CDR-H2 region
attggatgggacagtggtggcatc

SEQ ID NO: 3263 - DNA, 24 bp, Artificial Sequence
  Synthetic polynucleotide encoding artificial human antibody CDR-H2 region
atcagcatttacagtggtaacaca

SEQ ID NO: 3264 - DNA, 24 bp, Artificial Sequence
  Synthetic polynucleotide encoding artificial human antibody CDR-H2 region
atatcatctgatggaaggaagata

SEQ ID NO: 3265 - DNA, 24 bp, Artificial Sequence
  Synthetic polynucleotide encoding artificial human antibody CDR-H2 region
atcagtgctactactggtagcact

SEQ ID NO: 3266 - DNA, 27 bp, Artificial Sequence
  Synthetic polynucleotide encoding artificial human antibody CDR-H2 region
acatactacaggtccaagtggtataat

SEQ ID NO: 3267 - DNA, 24 bp, Artificial Sequence
  Synthetic polynucleotide encoding artificial human antibody CDR-H2 region
attcactatgatggaaggaataaa

SEQ ID NO: 3268 - DNA, 24 bp, Artificial Sequence
  Synthetic polynucleotide encoding artificial human antibody CDR-H2 region
attagtagtagtagtagttccata

SEQ ID NO: 3269 - DNA, 24 bp, Artificial Sequence
  Synthetic polynucleotide encoding artificial human antibody CDR-H2 region
atcagcgcttacaatggtaacacg

SEQ ID NO: 3270 - DNA, 24 bp, Artificial Sequence
  Synthetic polynucleotide encoding artificial human antibody CDR-H2 region
attggtattggtggcaataccata

SEQ ID NO: 3271 - DNA, 24 bp, Artificial Sequence
  Synthetic polynucleotide encoding artificial human antibody CDR-H2 region
atcaacgctggcaatggtaacaca

SEQ ID NO: 3272 - DNA, 21 bp, Artificial Sequence
  Synthetic polynucleotide encoding artificial human antibody CDR-H2 region
gtctatcatagtgggaatgcc

SEQ ID NO: 3273 - DNA, 21 bp, Artificial Sequence
  Synthetic polynucleotide encoding artificial human antibody CDR-H2 region
atttattgggatgatgatgag

SEQ ID NO: 3274 - DNA, 24 bp, Artificial Sequence
  Synthetic polynucleotide encoding artificial human antibody CDR-H2 region
attagttggggtagttcttacata

SEQ ID NO: 3275 - DNA, 24 bp, Artificial Sequence
  Synthetic polynucleotide encoding artificial human antibody CDR-H2 region
attagtagcagtagtaggtacata

SEQ ID NO: 3276 - DNA, 21 bp, Artificial Sequence
  Synthetic polynucleotide encoding artificial human antibody CDR-H2 region
atctattacagtgggaacagg

SEQ ID NO: 3277 - DNA, 21 bp, Artificial Sequence
  Synthetic polynucleotide encoding artificial human antibody CDR-H2 region
atctataccagtgggaatacc

SEQ ID NO: 3278 - DNA, 24 bp, Artificial Sequence
  Synthetic polynucleotide encoding artificial human antibody CDR-H2 region
attagtagtaaaagtagttccaaa

SEQ ID NO: 3279 - DNA, 21 bp, Artificial Sequence
  Synthetic polynucleotide encoding artificial human antibody CDR-H2 region
atctattatagagggaccacc

SEQ ID NO: 3280 - DNA, 24 bp, Artificial Sequence
  Synthetic polynucleotide encoding artificial human antibody CDR-H2 region
atctggtatgatggaagtaataaa

SEQ ID NO: 3281 - DNA, 21 bp, Artificial Sequence
  Synthetic polynucleotide encoding artificial human antibody CDR-H2 region
atgtacaccagtgggagcacc

SEQ ID NO: 3282 - DNA, 24 bp, Artificial Sequence
  Synthetic polynucleotide encoding artificial human antibody CDR-H2 region
atcaaccctaatagtggtggcaca

SEQ ID NO: 3283 - DNA, 21 bp, Artificial Sequence
  Synthetic polynucleotide encoding artificial human antibody CDR-H2 region
atccatcacactgggagcgcc

SEQ ID NO: 3284 - DNA, 21 bp, Artificial Sequence
  Synthetic polynucleotide encoding artificial human antibody CDR-H2 region
atctattatagtggggacacc

SEQ ID NO: 3285 - DNA, 24 bp, Artificial Sequence
  Synthetic polynucleotide encoding artificial human antibody CDR-H2 region
atatcacatgatggaagtaataaa

SEQ ID NO: 3286 - DNA, 21 bp, Artificial Sequence
  Synthetic polynucleotide encoding artificial human antibody CDR-H2 region
atttattgggatgatgataag

SEQ ID NO: 3287 - DNA, 24 bp, Artificial Sequence
  Synthetic polynucleotide encoding artificial human antibody CDR-H2 region
attaatactactagtgatcccata

SEQ ID NO: 3288 - DNA, 24 bp, Artificial Sequence
  Synthetic polynucleotide encoding artificial human antibody CDR-H2 region
atcatccctatctttggtacagca

SEQ ID NO: 3289 - DNA, 21 bp, Artificial Sequence
  Synthetic polynucleotide encoding artificial human antibody CDR-H2 region
atctatttcagtgtgaccacc

SEQ ID NO: 3290 - DNA, 21 bp, Artificial Sequence
  Synthetic polynucleotide encoding artificial human antibody CDR-H2 region
ctctcttacagtgggaacacc

SEQ ID NO: 3291 - DNA, 24 bp, Artificial Sequence
  Synthetic polynucleotide encoding artificial human antibody CDR-H2 region
atcaacgctggcaatggtgacata

SEQ ID NO: 3292 - DNA, 24 bp, Artificial Sequence
  Synthetic polynucleotide encoding artificial human antibody CDR-H2 region
attagtggtagtggtcatagcaca

SEQ ID NO: 3293 - DNA, 24 bp, Artificial Sequence
  Synthetic polynucleotide encoding artificial human antibody CDR-H2 region
attaattggaatggtggtagcaca

SEQ ID NO: 3294 - DNA, 24 bp, Artificial Sequence
  Synthetic polynucleotide encoding artificial human antibody CDR-H2 region
atatcatatgatggaagtaataaa

SEQ ID NO: 3295 - DNA, 21 bp, Artificial Sequence
  Synthetic polynucleotide encoding artificial human antibody CDR-H2 region
atctattacagtgggagcacc

SEQ ID NO: 3296 - DNA, 24 bp, Artificial Sequence
  Synthetic polynucleotide encoding artificial human antibody CDR-H2 region
atcaaccctaacagtggtggcaca

SEQ ID NO: 3297 - DNA, 21 bp, Artificial Sequence
  Synthetic polynucleotide encoding artificial human antibody CDR-H2 region
attggtactgctggtgacaca

SEQ ID NO: 3298 - DNA, 24 bp, Artificial Sequence
  Synthetic polynucleotide encoding artificial human antibody CDR-H2 region
atatcatatgatggaagtaatagt

SEQ ID NO: 3299 - DNA, 24 bp, Artificial Sequence
  Synthetic polynucleotide encoding artificial human antibody CDR-H2 region
atgagtagtggcggtaatcgcaga

SEQ ID NO: 3300 - DNA, 24 bp, Artificial Sequence
  Synthetic polynucleotide encoding artificial human antibody CDR-H2 region
attagtagtagtggtacttacata

SEQ ID NO: 3301 - DNA, 24 bp, Artificial Sequence
  Synthetic polynucleotide encoding artificial human antibody CDR-H2 region
atatcatatgatggaagcaataaa

SEQ ID NO: 3302 - DNA, 24 bp, Artificial Sequence
  Synthetic polynucleotide encoding artificial human antibody CDR-H2 region
atcagttggaatagtggttcgata

SEQ ID NO: 3303 - DNA, 21 bp, Artificial Sequence
  Synthetic polynucleotide encoding artificial human antibody CDR-H2 region
atctattatagtgggagcacc

SEQ ID NO: 3304 - DNA, 24 bp, Artificial Sequence
  Synthetic polynucleotide encoding artificial human antibody CDR-H2 region
atcatccctatctttggtacagca

SEQ ID NO: 3305 - DNA, 24 bp, Artificial Sequence
  Synthetic polynucleotide encoding artificial human antibody CDR-H2 region
atcaacggttacaatggtaacaca

SEQ ID NO: 3306 - DNA, 24 bp, Artificial Sequence
  Synthetic polynucleotide encoding artificial human antibody CDR-H2 region
attactagtagtggtgataccata

SEQ ID NO: 3307 - DNA, 24 bp, Artificial Sequence
  Synthetic polynucleotide encoding artificial human antibody CDR-H2 region
atcatccctatctttggtacaaca

SEQ ID NO: 3308 - DNA, 24 bp, Artificial Sequence
  Synthetic polynucleotide encoding artificial human antibody CDR-H2 region
atctatcctggtgactctgatacc

SEQ ID NO: 3309 - DNA, 24 bp, Artificial Sequence
  Synthetic polynucleotide encoding artificial human antibody CDR-H2 region
acatggtatgaggggactaacgaa

SEQ ID NO: 3310 - DNA, 24 bp, Artificial Sequence
  Synthetic polynucleotide encoding artificial human antibody CDR-H2 region
atgagtggtagtggtgctggcaca

SEQ ID NO: 3311 - DNA, 24 bp, Artificial Sequence
  Synthetic polynucleotide encoding artificial human antibody CDR-H2 region
atatcatatgatggaggcactaaa

SEQ ID NO: 3312 - DNA, 24 bp, Artificial Sequence
  Synthetic polynucleotide encoding artificial human antibody CDR-H2 region
atatggtatgatggaagtactaaa

SEQ ID NO: 3313 - DNA, 21 bp, Artificial Sequence
  Synthetic polynucleotide encoding artificial human antibody CDR-H2 region
atctatttcactgggagcacc

SEQ ID NO: 3314 - DNA, 24 bp, Artificial Sequence
  Synthetic polynucleotide encoding artificial human antibody CDR-H2 region
atctatcctggtgactctgatacc

SEQ ID NO: 3315 - DNA, 21 bp, Artificial Sequence
  Synthetic polynucleotide encoding artificial human antibody CDR-H2 region
atctataccagtgggagcacc

SEQ ID NO: 3316 - DNA, 27 bp, Artificial Sequence
  Synthetic polynucleotide encoding artificial human antibody CDR-H2 region
acacactacaggtccaagtggtataat

SEQ ID NO: 3317 - DNA, 24 bp, Artificial Sequence
  Synthetic polynucleotide encoding artificial human antibody CDR-H2 region
tttgatcctgaagatggtgaaaca

SEQ ID NO: 3318 - DNA, 24 bp, Artificial Sequence
  Synthetic polynucleotide encoding artificial human antibody CDR-H2 region
attagtagtagtagtagttacata

SEQ ID NO: 3319 - DNA, 24 bp, Artificial Sequence
  Synthetic polynucleotide encoding artificial human antibody CDR-H2 region
attagtggtagtggtggtagtaca

SEQ ID NO: 3320 - DNA, 24 bp, Artificial Sequence
  Synthetic polynucleotide encoding artificial human antibody CDR-H2 region
atcacccctatttttaatataacg

SEQ ID NO: 3321 - DNA, 21 bp, Artificial Sequence
  Synthetic polynucleotide encoding artificial human antibody CDR-H2 region
atctattatagtgggagcacc

SEQ ID NO: 3322 - DNA, 24 bp, Artificial Sequence
  Synthetic polynucleotide encoding artificial human antibody CDR-H2 region
ataacttatgatggacaaatcaaa

SEQ ID NO: 3323 - DNA, 21 bp, Artificial Sequence
  Synthetic polynucleotide encoding artificial human antibody CDR-H2 region
atttattatagtgggaccacc

SEQ ID NO: 3324 - DNA, 24 bp, Artificial Sequence
  Synthetic polynucleotide encoding artificial human antibody CDR-H2 region
attagttggaatagtggtagcata

SEQ ID NO: 3325 - DNA, 21 bp, Artificial Sequence
  Synthetic polynucleotide encoding artificial human antibody CDR-H2 region
atatatagtagtggagacacc

SEQ ID NO: 3326 - DNA, 21 bp, Artificial Sequence
  Synthetic polynucleotide encoding artificial human antibody CDR-H2 region
atttattgggatgatgatgag

SEQ ID NO: 3327 - DNA, 24 bp, Artificial Sequence
  Synthetic polynucleotide encoding artificial human antibody CDR-H2 region
gttagcagtagtggtagtaccatg

SEQ ID NO: 3328 - DNA, 24 bp, Artificial Sequence
  Synthetic polynucleotide encoding artificial human antibody CDR-H2 region
attgatcctagtgactcttatacc

SEQ ID NO: 3329 - DNA, 24 bp, Artificial Sequence
  Synthetic polynucleotide encoding artificial human antibody CDR-H2 region
atctttcctgctgactctgatacc

SEQ ID NO: 3330 - DNA, 21 bp, Artificial Sequence
  Synthetic polynucleotide encoding artificial human antibody CDR-H2 region
atcttttacagtggaattacc

SEQ ID NO: 3331 - DNA, 24 bp, Artificial Sequence
  Synthetic polynucleotide encoding artificial human antibody CDR-H2 region
atcatccctatttttggaacatca

SEQ ID NO: 3332 - DNA, 24 bp, Artificial Sequence
  Synthetic polynucleotide encoding artificial human antibody CDR-H2 region
atcacttgggatggttctataata

SEQ ID NO: 3333 - DNA, 24 bp, Artificial Sequence
  Synthetic polynucleotide encoding artificial human antibody CDR-H2 region
atcaatgcttaccagggcgtcaca

SEQ ID NO: 3334 - DNA, 24 bp, Artificial Sequence
  Synthetic polynucleotide encoding artificial human antibody CDR-H2 region
ataaaggaagatggaagtgagaaa

SEQ ID NO: 3335 - DNA, 21 bp, Artificial Sequence
  Synthetic polynucleotide encoding artificial human antibody CDR-H2 region
atctcttacaatgggaacacc

SEQ ID NO: 3336 - DNA, 18 bp, Artificial Sequence
  Synthetic polynucleotide encoding artificial human antibody CDR-H2 region
attggtagtagtgggaca

SEQ ID NO: 3337 - DNA, 24 bp, Artificial Sequence
  Synthetic polynucleotide encoding artificial human antibody CDR-H2 region
attagtggtcttggaaatagtata

SEQ ID NO: 3338 - DNA, 24 bp, Artificial Sequence
  Synthetic polynucleotide encoding artificial human antibody CDR-H2 region
atatcagatgatgggaatgataaa

SEQ ID NO: 3339 - DNA, 24 bp, Artificial Sequence
  Synthetic polynucleotide encoding artificial human antibody CDR-H2 region
attagttgggatggtggtagcaca

SEQ ID NO: 3340 - DNA, 24 bp, Artificial Sequence
  Synthetic polynucleotide encoding artificial human antibody CDR-H2 region
atcaacacgaacaatggtaaaaca

SEQ ID NO: 3341 - DNA, 24 bp, Artificial Sequence
  Synthetic polynucleotide encoding artificial human antibody CDR-H2 region
atcgattggagtggaaagaccaca

SEQ ID NO: 3342 - DNA, 24 bp, Artificial Sequence
  Synthetic polynucleotide encoding artificial human antibody CDR-H2 region
attagtggtagtggtggtagcaca

SEQ ID NO: 3343 - DNA, 24 bp, Artificial Sequence
  Synthetic polynucleotide encoding artificial human antibody CDR-H2 region
gtatcatatgatggaactaataaa

SEQ ID NO: 3344 - DNA, 24 bp, Artificial Sequence
  Synthetic polynucleotide encoding artificial human antibody CDR-H2 region
attactagtaccagtagttactta

SEQ ID NO: 3345 - DNA, 21 bp, Artificial Sequence
  Synthetic polynucleotide encoding artificial human antibody CDR-H2 region
atatataccagtgggagcacc

SEQ ID NO: 3346 - DNA, 21 bp, Artificial Sequence
  Synthetic polynucleotide encoding artificial human antibody CDR-H2 region
gtctattacagtgggaggacc

SEQ ID NO: 3347 - DNA, 24 bp, Artificial Sequence
  Synthetic polynucleotide encoding artificial human antibody CDR-H2 region
gtatcatatgatggaactaataaa

SEQ ID NO: 3348 - DNA, 24 bp, Artificial Sequence
  Synthetic polynucleotide encoding artificial human antibody CDR-H2 region
atttatcctgttgactctgatacc

SEQ ID NO: 3349 - DNA, 24 bp, Artificial Sequence
  Synthetic polynucleotide encoding artificial human antibody CDR-H2 region
accggtggtagtggttataccaaa

SEQ ID NO: 3350 - DNA, 24 bp, Artificial Sequence
  Synthetic polynucleotide encoding artificial human antibody CDR-H2 region
attagtagtagtggtagtaccata

SEQ ID NO: 3351 - DNA, 24 bp, Artificial Sequence
  Synthetic polynucleotide encoding artificial human antibody CDR-H2 region
ataaaggaagatggaagtgagaaa

SEQ ID NO: 3352 - DNA, 21 bp, Artificial Sequence
  Synthetic polynucleotide encoding artificial human antibody CDR-H2 region
atctattacagtgggagcacc

SEQ ID NO: 3353 - DNA, 24 bp, Artificial Sequence
  Synthetic polynucleotide encoding artificial human antibody CDR-H2 region
atatcatatgatggaagtaataaa

SEQ ID NO: 3354 - DNA, 24 bp, Artificial Sequence
  Synthetic polynucleotide encoding artificial human antibody CDR-H2 region
attggtagtagtactactgccata

SEQ ID NO: 3355 - DNA, 21 bp, Artificial Sequence
  Synthetic polynucleotide encoding artificial human antibody CDR-H2 region
atctcttacagtgggagcacc

SEQ ID NO: 3356 - DNA, 21 bp, Artificial Sequence
  Synthetic polynucleotide encoding artificial human antibody CDR-H2 region
atctattatagtgggagcacc

SEQ ID NO: 3357 - DNA, 21 bp, Artificial Sequence
  Synthetic polynucleotide encoding artificial human antibody CDR-H2 region
atctcttattctgggagcacc

SEQ ID NO: 3358 - DNA, 24 bp, Artificial Sequence
  Synthetic polynucleotide encoding artificial human antibody CDR-H2 region
ataaagcaagatggaagtgagaaa

SEQ ID NO: 3359 - DNA, 24 bp, Artificial Sequence
  Synthetic polynucleotide encoding artificial human antibody CDR-H2 region
attagttggaatagtggtagtata

SEQ ID NO: 3360 - DNA, 24 bp, Artificial Sequence
  Synthetic polynucleotide encoding artificial human antibody CDR-H2 region
atctatcctggtgactctgatacc

SEQ ID NO: 3361 - DNA, 27 bp, Artificial Sequence
  Synthetic polynucleotide encoding artificial human antibody CDR-H2 region
acatactacaggtcccagtggatgaat

SEQ ID NO: 3362 - DNA, 27 bp, Artificial Sequence
  Synthetic polynucleotide encoding artificial human antibody CDR-H2 region
acatactacaggtccaagtggtataat

SEQ ID NO: 3363 - DNA, 21 bp, Artificial Sequence
  Synthetic polynucleotide encoding artificial human antibody CDR-H2 region
ctcttttacagtgggagcacc

SEQ ID NO: 3364 - DNA, 24 bp, Artificial Sequence
  Synthetic polynucleotide encoding artificial human antibody CDR-H2 region
atctatcctggtgactctgatacc

SEQ ID NO: 3365 - DNA, 24 bp, Artificial Sequence
  Synthetic polynucleotide encoding artificial human antibody CDR-H2 region
atatggtatgatggaagtaataaa

SEQ ID NO: 3366 - DNA, 24 bp, Artificial Sequence
  Synthetic polynucleotide encoding artificial human antibody CDR-H2 region
attagtagcagtagtcgttacgtg

SEQ ID NO: 3367 - DNA, 24 bp, Artificial Sequence
  Synthetic polynucleotide encoding artificial human antibody CDR-H2 region
atcatccctatacttaatataaca

SEQ ID NO: 3368 - DNA, 24 bp, Artificial Sequence
  Synthetic polynucleotide encoding artificial human antibody CDR-H2 region
attagtagtactagcaattacata

SEQ ID NO: 3369 - DNA, 24 bp, Artificial Sequence
  Synthetic polynucleotide encoding artificial human antibody CDR-H2 region
atttcatatgatggaagtgatgaa

SEQ ID NO: 3370 - DNA, 24 bp, Artificial Sequence
  Synthetic polynucleotide encoding artificial human antibody CDR-H2 region
atatggcatgatggaagtcataaa

SEQ ID NO: 3371 - DNA, 24 bp, Artificial Sequence
  Synthetic polynucleotide encoding artificial human antibody CDR-H2 region
attagtggtgatggtcgtagcaca

SEQ ID NO: 3372 - DNA, 24 bp, Artificial Sequence
  Synthetic polynucleotide encoding artificial human antibody CDR-H2 region
atatcagatgatggaaaaaataaa

SEQ ID NO: 3373 - DNA, 24 bp, Artificial Sequence
  Synthetic polynucleotide encoding artificial human antibody CDR-H2 region
ataaagcaagatgggagtgagaaa

SEQ ID NO: 3374 - DNA, 24 bp, Artificial Sequence
  Synthetic polynucleotide encoding artificial human antibody CDR-H2 region
atttccagtgatgggagtaccaca

SEQ ID NO: 3375 - DNA, 30 bp, Artificial Sequence
  Synthetic polynucleotide encoding artificial human antibody CDR-H2 region
attaggagcaaaaccgatggtgggactaca

SEQ ID NO: 3376 - DNA, 21 bp, Artificial Sequence
  Synthetic polynucleotide encoding artificial human antibody CDR-H2 region
atctctgacattggggacacc

SEQ ID NO: 3377 - DNA, 24 bp, Artificial Sequence
  Synthetic polynucleotide encoding artificial human antibody CDR-H2 region
atcatccccatctttggtacagca

SEQ ID NO: 3378 - DNA, 21 bp, Artificial Sequence
  Synthetic polynucleotide encoding artificial human antibody CDR-H2 region
atctattttagtgggaaaact

SEQ ID NO: 3379 - DNA, 24 bp, Artificial Sequence
  Synthetic polynucleotide encoding artificial human antibody CDR-H2 region
attaatcgtgatgggagttacaca

SEQ ID NO: 3380 - DNA, 21 bp, Artificial Sequence
  Synthetic polynucleotide encoding artificial human antibody CDR-H2 region
gtctattatagtgggagcacc

SEQ ID NO: 3381 - DNA, 21 bp, Artificial Sequence
  Synthetic polynucleotide encoding artificial human antibody CDR-H2 region
gtgtctcccagcgggactaac

SEQ ID NO: 3382 - DNA, 24 bp, Artificial Sequence
  Synthetic polynucleotide encoding artificial human antibody CDR-H2 region
atcatccctattgttggagaagca

SEQ ID NO: 3383 - DNA, 24 bp, Artificial Sequence
  Synthetic polynucleotide encoding artificial human antibody CDR-H2 region
attaatagtgatgggagtagcaca

SEQ ID NO: 3384 - DNA, 21 bp, Artificial Sequence
  Synthetic polynucleotide encoding artificial human antibody CDR-H2 region
atctattacaatgggagcacc

SEQ ID NO: 3385 - DNA, 24 bp, Artificial Sequence
  Synthetic polynucleotide encoding artificial human antibody CDR-H2 region
attagtggtagtggtggtagcaca

SEQ ID NO: 3386 - DNA, 24 bp, Artificial Sequence
  Synthetic polynucleotide encoding artificial human antibody CDR-H2 region
attagtgccagtggtcgtaccaca

SEQ ID NO: 3387 - DNA, 24 bp, Artificial Sequence
  Synthetic polynucleotide encoding artificial human antibody CDR-H2 region
attactgctaatgggggtagcaca

SEQ ID NO: 3388 - DNA, 21 bp, Artificial Sequence
  Synthetic polynucleotide encoding artificial human antibody CDR-H2 region
atctatcatagggggacctcc

SEQ ID NO: 3389 - DNA, 24 bp, Artificial Sequence
  Synthetic polynucleotide encoding artificial human antibody CDR-H2 region
atctcatttgatggaagcaatcaa

SEQ ID NO: 3390 - DNA, 24 bp, Artificial Sequence
  Synthetic polynucleotide encoding artificial human antibody CDR-H2 region
atcgaccctagtggcggcagcaga

SEQ ID NO: 3391 - DNA, 24 bp, Artificial Sequence
  Synthetic polynucleotide encoding artificial human antibody CDR-H2 region
attaatactgatgggagtagcaca

SEQ ID NO: 3392 - DNA, 24 bp, Artificial Sequence
  Synthetic polynucleotide encoding artificial human antibody CDR-H2 region
tttgatcctgaaggtggtgaaaca

SEQ ID NO: 3393 - DNA, 21 bp, Artificial Sequence
  Synthetic polynucleotide encoding artificial human antibody CDR-H2 region
atctattataatggagacacc

SEQ ID NO: 3394 - DNA, 24 bp, Artificial Sequence
  Synthetic polynucleotide encoding artificial human antibody CDR-H2 region
atcagcgcttacactggtaacaca

SEQ ID NO: 3395 - DNA, 24 bp, Artificial Sequence
  Synthetic polynucleotide encoding artificial human antibody CDR-H2 region
attatttggaatagtggtacgaca

SEQ ID NO: 3396 - DNA, 24 bp, Artificial Sequence
  Synthetic polynucleotide encoding artificial human antibody CDR-H2 region
ataaatactgatggtagtcgagga

SEQ ID NO: 3397 - DNA, 21 bp, Artificial Sequence
  Synthetic polynucleotide encoding artificial human antibody CDR-H2 region
atttatcacagtggcagcacc

SEQ ID NO: 3398 - DNA, 30 bp, Artificial Sequence
  Synthetic polynucleotide encoding artificial human antibody CDR-H2 region
attaaaagtaaaagtgatggtgggtcaaca

SEQ ID NO: 3399 - DNA, 21 bp, Artificial Sequence
  Synthetic polynucleotide encoding artificial human antibody CDR-H2 region
atttatagcggtggtaccaca

SEQ ID NO: 3400 - DNA, 30 bp, Artificial Sequence
  Synthetic polynucleotide encoding artificial human antibody CDR-H2 region
attaaaaacagagctaacagttacaacaca

SEQ ID NO: 3401 - DNA, 24 bp, Artificial Sequence
  Synthetic polynucleotide encoding artificial human antibody CDR-H2 region
atatcttttgatggaagtgataaa

SEQ ID NO: 3402 - DNA, 24 bp, Artificial Sequence
  Synthetic polynucleotide encoding artificial human antibody CDR-H2 region
attactgctggtggaagtttcata

SEQ ID NO: 3403 - DNA, 24 bp, Artificial Sequence
  Synthetic polynucleotide encoding artificial human antibody CDR-H2 region
atcaaccctaatagtggtggcaca

SEQ ID NO: 3404 - DNA, 24 bp, Artificial Sequence
  Synthetic polynucleotide encoding artificial human antibody CDR-H2 region
attagttatagtggtggtagcaca

SEQ ID NO: 3405 - DNA, 24 bp, Artificial Sequence
  Synthetic polynucleotide encoding artificial human antibody CDR-H2 region
attagtagtagtggtggtgacatc

SEQ ID NO: 3406 - DNA, 24 bp, Artificial Sequence
  Synthetic polynucleotide encoding artificial human antibody CDR-H2 region
attagttggaatagtggtgacata

SEQ ID NO: 3407 - DNA, 6 bp, Artificial Sequence
  Synthetic polynucleotide encoding artificial human antibody CDR-H2 region
atggca

SEQ ID NO: 3408 - DNA, 24 bp, Artificial Sequence
  Synthetic polynucleotide encoding artificial human antibody CDR-H2 region
attggtggtagtggtggttacaca

SEQ ID NO: 3409 - DNA, 21 bp, Artificial Sequence
  Synthetic polynucleotide encoding artificial human antibody CDR-H2 region
atctttcacagtgggagcgcc

SEQ ID NO: 3410 - DNA, 24 bp, Artificial Sequence
  Synthetic polynucleotide encoding artificial human antibody CDR-H2 region
atgatcaccacttttggaaaagcg

SEQ ID NO: 3411 - DNA, 21 bp, Artificial Sequence
  Synthetic polynucleotide encoding artificial human antibody CDR-H2 region
atctattacagtgggagcacc

SEQ ID NO: 3412 - DNA, 24 bp, Artificial Sequence
  Synthetic polynucleotide encoding artificial human antibody CDR-H2 region
atcagcgcttacaatgggaacaca

SEQ ID NO: 3413 - DNA, 24 bp, Artificial Sequence
  Synthetic polynucleotide encoding artificial human antibody CDR-H2 region
atcaacaccgtcactgggatccca

SEQ ID NO: 3414 - DNA, 21 bp, Artificial Sequence
  Synthetic polynucleotide encoding artificial human antibody CDR-H2 region
gtctattatagtgggagcacc

SEQ ID NO: 3415 - DNA, 24 bp, Artificial Sequence
  Synthetic polynucleotide encoding artificial human antibody CDR-H2 region
atagcctatgatggaagtcagaaa

SEQ ID NO: 3416 - DNA, 24 bp, Artificial Sequence
  Synthetic polynucleotide encoding artificial human antibody CDR-H2 region
atcatccctgtttttggaacaaca

SEQ ID NO: 3417 - DNA, 24 bp, Artificial Sequence
  Synthetic polynucleotide encoding artificial human antibody CDR-H2 region
atcaacgctggcaatggtgacacg

SEQ ID NO: 3418 - DNA, 21 bp, Artificial Sequence
  Synthetic polynucleotide encoding artificial human antibody CDR-H2 region
atctatcatagtgggagcacc

SEQ ID NO: 3419 - DNA, 24 bp, Artificial Sequence
  Synthetic polynucleotide encoding artificial human antibody CDR-H2 region
gtagagggataccgaagtgaagaa

SEQ ID NO: 3420 - DNA, 24 bp, Artificial Sequence
  Synthetic polynucleotide encoding artificial human antibody CDR-H2 region
attagtgccagtggcggtggcacc

SEQ ID NO: 3421 - DNA, 21 bp, Artificial Sequence
  Synthetic polynucleotide encoding artificial human antibody CDR-H2 region
atctattacagtgggacctcc

SEQ ID NO: 3422 - DNA, 24 bp, Artificial Sequence
  Synthetic polynucleotide encoding artificial human antibody CDR-H2 region
atcaaccctaaaactggtgacaca

SEQ ID NO: 3423 - DNA, 24 bp, Artificial Sequence
  Synthetic polynucleotide encoding artificial human antibody CDR-H2 region
atatcatatgatggaagtaataaa

SEQ ID NO: 3424 - DNA, 24 bp, Artificial Sequence
  Synthetic polynucleotide encoding artificial human antibody CDR-H2 region
attagtagtagtagtagttacata

SEQ ID NO: 3425 - DNA, 21 bp, Artificial Sequence
  Synthetic polynucleotide encoding artificial human antibody CDR-H2 region
atctattatagtgggagcacc

SEQ ID NO: 3426 - DNA, 30 bp, Artificial Sequence
  Synthetic polynucleotide encoding artificial human antibody CDR-H2 region
attaaaagcaaaactgatggtgggacaaca

SEQ ID NO: 3427 - DNA, 24 bp, Artificial Sequence
  Synthetic polynucleotide encoding artificial human antibody CDR-H2 region
atcaaccctagttttggaagcaca

SEQ ID NO: 3428 - DNA, 24 bp, Artificial Sequence
  Synthetic polynucleotide encoding artificial human antibody CDR-H2 region
atcatgcctatgtttggaagaaca

SEQ ID NO: 3429 - DNA, 24 bp, Artificial Sequence
  Synthetic polynucleotide encoding artificial human antibody CDR-H2 region
atcagcagtactggaaccaccaca

SEQ ID NO: 3430 - DNA, 24 bp, Artificial Sequence
  Synthetic polynucleotide encoding artificial human antibody CDR-H2 region
atatcaaatgacggaagtaataaa

SEQ ID NO: 3431 - DNA, 24 bp, Artificial Sequence
  Synthetic polynucleotide encoding artificial human antibody CDR-H2 region
atctatcctggtgactctgatacc

SEQ ID NO: 3432 - DNA, 24 bp, Artificial Sequence
  Synthetic polynucleotide encoding artificial human antibody CDR-H2 region
attagtcgggggagcagtgtgata

SEQ ID NO: 3433 - DNA, 21 bp, Artificial Sequence
  Synthetic polynucleotide encoding artificial human antibody CDR-H2 region
attttttcgaatgacgaaaaa

SEQ ID NO: 3434 - DNA, 24 bp, Artificial Sequence
  Synthetic polynucleotide encoding artificial human antibody CDR-H2 region
atcaaccctaacagtggtggcaca

SEQ ID NO: 3435 - DNA, 24 bp, Artificial Sequence
  Synthetic polynucleotide encoding artificial human antibody CDR-H2 region
atcagcgcttacaatggtaacaca

SEQ ID NO: 3436 - DNA, 27 bp, Artificial Sequence
  Synthetic polynucleotide encoding artificial human antibody CDR-H2 region
acattctacaggaccaagtggtatagt

SEQ ID NO: 3437 - DNA, 21 bp, Artificial Sequence
  Synthetic polynucleotide encoding artificial human antibody CDR-H2 region
atctgtcatagtgggagcacc

SEQ ID NO: 3438 - DNA, 21 bp, Artificial Sequence
  Synthetic polynucleotide encoding artificial human antibody CDR-H2 region
atttatagcggtggtagcaca

SEQ ID NO: 3439 - DNA, 24 bp, Artificial Sequence
  Synthetic polynucleotide encoding artificial human antibody CDR-H2 region
atcaaccctaatggtggtactact

SEQ ID NO: 3440 - DNA, 21 bp, Artificial Sequence
  Synthetic polynucleotide encoding artificial human antibody CDR-H2 region
atctattacagtgggagcacc

SEQ ID NO: 3441 - DNA, 21 bp, Artificial Sequence
  Synthetic polynucleotide encoding artificial human antibody CDR-H2 region
atccattatactgggagcacc

SEQ ID NO: 3442 - DNA, 24 bp, Artificial Sequence
  Synthetic polynucleotide encoding artificial human antibody CDR-H2 region
atatcatatgatggaagtaataaa

SEQ ID NO: 3443 - DNA, 24 bp, Artificial Sequence
  Synthetic polynucleotide encoding artificial human antibody CDR-H2 region
attagtggcagtggtggtagcaca

SEQ ID NO: 3444 - DNA, 21 bp, Artificial Sequence
  Synthetic polynucleotide encoding artificial human antibody CDR-H2 region
atctattatagtgggagcacc

SEQ ID NO: 3445 - DNA, 24 bp, Artificial Sequence
  Synthetic polynucleotide encoding artificial human antibody CDR-H2 region
atcaaccctaacagtggtggcaca

SEQ ID NO: 3446 - DNA, 24 bp, Artificial Sequence
  Synthetic polynucleotide encoding artificial human antibody CDR-H2 region
atcaatcctgctgactctgatacc

SEQ ID NO: 3447 - DNA, 24 bp, Artificial Sequence
  Synthetic polynucleotide encoding artificial human antibody CDR-H2 region
atctatcctgctgactctgatacc

SEQ ID NO: 3448 - DNA, 24 bp, Artificial Sequence
  Synthetic polynucleotide encoding artificial human antibody CDR-H2 region
atcagttatagtggtaataccaca

SEQ ID NO: 3449 - DNA, 24 bp, Artificial Sequence
  Synthetic polynucleotide encoding artificial human antibody CDR-H2 region
atcaaccctggtggtggtagcaca

SEQ ID NO: 3450 - DNA, 24 bp, Artificial Sequence
  Synthetic polynucleotide encoding artificial human antibody CDR-H2 region
attactagtcctggtggtcacaca

SEQ ID NO: 3451 - DNA, 24 bp, Artificial Sequence
  Synthetic polynucleotide encoding artificial human antibody CDR-H2 region
attagtggcagtggtggtagcaca

SEQ ID NO: 3452 - DNA, 24 bp, Artificial Sequence
  Synthetic polynucleotide encoding artificial human antibody CDR-H2 region
atcaaccctgtcaatggggtcaca

SEQ ID NO: 3453 - DNA, 24 bp, Artificial Sequence
  Synthetic polynucleotide encoding artificial human antibody CDR-H2 region
atcaacaccaacactgggaaccca

SEQ ID NO: 3454 - DNA, 24 bp, Artificial Sequence
  Synthetic polynucleotide encoding artificial human antibody CDR-H2 region
atttcatctgatggaagcaataaa

SEQ ID NO: 3455 - DNA, 24 bp, Artificial Sequence
  Synthetic polynucleotide encoding artificial human antibody CDR-H2 region
gttagtggaagtggttttaccact

SEQ ID NO: 3456 - DNA, 24 bp, Artificial Sequence
  Synthetic polynucleotide encoding artificial human antibody CDR-H2 region
attagtagtagtagtagttacata

SEQ ID NO: 3457 - DNA, 21 bp, Artificial Sequence
  Synthetic polynucleotide encoding artificial human antibody CDR-H2 region
attaattgggatgatgataag

SEQ ID NO: 3458 - DNA, 21 bp, Artificial Sequence
  Synthetic polynucleotide encoding artificial human antibody CDR-H2 region
atttattgggatgatgatacg

SEQ ID NO: 3459 - DNA, 21 bp, Artificial Sequence
  Synthetic polynucleotide encoding artificial human antibody CDR-H2 region
atctattacattgggaccacc

SEQ ID NO: 3460 - DNA, 24 bp, Artificial Sequence
  Synthetic polynucleotide encoding artificial human antibody CDR-H2 region
ataaaccaagatggaggtgagaaa

SEQ ID NO: 3461 - DNA, 24 bp, Artificial Sequence
  Synthetic polynucleotide encoding artificial human antibody CDR-H2 region
atcatccctgtctttggtccacca

SEQ ID NO: 3462 - DNA, 24 bp, Artificial Sequence
  Synthetic polynucleotide encoding artificial human antibody CDR-H2 region
atcgtccctatctttgatacaaca

SEQ ID NO: 3463 - DNA, 24 bp, Artificial Sequence
  Synthetic polynucleotide encoding artificial human antibody CDR-H2 region
atcaacgctggcaatgggaacaca

SEQ ID NO: 3464 - DNA, 24 bp, Artificial Sequence
  Synthetic polynucleotide encoding artificial human antibody CDR-H2 region
atcagcccttacaatggtaacata

SEQ ID NO: 3465 - DNA, 24 bp, Artificial Sequence
  Synthetic polynucleotide encoding artificial human antibody CDR-H2 region
attagtggtcctggtgaaagttca

SEQ ID NO: 3466 - DNA, 24 bp, Artificial Sequence
  Synthetic polynucleotide encoding artificial human antibody CDR-H2 region
atcaaccctagcggtggttacaca

SEQ ID NO: 3467 - DNA, 24 bp, Artificial Sequence
  Synthetic polynucleotide encoding artificial human antibody CDR-H2 region
gtctttcctggtgactctgatatc

SEQ ID NO: 3468 - DNA, 24 bp, Artificial Sequence
  Synthetic polynucleotide encoding artificial human antibody CDR-H2 region
atatggtatgatggaaccaacaag

SEQ ID NO: 3469 - DNA, 24 bp, Artificial Sequence
  Synthetic polynucleotide encoding artificial human antibody CDR-H2 region
attgatcctagtgactcttatacc

SEQ ID NO: 3470 - DNA, 24 bp, Artificial Sequence
  Synthetic polynucleotide encoding artificial human antibody CDR-H2 region
attagtggggatggtactcggaca

SEQ ID NO: 3471 - DNA, 24 bp, Artificial Sequence
  Synthetic polynucleotide encoding artificial human antibody CDR-H2 region
acttatcatcgcacaactaccacc

SEQ ID NO: 3472 - DNA, 24 bp, Artificial Sequence
  Synthetic polynucleotide encoding artificial human antibody CDR-H2 region
atcacccctaattctggcacacca

SEQ ID NO: 3473 - DNA, 30 bp, Artificial Sequence
  Synthetic polynucleotide encoding artificial human antibody CDR-H2 region
attagaagcaaagcttatggtgggacaaga

SEQ ID NO: 3474 - DNA, 24 bp, Artificial Sequence
  Synthetic polynucleotide encoding artificial human antibody CDR-H2 region
ataagcggttacaatggaagaaca

SEQ ID NO: 3475 - DNA, 24 bp, Artificial Sequence
  Synthetic polynucleotide encoding artificial human antibody CDR-H2 region
atgaacgcagatgggagtgagaaa

SEQ ID NO: 3476 - DNA, 24 bp, Artificial Sequence
  Synthetic polynucleotide encoding artificial human antibody CDR-H2 region
attagtagtagtagtagtaccata

SEQ ID NO: 3477 - DNA, 21 bp, Artificial Sequence
  Synthetic polynucleotide encoding artificial human antibody CDR-H2 region
atctactatagtgggagcacc

SEQ ID NO: 3478 - DNA, 21 bp, Artificial Sequence
  Synthetic polynucleotide encoding artificial human antibody CDR-H2 region
atgttttatggtgggagcacc

SEQ ID NO: 3479 - DNA, 24 bp, Artificial Sequence
  Synthetic polynucleotide encoding artificial human antibody CDR-H2 region
atatggtatgatggaagtaatgaa

SEQ ID NO: 3480 - DNA, 24 bp, Artificial Sequence
  Synthetic polynucleotide encoding artificial human antibody CDR-H2 region
atcagcactgacagtggtaacaca

SEQ ID NO: 3481 - DNA, 24 bp, Artificial Sequence
  Synthetic polynucleotide encoding artificial human antibody CDR-H2 region
attcattggaatggtggtagcaca

SEQ ID NO: 3482 - DNA, 24 bp, Artificial Sequence
  Synthetic polynucleotide encoding artificial human antibody CDR-H2 region
atgtggtatgatggaaataataaa

SEQ ID NO: 3483 - DNA, 24 bp, Artificial Sequence
  Synthetic polynucleotide encoding artificial human antibody CDR-H2 region
attagtggcagtggtggtcggaca

SEQ ID NO: 3484 - DNA, 30 bp, Artificial Sequence
  Synthetic polynucleotide encoding artificial human antibody CDR-H2 region
attaaaaccaaaactgatggtgggacaaca

SEQ ID NO: 3485 - DNA, 24 bp, Artificial Sequence
  Synthetic polynucleotide encoding artificial human antibody CDR-H2 region
atttggcatgatggcagtaagacg

SEQ ID NO: 3486 - DNA, 24 bp, Artificial Sequence
  Synthetic polynucleotide encoding artificial human antibody CDR-H2 region
attagcccttacacccgtcagaca

SEQ ID NO: 3487 - DNA, 24 bp, Artificial Sequence
  Synthetic polynucleotide encoding artificial human antibody CDR-H2 region
acacgttttgatggaagtgaaaaa

SEQ ID NO: 3488 - DNA, 24 bp, Artificial Sequence
  Synthetic polynucleotide encoding artificial human antibody CDR-H2 region
atatcacatgatggaagtaataac

SEQ ID NO: 3489 - DNA, 24 bp, Artificial Sequence
  Synthetic polynucleotide encoding artificial human antibody CDR-H2 region
atccacgttggaaatgatcacaca

SEQ ID NO: 3490 - DNA, 24 bp, Artificial Sequence
  Synthetic polynucleotide encoding artificial human antibody CDR-H2 region
tttgatcctagtgactcttataac

SEQ ID NO: 3491 - DNA, 21 bp, Artificial Sequence
  Synthetic polynucleotide encoding artificial human antibody CDR-H2 region
atttattgggatgatgataag

SEQ ID NO: 3492 - DNA, 24 bp, Artificial Sequence
  Synthetic polynucleotide encoding artificial human antibody CDR-H2 region
attagtggagatagtcgtgacatc

SEQ ID NO: 3493 - DNA, 24 bp, Artificial Sequence
  Synthetic polynucleotide encoding artificial human antibody CDR-H2 region
atcatacctgtcctaggtatacca

SEQ ID NO: 3494 - DNA, 21 bp, Artificial Sequence
  Synthetic polynucleotide encoding artificial human antibody CDR-H2 region
gtctattacagtgggaacacc

SEQ ID NO: 3495 - DNA, 24 bp, Artificial Sequence
  Synthetic polynucleotide encoding artificial human antibody CDR-H2 region
attagtagtaatgggggtagcaca

SEQ ID NO: 3496 - DNA, 24 bp, Artificial Sequence
  Synthetic polynucleotide encoding artificial human antibody CDR-H2 region
attagtagtagtaggagtaccata

SEQ ID NO: 3497 - DNA, 21 bp, Artificial Sequence
  Synthetic polynucleotide encoding artificial human antibody CDR-H2 region
atcattcatactgggaccacc

SEQ ID NO: 3498 - DNA, 24 bp, Artificial Sequence
  Synthetic polynucleotide encoding artificial human antibody CDR-H2 region
attaatactgatgggactgtcaca

SEQ ID NO: 3499 - DNA, 21 bp, Artificial Sequence
  Synthetic polynucleotide encoding artificial human antibody CDR-H2 region
atttattgggatgatgataag

SEQ ID NO: 3500 - DNA, 24 bp, Artificial Sequence
  Synthetic polynucleotide encoding artificial human antibody CDR-H2 region
atatcatatgatggaagtaataaa

SEQ ID NO: 3501 - DNA, 24 bp, Artificial Sequence
  Synthetic polynucleotide encoding artificial human antibody CDR-H2 region
attagtagtagtggtagtaccata

SEQ ID NO: 3502 - DNA, 24 bp, Artificial Sequence
  Synthetic polynucleotide encoding artificial human antibody CDR-H2 region
attagtagtagtagtagtaccata

SEQ ID NO: 3503 - DNA, 21 bp, Artificial Sequence
  Synthetic polynucleotide encoding artificial human antibody CDR-H2 region
attgattgggatgatgataaa

SEQ ID NO: 3504 - DNA, 24 bp, Artificial Sequence
  Synthetic polynucleotide encoding artificial human antibody CDR-H2 region
ataaagcaagatggaagtgagaaa

SEQ ID NO: 3505 - DNA, 24 bp, Artificial Sequence
  Synthetic polynucleotide encoding artificial human antibody CDR-H2 region
tttgttggtagcggtgacaccaca

SEQ ID NO: 3506 - DNA, 24 bp, Artificial Sequence
  Synthetic polynucleotide encoding artificial human antibody CDR-H2 region
attagtagtagtagtagtaccaaa

SEQ ID NO: 3507 - DNA, 24 bp, Artificial Sequence
  Synthetic polynucleotide encoding artificial human antibody CDR-H2 region
atcaaccctaagactggtgccaca

SEQ ID NO: 3508 - DNA, 21 bp, Artificial Sequence
  Synthetic polynucleotide encoding artificial human antibody CDR-H2 region
atctatgccagtgggagcacc

SEQ ID NO: 3509 - DNA, 24 bp, Artificial Sequence
  Synthetic polynucleotide encoding artificial human antibody CDR-H2 region
atctatcctggtgactctgatacc

SEQ ID NO: 3510 - DNA, 30 bp, Artificial Sequence; identical to SEQ ID NO: 3426
  Synthetic polynucleotide encoding artificial human antibody CDR-H2 region

SEQ ID NO: 3511 - DNA, 24 bp, Artificial Sequence
  Synthetic polynucleotide encoding artificial human antibody CDR-H2 region
atatcaaaagatggaaacagcaaa

SEQ ID NO: 3512 - DNA, 30 bp, Artificial Sequence
  Synthetic polynucleotide encoding artificial human antibody CDR-H2 region
attagaagcaaaactaagaattacgcgaca

SEQ ID NO: 3513 - DNA, 21 bp, Artificial Sequence
  Synthetic polynucleotide encoding artificial human antibody CDR-H2 region
atctacaccagtgggagcacc

SEQ ID NO: 3514 - DNA, 30 bp, Artificial Sequence
  Synthetic polynucleotide encoding artificial human antibody CDR-H2 region
attagtaccaaaggttatgatgagacagca

SEQ ID NO: 3515 - DNA, 24 bp, Artificial Sequence
  Synthetic polynucleotide encoding artificial human antibody CDR-H2 region
ataccgtatgatggaagtaataaa

SEQ ID NO: 3516 - DNA, 24 bp, Artificial Sequence
  Synthetic polynucleotide encoding artificial human antibody CDR-H2 region
atcagtactagtacaagtaccata

SEQ ID NO: 3517 - DNA, 24 bp, Artificial Sequence
  Synthetic polynucleotide encoding artificial human antibody CDR-H2 region
attagtagtagtggtagtaccata

SEQ ID NO: 3518 - DNA, 24 bp, Artificial Sequence
  Synthetic polynucleotide encoding artificial human antibody CDR-H2 region
attagtagtagtagtagtaccata

SEQ ID NO: 3519 - DNA, 21 bp, Artificial Sequence
  Synthetic polynucleotide encoding artificial human antibody CDR-H2 region
atgtacagtggtggcgccaca

SEQ ID NO: 3520 - DNA, 24 bp, Artificial Sequence
  Synthetic polynucleotide encoding artificial human antibody CDR-H2 region
atctatcctggtgactctgatacc

SEQ ID NO: 3521 - DNA, 30 bp, Artificial Sequence
  Synthetic polynucleotide encoding artificial human antibody CDR-H2 region
attagaagtaaacctaacagttacgcgaca

SEQ ID NO: 3522 - DNA, 24 bp, Artificial Sequence
  Synthetic polynucleotide encoding artificial human antibody CDR-H2 region
atatggtatgatggaagtaatgag

SEQ ID NO: 3523 - DNA, 24 bp, Artificial Sequence
  Synthetic polynucleotide encoding artificial human antibody CDR-H2 region
atatggtatgatggaagtaataaa

SEQ ID NO: 3524 - DNA, 9 bp, Artificial Sequence
  Synthetic polynucleotide encoding artificial human antibody CDR-L2 region
agtgcatcc

SEQ ID NO: 3525 - DNA, 9 bp, Artificial Sequence
  Synthetic polynucleotide encoding artificial human antibody CDR-L2 region
gctgcatcc

SEQ ID NO: 3526 - DNA, 9 bp, Artificial Sequence
  Synthetic polynucleotide encoding artificial human antibody CDR-L2 region
actgcatcc

SEQ ID NO: 3527 - DNA, 9 bp, Artificial Sequence
  Synthetic polynucleotide encoding artificial human antibody CDR-L2 region
aggaataat

SEQ ID NO: 3528 - DNA, 9 bp, Artificial Sequence
  Synthetic polynucleotide encoding artificial human antibody CDR-L2 region
ggtaaaaac

SEQ ID NO: 3529 - DNA, 9 bp, Artificial Sequence
  Synthetic polynucleotide encoding artificial human antibody CDR-L2 region
tatgatagc

SEQ ID NO: 3530 - DNA, 9 bp, Artificial Sequence
  Synthetic polynucleotide encoding artificial human antibody CDR-L2 region
gctgcatcc

SEQ ID NO: 3531 - DNA, 9 bp, Artificial Sequence
  Synthetic polynucleotide encoding artificial human antibody CDR-L2 region
gatgcatcc

SEQ ID NO: 3532 - DNA, 9 bp, Artificial Sequence
  Synthetic polynucleotide encoding artificial human antibody CDR-L2 region
gaggatgac

SEQ ID NO: 3533 - DNA, 9 bp, Artificial Sequence
  Synthetic polynucleotide encoding artificial human antibody CDR-L2 region
ggtgcatcc

SEQ ID NO: 3534 - DNA, 9 bp, Artificial Sequence
  Synthetic polynucleotide encoding artificial human antibody CDR-L2 region
gaaaataat

SEQ ID NO: 3535 - DNA, 9 bp, Artificial Sequence
  Synthetic polynucleotide encoding artificial human antibody CDR-L2 region
atggtttct

SEQ ID NO: 3536 - DNA, 9 bp, Artificial Sequence
  Synthetic polynucleotide encoding artificial human antibody CDR-L2 region
agggataat

SEQ ID NO: 3537 - DNA, 9 bp, Artificial Sequence
  Synthetic polynucleotide encoding artificial human antibody CDR-L2 region
agtagtagt

SEQ ID NO: 3538 - DNA, 9 bp, Artificial Sequence
  Synthetic polynucleotide encoding artificial human antibody CDR-L2 region
gatgcatcc

SEQ ID NO: 3539 - DNA, 9 bp, Artificial Sequence
  Synthetic polynucleotide encoding artificial human antibody CDR-L2 region
ggtgcatcc

SEQ ID NO: 3540 - DNA, 9 bp, Artificial Sequence
  Synthetic polynucleotide encoding artificial human antibody CDR-L2 region
aaagacagt

SEQ ID NO: 3541 - DNA, 9 bp, Artificial Sequence
  Synthetic polynucleotide encoding artificial human antibody CDR-L2 region
gatgcatcc

SEQ ID NO: 3542 - DNA, 9 bp, Artificial Sequence
  Synthetic polynucleotide encoding artificial human antibody CDR-L2 region
gatgcatcc

SEQ ID NO: 3543 - DNA, 9 bp, Artificial Sequence
  Synthetic polynucleotide encoding artificial human antibody CDR-L2 region
gctgcatcc

SEQ ID NO: 3544 - DNA, 9 bp, Artificial Sequence
  Synthetic polynucleotide encoding artificial human antibody CDR-L2 region
tgggcatct

SEQ ID NO: 3545 - DNA, 9 bp, Artificial Sequence
  Synthetic polynucleotide encoding artificial human antibody CDR-L2 region
ggtgcatcc

SEQ ID NO: 3546 - DNA, 9 bp, Artificial Sequence
  Synthetic polynucleotide encoding artificial human antibody CDR-L2 region
gaggtcagt

SEQ ID NO: 3547 - DNA, 9 bp, Artificial Sequence
  Synthetic polynucleotide encoding artificial human antibody CDR-L2 region
aggattgat

SEQ ID NO: 3548 - DNA, 9 bp, Artificial Sequence
  Synthetic polynucleotide encoding artificial human antibody CDR-L2 region
gctgcatcc

SEQ ID NO: 3549 - DNA, 9 bp, Artificial Sequence
  Synthetic polynucleotide encoding artificial human antibody CDR-L2 region
gctgcatcc

SEQ ID NO: 3550 - DNA, 9 bp, Artificial Sequence
  Synthetic polynucleotide encoding artificial human antibody CDR-L2 region
ggtgacagc

SEQ ID NO: 3551 - DNA, 9 bp, Artificial Sequence
  Synthetic polynucleotide encoding artificial human antibody CDR-L2 region
gatgatagc

SEQ ID NO: 3552 - DNA, 9 bp, Artificial Sequence
  Synthetic polynucleotide encoding artificial human antibody CDR-L2 region
gctgcatcc

SEQ ID NO: 3553 - DNA, 9 bp, Artificial Sequence
  Synthetic polynucleotide encoding artificial human antibody CDR-L2 region
gaggacatt

SEQ ID NO: 3554 - DNA, 9 bp, Artificial Sequence
  Synthetic polynucleotide encoding artificial human antibody CDR-L2 region
gaggtcagt

SEQ ID NO: 3555 - DNA, 9 bp, Artificial Sequence
  Synthetic polynucleotide encoding artificial human antibody CDR-L2 region
gacaataat

SEQ ID NO: 3556 - DNA, 9 bp, Artificial Sequence
  Synthetic polynucleotide encoding artificial human antibody CDR-L2 region
aaggtttct

SEQ ID NO: 3557 - DNA, 9 bp, Artificial Sequence
  Synthetic polynucleotide encoding artificial human antibody CDR-L2 region
ggtgcatcc

SEQ ID NO: 3558 - DNA, 9 bp, Artificial Sequence
  Synthetic polynucleotide encoding artificial human antibody CDR-L2 region
ggtaacatc

SEQ ID NO: 3559 - DNA, 9 bp, Artificial Sequence
  Synthetic polynucleotide encoding artificial human antibody CDR-L2 region
gctgcatcc

SEQ ID NO: 3560 - DNA, 9 bp, Artificial Sequence
  Synthetic polynucleotide encoding artificial human antibody CDR-L2 region
tgggcatct

SEQ ID NO: 3561 - DNA, 9 bp, Artificial Sequence
  Synthetic polynucleotide encoding artificial human antibody CDR-L2 region
cgtaacaac

SEQ ID NO: 3562 - DNA, 9 bp, Artificial Sequence
  Synthetic polynucleotide encoding artificial human antibody CDR-L2 region
gaggataaa

SEQ ID NO: 3563 - DNA, 9 bp, Artificial Sequence
  Synthetic polynucleotide encoding artificial human antibody CDR-L2 region
gctgcatcc

SEQ ID NO: 3564 - DNA, 9 bp, Artificial Sequence
  Synthetic polynucleotide encoding artificial human antibody CDR-L2 region
tatgatagc

SEQ ID NO: 3565 - DNA, 9 bp, Artificial Sequence
  Synthetic polynucleotide encoding artificial human antibody CDR-L2 region
gatgtcagt

SEQ ID NO: 3566 - DNA, 9 bp, Artificial Sequence
  Synthetic polynucleotide encoding artificial human antibody CDR-L2 region
gctgcatcc

SEQ ID NO: 3567 - DNA, 9 bp, Artificial Sequence
  Synthetic polynucleotide encoding artificial human antibody CDR-L2 region
gctgcctcc

SEQ ID NO: 3568 - DNA, 9 bp, Artificial Sequence
  Synthetic polynucleotide encoding artificial human antibody CDR-L2 region
ggtgaaaac

SEQ ID NO: 3569 - DNA, 9 bp, Artificial Sequence
  Synthetic polynucleotide encoding artificial human antibody CDR-L2 region
gctgcatcc

SEQ ID NO: 3570 - DNA, 9 bp, Artificial Sequence
  Synthetic polynucleotide encoding artificial human antibody CDR-L2 region
gctgcatcc

SEQ ID NO: 3571 - DNA, 9 bp, Artificial Sequence
  Synthetic polynucleotide encoding artificial human antibody CDR-L2 region
ggtgcatcc

SEQ ID NO: 3572 - DNA, 9 bp, Artificial Sequence
  Synthetic polynucleotide encoding artificial human antibody CDR-L2 region
ggtgcatcc

SEQ ID NO: 3573 - DNA, 9 bp, Artificial Sequence
  Synthetic polynucleotide encoding artificial human antibody CDR-L2 region
gattcatcc

SEQ ID NO: 3574 - DNA, 9 bp, Artificial Sequence
  Synthetic polynucleotide encoding artificial human antibody CDR-L2 region
aaggcatct

SEQ ID NO: 3575 - DNA, 9 bp, Artificial Sequence
  Synthetic polynucleotide encoding artificial human antibody CDR-L2 region
tatgatagc

SEQ ID NO: 3576 - DNA, 9 bp, Artificial Sequence
  Synthetic polynucleotide encoding artificial human antibody CDR-L2 region
gatgcatcc

SEQ ID NO: 3577 - DNA, 9 bp, Artificial Sequence
  Synthetic polynucleotide encoding artificial human antibody CDR-L2 region
ttggggtct

SEQ ID NO: 3578 - DNA, 9 bp, Artificial Sequence
  Synthetic polynucleotide encoding artificial human antibody CDR-L2 region
aaggcgtct

SEQ ID NO: 3579 - DNA, 9 bp, Artificial Sequence
  Synthetic polynucleotide encoding artificial human antibody CDR-L2 region
aacattaat

SEQ ID NO: 3580 - DNA, 9 bp, Artificial Sequence
  Synthetic polynucleotide encoding artificial human antibody CDR-L2 region
ggtgcatcc

SEQ ID NO: 3581 - DNA, 9 bp, Artificial Sequence
  Synthetic polynucleotide encoding artificial human antibody CDR-L2 region
gctgataga

SEQ ID NO: 3582 - DNA, 9 bp, Artificial Sequence
  Synthetic polynucleotide encoding artificial human antibody CDR-L2 region
aaggcgtct

SEQ ID NO: 3583 - DNA, 9 bp, Artificial Sequence
  Synthetic polynucleotide encoding artificial human antibody CDR-L2 region
gaagctact

SEQ ID NO: 3584 - DNA, 9 bp, Artificial Sequence
  Synthetic polynucleotide encoding artificial human antibody CDR-L2 region
ggtgcatcc

SEQ ID NO: 3585 - DNA, 9 bp, Artificial Sequence
  Synthetic polynucleotide encoding artificial human antibody CDR-L2 region
gaggacagc

SEQ ID NO: 3586 - DNA, 9 bp, Artificial Sequence
  Synthetic polynucleotide encoding artificial human antibody CDR-L2 region
ttgggttct

SEQ ID NO: 3587 - DNA, 9 bp, Artificial Sequence
  Synthetic polynucleotide encoding artificial human antibody CDR-L2 region
gaggtcaag

SEQ ID NO: 3588 - DNA, 9 bp, Artificial Sequence
  Synthetic polynucleotide encoding artificial human antibody CDR-L2 region
gatgcatcc

SEQ ID NO: 3589 - DNA, 9 bp, Artificial Sequence
  Synthetic polynucleotide encoding artificial human antibody CDR-L2 region
gatgtcagt

SEQ ID NO: 3590 - DNA, 9 bp, Artificial Sequence
  Synthetic polynucleotide encoding artificial human antibody CDR-L2 region
gaagtttcc

SEQ ID NO: 3591 - DNA, 9 bp, Artificial Sequence
  Synthetic polynucleotide encoding artificial human antibody CDR-L2 region
ggcgcatcc

SEQ ID NO: 3592 - DNA, 9 bp, Artificial Sequence
  Synthetic polynucleotide encoding artificial human antibody CDR-L2 region
gctgcatcc

SEQ ID NO: 3593 - DNA, 9 bp, Artificial Sequence
  Synthetic polynucleotide encoding artificial human antibody CDR-L2 region
gacaataac

SEQ ID NO: 3594 - DNA, 9 bp, Artificial Sequence
  Synthetic polynucleotide encoding artificial human antibody CDR-L2 region
gatgtgtcc

SEQ ID NO: 3595 - DNA, 9 bp, Artificial Sequence
  Synthetic polynucleotide encoding artificial human antibody CDR-L2 region
ggtgcatcc

SEQ ID NO: 3596 - DNA, 9 bp, Artificial Sequence
  Synthetic polynucleotide encoding artificial human antibody CDR-L2 region
aaggcgtct

SEQ ID NO: 3597 - DNA, 9 bp, Artificial Sequence
  Synthetic polynucleotide encoding artificial human antibody CDR-L2 region
ggtaaaaac

SEQ ID NO: 3598 - DNA, 9 bp, Artificial Sequence
  Synthetic polynucleotide encoding artificial human antibody CDR-L2 region
gctgcatcc

SEQ ID NO: 3599 - DNA, 9 bp, Artificial Sequence
  Synthetic polynucleotide encoding artificial human antibody CDR-L2 region
gatgcatcc

SEQ ID NO: 3600 - DNA, 9 bp, Artificial Sequence
  Synthetic polynucleotide encoding artificial human antibody CDR-L2 region
gaaaataat

SEQ ID NO: 3601 - DNA, 9 bp, Artificial Sequence
  Synthetic polynucleotide encoding artificial human antibody CDR-L2 region
gctgcatcc

SEQ ID NO: 3602 - DNA, 9 bp, Artificial Sequence
  Synthetic polynucleotide encoding artificial human antibody CDR-L2 region
tgggcttct

SEQ ID NO: 3603 - DNA, 9 bp, Artificial Sequence
  Synthetic polynucleotide encoding artificial human antibody CDR-L2 region
gacgcatct

SEQ ID NO: 3604 - DNA, 9 bp, Artificial Sequence
  Synthetic polynucleotide encoding artificial human antibody CDR-L2 region
gctgcatcc

SEQ ID NO: 3605 - DNA, 9 bp, Artificial Sequence
  Synthetic polynucleotide encoding artificial human antibody CDR-L2 region
ggtaacatc

SEQ ID NO: 3606 - DNA, 9 bp, Artificial Sequence
  Synthetic polynucleotide encoding artificial human antibody CDR-L2 region
ggtgcatcc

SEQ ID NO: 3607 - DNA, 9 bp, Artificial Sequence
  Synthetic polynucleotide encoding artificial human antibody CDR-L2 region
gacgcatcc

SEQ ID NO: 3608 - DNA, 9 bp, Artificial Sequence
  Synthetic polynucleotide encoding artificial human antibody CDR-L2 region
aatgatcat

SEQ ID NO: 3609 - DNA, 9 bp, Artificial Sequence
  Synthetic polynucleotide encoding artificial human antibody CDR-L2 region
acggtttcc

SEQ ID NO: 3610 - DNA, 9 bp, Artificial Sequence
  Synthetic polynucleotide encoding artificial human antibody CDR-L2 region
caagatagc

SEQ ID NO: 3611 - DNA, 9 bp, Artificial Sequence
  Synthetic polynucleotide encoding artificial human antibody CDR-L2 region
caacataac

SEQ ID NO: 3612 - DNA, 9 bp, Artificial Sequence
  Synthetic polynucleotide encoding artificial human antibody CDR-L2 region
tgggcatct

SEQ ID NO: 3613 - DNA, 9 bp, Artificial Sequence
  Synthetic polynucleotide encoding artificial human antibody CDR-L2 region
gatgcatcc

SEQ ID NO: 3614 - DNA, 9 bp, Artificial Sequence
  Synthetic polynucleotide encoding artificial human antibody CDR-L2 region
gatgcatcc

SEQ ID NO: 3615 - DNA, 9 bp, Artificial Sequence
  Synthetic polynucleotide encoding artificial human antibody CDR-L2 region
ttgggttct

SEQ ID NO: 3616 - DNA, 9 bp, Artificial Sequence
  Synthetic polynucleotide encoding artificial human antibody CDR-L2 region
ttggtgtct

SEQ ID NO: 3617 - DNA, 9 bp, Artificial Sequence
  Synthetic polynucleotide encoding artificial human antibody CDR-L2 region
gacaatgat

SEQ ID NO: 3618 - DNA, 9 bp, Artificial Sequence
  Synthetic polynucleotide encoding artificial human antibody CDR-L2 region
gatgcatcc

SEQ ID NO: 3619 - DNA, 9 bp, Artificial Sequence
  Synthetic polynucleotide encoding artificial human antibody CDR-L2 region
ttgggttct

SEQ ID NO: 3620 - DNA, 9 bp, Artificial Sequence
  Synthetic polynucleotide encoding artificial human antibody CDR-L2 region
gatgtcagt

SEQ ID NO: 3621 - DNA, 9 bp, Artificial Sequence
  Synthetic polynucleotide encoding artificial human antibody CDR-L2 region
aaggtttct

SEQ ID NO: 3622 - DNA, 9 bp, Artificial Sequence
  Synthetic polynucleotide encoding artificial human antibody CDR-L2 region
gctgcatcc

SEQ ID NO: 3623 - DNA, 9 bp, Artificial Sequence
  Synthetic polynucleotide encoding artificial human antibody CDR-L2 region
gatgcatcc

SEQ ID NO: 3624 - DNA, 9 bp, Artificial Sequence
  Synthetic polynucleotide encoding artificial human antibody CDR-L2 region
gatgatagc

SEQ ID NO: 3625 - DNA, 9 bp, Artificial Sequence
  Synthetic polynucleotide encoding artificial human antibody CDR-L2 region
gctgcatcc

SEQ ID NO: 3626 - DNA, 9 bp, Artificial Sequence
  Synthetic polynucleotide encoding artificial human antibody CDR-L2 region
gttgcatcc

SEQ ID NO: 3627 - DNA, 9 bp, Artificial Sequence
  Synthetic polynucleotide encoding artificial human antibody CDR-L2 region
aaggcgtcc

SEQ ID NO: 3628 - DNA, 9 bp, Artificial Sequence
  Synthetic polynucleotide encoding artificial human antibody CDR-L2 region
gaactttcc

SEQ ID NO: 3629 - DNA, 9 bp, Artificial Sequence
  Synthetic polynucleotide encoding artificial human antibody CDR-L2 region
gctgcatcc

SEQ ID NO: 3630 - DNA, 9 bp, Artificial Sequence
  Synthetic polynucleotide encoding artificial human antibody CDR-L2 region
ggtaacaga

SEQ ID NO: 3631 - DNA, 9 bp, Artificial Sequence
  Synthetic polynucleotide encoding artificial human antibody CDR-L2 region
tatgcatcc

SEQ ID NO: 3632 - DNA, 9 bp, Artificial Sequence
  Synthetic polynucleotide encoding artificial human antibody CDR-L2 region
ggcgcgtcc

SEQ ID NO: 3633 - DNA, 9 bp, Artificial Sequence
  Synthetic polynucleotide encoding artificial human antibody CDR-L2 region
tcggcatct

SEQ ID NO: 3634 - DNA, 9 bp, Artificial Sequence
  Synthetic polynucleotide encoding artificial human antibody CDR-L2 region
gatgcatcc

SEQ ID NO: 3635 - DNA, 9 bp, Artificial Sequence
  Synthetic polynucleotide encoding artificial human antibody CDR-L2 region
gatgtcagt

SEQ ID NO: 3636 - DNA, 9 bp, Artificial Sequence
  Synthetic polynucleotide encoding artificial human antibody CDR-L2 region
gaggacagc

SEQ ID NO: 3637 - DNA, 9 bp, Artificial Sequence
  Synthetic polynucleotide encoding artificial human antibody CDR-L2 region
ggtgcatcc

SEQ ID NO: 3638 - DNA, 9 bp, Artificial Sequence
  Synthetic polynucleotide encoding artificial human antibody CDR-L2 region
ggtgcatcc

SEQ ID NO: 3639 - DNA, 9 bp, Artificial Sequence
  Synthetic polynucleotide encoding artificial human antibody CDR-L2 region
gatgtcaat

SEQ ID NO: 3640 - DNA, 9 bp, Artificial Sequence
  Synthetic polynucleotide encoding artificial human antibody CDR-L2 region
gcagacagc

SEQ ID NO: 3641 - DNA, 9 bp, Artificial Sequence
  Synthetic polynucleotide encoding artificial human antibody CDR-L2 region
gctgcatcc

SEQ ID NO: 3642 - DNA, 9 bp, Artificial Sequence
  Synthetic polynucleotide encoding artificial human antibody CDR-L2 region
aaaaataat

SEQ ID NO: 3643 - DNA, 9 bp, Artificial Sequence
  Synthetic polynucleotide encoding artificial human antibody CDR-L2 region
gaagcaact

SEQ ID NO: 3644 - DNA, 9 bp, Artificial Sequence
  Synthetic polynucleotide encoding artificial human antibody CDR-L2 region
gtggcgtct

SEQ ID NO: 3645 - DNA, 9 bp, Artificial Sequence
  Synthetic polynucleotide encoding artificial human antibody CDR-L2 region
gctgcatcc

SEQ ID NO: 3646 - DNA, 9 bp, Artificial Sequence
  Synthetic polynucleotide encoding artificial human antibody CDR-L2 region
ttcagaaac

SEQ ID NO: 3647 - DNA, 9 bp, Artificial Sequence
  Synthetic polynucleotide encoding artificial human antibody CDR-L2 region
gatacatcc

SEQ ID NO: 3648 - DNA, 9 bp, Artificial Sequence
  Synthetic polynucleotide encoding artificial human antibody CDR-L2 region
tatgatagc

SEQ ID NO: 3649 - DNA, 9 bp, Artificial Sequence
  Synthetic polynucleotide encoding artificial human antibody CDR-L2 region
gaggtcatt

SEQ ID NO: 3650 - DNA, 9 bp, Artificial Sequence
  Synthetic polynucleotide encoding artificial human antibody CDR-L2 region
gatgcattc

SEQ ID NO: 3651 - DNA, 9 bp, Artificial Sequence
  Synthetic polynucleotide encoding artificial human antibody CDR-L2 region
gataaagac

SEQ ID NO: 3652 - DNA, 9 bp, Artificial Sequence
  Synthetic polynucleotide encoding artificial human antibody CDR-L2 region
agtgcttcc

SEQ ID NO: 3653 - DNA, 9 bp, Artificial Sequence
  Synthetic polynucleotide encoding artificial human antibody CDR-L2 region
agggatgac

SEQ ID NO: 3654 - DNA, 9 bp, Artificial Sequence
  Synthetic polynucleotide encoding artificial human antibody CDR-L2 region
gatgatagc

SEQ ID NO: 3655 - DNA, 9 bp, Artificial Sequence
  Synthetic polynucleotide encoding artificial human antibody CDR-L2 region
aaagacact

SEQ ID NO: 3656 - DNA, 9 bp, Artificial Sequence
  Synthetic polynucleotide encoding artificial human antibody CDR-L2 region
aaagacagt

SEQ ID NO: 3657 - DNA, 9 bp, Artificial Sequence
  Synthetic polynucleotide encoding artificial human antibody CDR-L2 region
gaggacacc

SEQ ID NO: 3658 - DNA, 9 bp, Artificial Sequence
  Synthetic polynucleotide encoding artificial human antibody CDR-L2 region
gctgcatcc

SEQ ID NO: 3659 - DNA, 9 bp, Artificial Sequence
  Synthetic polynucleotide encoding artificial human antibody CDR-L2 region
gatgcatcc

SEQ ID NO: 3660 - DNA, 9 bp, Artificial Sequence
  Synthetic polynucleotide encoding artificial human antibody CDR-L2 region
gatgaatcc

SEQ ID NO: 3661 - DNA, 9 bp, Artificial Sequence
  Synthetic polynucleotide encoding artificial human antibody CDR-L2 region
gatgtcagt

SEQ ID NO: 3662 - DNA, 9 bp, Artificial Sequence
  Synthetic polynucleotide encoding artificial human antibody CDR-L2 region
caagatacc

SEQ ID NO: 3663 - DNA, 9 bp, Artificial Sequence
  Synthetic polynucleotide encoding artificial human antibody CDR-L2 region
gacaatgat

SEQ ID NO: 3664 - DNA, 9 bp, Artificial Sequence
  Synthetic polynucleotide encoding artificial human antibody CDR-L2 region
gctgcgtcc

SEQ ID NO: 3665 - DNA, 9 bp, Artificial Sequence
  Synthetic polynucleotide encoding artificial human antibody CDR-L2 region
ggtgcatcc

SEQ ID NO: 3666 - DNA, 9 bp, Artificial Sequence
  Synthetic polynucleotide encoding artificial human antibody CDR-L2 region
gacgtcagt

SEQ ID NO: 3667 - DNA, 9 bp, Artificial Sequence
  Synthetic polynucleotide encoding artificial human antibody CDR-L2 region
actgcgtcc

SEQ ID NO: 3668 - DNA, 9 bp, Artificial Sequence
  Synthetic polynucleotide encoding artificial human antibody CDR-L2 region
ggtgcatcc

SEQ ID NO: 3669 - DNA, 9 bp, Artificial Sequence
  Synthetic polynucleotide encoding artificial human antibody CDR-L2 region
aaagacaat

SEQ ID NO: 3670 - DNA, 9 bp, Artificial Sequence
  Synthetic polynucleotide encoding artificial human antibody CDR-L2 region
gatgtcatt

SEQ ID NO: 3671 - DNA, 9 bp, Artificial Sequence
  Synthetic polynucleotide encoding artificial human antibody CDR-L2 region
ggtgcatcc

SEQ ID NO: 3672 - DNA, 9 bp, Artificial Sequence
  Synthetic polynucleotide encoding artificial human antibody CDR-L2 region
tgggcgtct

SEQ ID NO: 3673 - DNA, 9 bp, Artificial Sequence
  Synthetic polynucleotide encoding artificial human antibody CDR-L2 region
cgtaacacc

SEQ ID NO: 3674 - DNA, 9 bp, Artificial Sequence
  Synthetic polynucleotide encoding artificial human antibody CDR-L2 region
gaggtcact

SEQ ID NO: 3675 - DNA, 9 bp, Artificial Sequence
  Synthetic polynucleotide encoding artificial human antibody CDR-L2 region
aaggcgtct

SEQ ID NO: 3676 - DNA, 9 bp, Artificial Sequence
  Synthetic polynucleotide encoding artificial human antibody CDR-L2 region
ggtgcatcc

SEQ ID NO: 3677 - DNA, 21 bp, Artificial Sequence
  Synthetic polynucleotide encoding artificial human antibody CDR-L2 region
cttaacagtgatggcagccac

SEQ ID NO: 3678 - DNA, 9 bp, Artificial Sequence
  Synthetic polynucleotide encoding artificial human antibody CDR-L2 region
ggtgcatcc

SEQ ID NO: 3679 - DNA, 9 bp, Artificial Sequence
  Synthetic polynucleotide encoding artificial human antibody CDR-L2 region
gctaacagc

SEQ ID NO: 3680 - DNA, 9 bp, Artificial Sequence
  Synthetic polynucleotide encoding artificial human antibody CDR-L2 region
ggtaacagt

SEQ ID NO: 3681 - DNA, 9 bp, Artificial Sequence
  Synthetic polynucleotide encoding artificial human antibody CDR-L2 region
ctgggttct

SEQ ID NO: 3682 - DNA, 9 bp, Artificial Sequence
  Synthetic polynucleotide encoding artificial human antibody CDR-L2 region
gctgcatcc

SEQ ID NO: 3683 - DNA, 9 bp, Artificial Sequence
  Synthetic polynucleotide encoding artificial human antibody CDR-L2 region
agtaataat

SEQ ID NO: 3684 - DNA, 9 bp, Artificial Sequence
  Synthetic polynucleotide encoding artificial human antibody CDR-L2 region
atgggttcg

SEQ ID NO: 3685 - DNA, 9 bp, Artificial Sequence
  Synthetic polynucleotide encoding artificial human antibody CDR-L2 region
ggtaaaaac

SEQ ID NO: 3686 - DNA, 9 bp, Artificial Sequence
  Synthetic polynucleotide encoding artificial human antibody CDR-L2 region
aaggcgtct

SEQ ID NO: 3687 - DNA, 9 bp, Artificial Sequence
  Synthetic polynucleotide encoding artificial human antibody CDR-L2 region
tgggcgtct

SEQ ID NO: 3688 - DNA, 9 bp, Artificial Sequence
  Synthetic polynucleotide encoding artificial human antibody CDR-L2 region
aggaataat

SEQ ID NO: 3689 - DNA, 9 bp, Artificial Sequence
  Synthetic polynucleotide encoding artificial human antibody CDR-L2 region
gctgcatcc

SEQ ID NO: 3690 - DNA, 9 bp, Artificial Sequence
  Synthetic polynucleotide encoding artificial human antibody CDR-L2 region
gacgatagc

SEQ ID NO: 3691 - DNA, 9 bp, Artificial Sequence
  Synthetic polynucleotide encoding artificial human antibody CDR-L2 region
gctaacaac

SEQ ID NO: 3692 - DNA, 9 bp, Artificial Sequence
  Synthetic polynucleotide encoding artificial human antibody CDR-L2 region
ggtgaaaac

SEQ ID NO: 3693 - DNA, 9 bp, Artificial Sequence
  Synthetic polynucleotide encoding artificial human antibody CDR-L2 region
gatgtcact

SEQ ID NO: 3694 - DNA, 9 bp, Artificial Sequence
  Synthetic polynucleotide encoding artificial human antibody CDR-L2 region
tgggcatct

SEQ ID NO: 3695 - DNA, 9 bp, Artificial Sequence
  Synthetic polynucleotide encoding artificial human antibody CDR-L2 region
gaggtcagt

SEQ ID NO: 3696 - DNA, 9 bp, Artificial Sequence
  Synthetic polynucleotide encoding artificial human antibody CDR-L2 region
gatgcatcc

SEQ ID NO: 3697 - DNA, 9 bp, Artificial Sequence
  Synthetic polynucleotide encoding artificial human antibody CDR-L2 region
gatgatagt

SEQ ID NO: 3698 - DNA, 9 bp, Artificial Sequence
  Synthetic polynucleotide encoding artificial human antibody CDR-L2 region
ggggcctcc

SEQ ID NO: 3699 - DNA, 9 bp, Artificial Sequence
  Synthetic polynucleotide encoding artificial human antibody CDR-L2 region
gaaaataat

SEQ ID NO: 3700 - DNA, 9 bp, Artificial Sequence
  Synthetic polynucleotide encoding artificial human antibody CDR-L2 region
tctgatagc

SEQ ID NO: 3701 - DNA, 9 bp, Artificial Sequence
  Synthetic polynucleotide encoding artificial human antibody CDR-L2 region
ggtccatcc

SEQ ID NO: 3702 - DNA, 9 bp, Artificial Sequence
  Synthetic polynucleotide encoding artificial human antibody CDR-L2 region
gagggcagt

SEQ ID NO: 3703 - DNA, 9 bp, Artificial Sequence
  Synthetic polynucleotide encoding artificial human antibody CDR-L2 region
atggtttct

SEQ ID NO: 3704 - DNA, 9 bp, Artificial Sequence
  Synthetic polynucleotide encoding artificial human antibody CDR-L2 region
aggaataat

SEQ ID NO: 3705 - DNA, 9 bp, Artificial Sequence
  Synthetic polynucleotide encoding artificial human antibody CDR-L2 region
ggtaaaaac

SEQ ID NO: 3706 - DNA, 9 bp, Artificial Sequence
  Synthetic polynucleotide encoding artificial human antibody CDR-L2 region
gctgcatcc

SEQ ID NO: 3707 - DNA, 9 bp, Artificial Sequence
  Synthetic polynucleotide encoding artificial human antibody CDR-L2 region
gatgatagc

SEQ ID NO: 3708 - DNA, 9 bp, Artificial Sequence
  Synthetic polynucleotide encoding artificial human antibody CDR-L2 region
gctgcatcc

SEQ ID NO: 3709 - DNA, 9 bp, Artificial Sequence
  Synthetic polynucleotide encoding artificial human antibody CDR-L2 region
gatgcctcc

SEQ ID NO: 3710 - DNA, 9 bp, Artificial Sequence
  Synthetic polynucleotide encoding artificial human antibody CDR-L2 region
ttgggttct

SEQ ID NO: 3711 - DNA, 9 bp, Artificial Sequence
  Synthetic polynucleotide encoding artificial human antibody CDR-L2 region
caagatagc

SEQ ID NO: 3712 - DNA, 9 bp, Artificial Sequence
  Synthetic polynucleotide encoding artificial human antibody CDR-L2 region
gaggacagc

SEQ ID NO: 3713 - DNA, 9 bp, Artificial Sequence
  Synthetic polynucleotide encoding artificial human antibody CDR-L2 region
ggtaaaaac

SEQ ID NO: 3714 - DNA, 9 bp, Artificial Sequence
  Synthetic polynucleotide encoding artificial human antibody CDR-L2 region
tgggcatct

SEQ ID NO: 3715 - DNA, 9 bp, Artificial Sequence
  Synthetic polynucleotide encoding artificial human antibody CDR-L2 region
ttgggttct

SEQ ID NO: 3716 - DNA, 9 bp, Artificial Sequence
  Synthetic polynucleotide encoding artificial human antibody CDR-L2 region
gacgtcagt

SEQ ID NO: 3717 - DNA, 9 bp, Artificial Sequence
  Synthetic polynucleotide encoding artificial human antibody CDR-L2 region
tgggcatct

SEQ ID NO: 3718 - DNA, 9 bp, Artificial Sequence
  Synthetic polynucleotide encoding artificial human antibody CDR-L2 region
gagggcagt

SEQ ID NO: 3719 - DNA, 9 bp, Artificial Sequence
  Synthetic polynucleotide encoding artificial human antibody CDR-L2 region
gaggacagc

SEQ ID NO: 3720 - DNA, 9 bp, Artificial Sequence
  Synthetic polynucleotide encoding artificial human antibody CDR-L2 region
ggtgcatcc

SEQ ID NO: 3721 - DNA, 9 bp, Artificial Sequence
  Synthetic polynucleotide encoding artificial human antibody CDR-L2 region
ggtgcatcc

SEQ ID NO: 3722 - DNA, 9 bp, Artificial Sequence
  Synthetic polynucleotide encoding artificial human antibody CDR-L2 region
tatgatagc

SEQ ID NO: 3723 - DNA, 9 bp, Artificial Sequence
  Synthetic polynucleotide encoding artificial human antibody CDR-L2 region
gacgtcatt

SEQ ID NO: 3724 - DNA, 9 bp, Artificial Sequence
  Synthetic polynucleotide encoding artificial human antibody CDR-L2 region
tgggcatct

SEQ ID NO: 3725 - DNA, 9 bp, Artificial Sequence
  Synthetic polynucleotide encoding artificial human antibody CDR-L2 region
gatgatagc

SEQ ID NO: 3726 - DNA, 9 bp, Artificial Sequence
  Synthetic polynucleotide encoding artificial human antibody CDR-L2 region
agtgcatcc

SEQ ID NO: 3727 - DNA, 9 bp, Artificial Sequence
  Synthetic polynucleotide encoding artificial human antibody CDR-L2 region
agtaataat

SEQ ID NO: 3728 - DNA, 9 bp, Artificial Sequence
  Synthetic polynucleotide encoding artificial human antibody CDR-L2 region
gaagatcac

SEQ ID NO: 3729 - DNA, 9 bp, Artificial Sequence
  Synthetic polynucleotide encoding artificial human antibody CDR-L2 region
ggtaacagc

SEQ ID NO: 3730 - DNA, 9 bp, Artificial Sequence
  Synthetic polynucleotide encoding artificial human antibody CDR-L2 region
gctgcatcc

SEQ ID NO: 3731 - DNA, 9 bp, Artificial Sequence
  Synthetic polynucleotide encoding artificial human antibody CDR-L2 region
gctgcatcc

SEQ ID NO: 3732 - DNA, 9 bp, Artificial Sequence
  Synthetic polynucleotide encoding artificial human antibody CDR-L2 region
ggtgcatcc

SEQ ID NO: 3733 - DNA, 9 bp, Artificial Sequence
  Synthetic polynucleotide encoding artificial human antibody CDR-L2 region
gaggtcact

SEQ ID NO: 3734 - DNA, 9 bp, Artificial Sequence
  Synthetic polynucleotide encoding artificial human antibody CDR-L2 region
ggtgcatcc

SEQ ID NO: 3735 - DNA, 9 bp, Artificial Sequence
  Synthetic polynucleotide encoding artificial human antibody CDR-L2 region
ggtgcatcc

SEQ ID NO: 3736 - DNA, 9 bp, Artificial Sequence
  Synthetic polynucleotide encoding artificial human antibody CDR-L2 region
aacacaaat

SEQ ID NO: 3737 - DNA, 9 bp, Artificial Sequence
  Synthetic polynucleotide encoding artificial human antibody CDR-L2 region
ggtaacgac

SEQ ID NO: 3738 - DNA, 9 bp, Artificial Sequence
  Synthetic polynucleotide encoding artificial human antibody CDR-L2 region
gctaacacc

SEQ ID NO: 3739 - DNA, 9 bp, Artificial Sequence
  Synthetic polynucleotide encoding artificial human antibody CDR-L2 region
gagacttcc

SEQ ID NO: 3740 - DNA, 9 bp, Artificial Sequence
  Synthetic polynucleotide encoding artificial human antibody CDR-L2 region
gatgtcagt

SEQ ID NO: 3741 - DNA, 9 bp, Artificial Sequence
  Synthetic polynucleotide encoding artificial human antibody CDR-L2 region
gagggcagt

SEQ ID NO: 3742 - DNA, 9 bp, Artificial Sequence
  Synthetic polynucleotide encoding artificial human antibody CDR-L2 region
tgggcatct

SEQ ID NO: 3743 - DNA, 9 bp, Artificial Sequence
  Synthetic polynucleotide encoding artificial human antibody CDR-L2 region
agtaataat

SEQ ID NO: 3744 - DNA, 9 bp, Artificial Sequence
  Synthetic polynucleotide encoding artificial human antibody CDR-L2 region
gatacaagc

SEQ ID NO: 3745 - DNA, 9 bp, Artificial Sequence
  Synthetic polynucleotide encoding artificial human antibody CDR-L2 region
agtaacaac

SEQ ID NO: 3746 - DNA, 9 bp, Artificial Sequence
  Synthetic polynucleotide encoding artificial human antibody CDR-L2 region
gatgcatcc

SEQ ID NO: 3747 - DNA, 9 bp, Artificial Sequence
  Synthetic polynucleotide encoding artificial human antibody CDR-L2 region
gctgcatcc

SEQ ID NO: 3748 - DNA, 9 bp, Artificial Sequence
  Synthetic polynucleotide encoding artificial human antibody CDR-L2 region
ggtgaggac

SEQ ID NO: 3749 - DNA, 9 bp, Artificial Sequence
  Synthetic polynucleotide encoding artificial human antibody CDR-L2 region
tgggcatct

SEQ ID NO: 3750 - DNA, 9 bp, Artificial Sequence
  Synthetic polynucleotide encoding artificial human antibody CDR-L2 region
aaggtttct

SEQ ID NO: 3751 - DNA, 9 bp, Artificial Sequence
  Synthetic polynucleotide encoding artificial human antibody CDR-L2 region
gaagacagt

SEQ ID NO: 3752 - DNA, 9 bp, Artificial Sequence
  Synthetic polynucleotide encoding artificial human antibody CDR-L2 region
gatgatagc

SEQ ID NO: 3753 - DNA, 9 bp, Artificial Sequence
  Synthetic polynucleotide encoding artificial human antibody CDR-L2 region
gctgcttcc

SEQ ID NO: 3754 - DNA, 9 bp, Artificial Sequence
  Synthetic polynucleotide encoding artificial human antibody CDR-L2 region
gatgcttcc

SEQ ID NO: 3755 - DNA, 9 bp, Artificial Sequence
  Synthetic polynucleotide encoding artificial human antibody CDR-L2 region
tgggcatct

SEQ ID NO: 3756 - DNA, 9 bp, Artificial Sequence
  Synthetic polynucleotide encoding artificial human antibody CDR-L2 region
aaagacacg

SEQ ID NO: 3757 - DNA, 9 bp, Artificial Sequence
  Synthetic polynucleotide encoding artificial human antibody CDR-L2 region
cgggcatct

SEQ ID NO: 3758 - DNA, 9 bp, Artificial Sequence
  Synthetic polynucleotide encoding artificial human antibody CDR-L2 region
tgggcatct

SEQ ID NO: 3759 - DNA, 9 bp, Artificial Sequence
  Synthetic polynucleotide encoding artificial human antibody CDR-L2 region
caggatacc

SEQ ID NO: 3760 - DNA, 9 bp, Artificial Sequence
  Synthetic polynucleotide encoding artificial human antibody CDR-L2 region
tctaatact

SEQ ID NO: 3761 - DNA, 9 bp, Artificial Sequence
  Synthetic polynucleotide encoding artificial human antibody CDR-L2 region
gacactgat

SEQ ID NO: 3762 - DNA, 9 bp, Artificial Sequence
  Synthetic polynucleotide encoding artificial human antibody CDR-L2 region
aaggcgtct

SEQ ID NO: 3763 - DNA, 9 bp, Artificial Sequence
  Synthetic polynucleotide encoding artificial human antibody CDR-L2 region
tgggcatct

SEQ ID NO: 3764 - DNA, 9 bp, Artificial Sequence
  Synthetic polynucleotide encoding artificial human antibody CDR-L2 region
tgggcatct

SEQ ID NO: 3765 - DNA, 9 bp, Artificial Sequence
  Synthetic polynucleotide encoding artificial human antibody CDR-L2 region
gaggtcaat

SEQ ID NO: 3766 - DNA, 9 bp, Artificial Sequence
  Synthetic polynucleotide encoding artificial human antibody CDR-L2 region
aaggtttct

SEQ ID NO: 3767 - DNA, 9 bp, Artificial Sequence
  Synthetic polynucleotide encoding artificial human antibody CDR-L2 region
caagatagc

SEQ ID NO: 3768 - DNA, 9 bp, Artificial Sequence
  Synthetic polynucleotide encoding artificial human antibody CDR-L2 region
ggtgcatcc

SEQ ID NO: 3769 - DNA, 9 bp, Artificial Sequence
  Synthetic polynucleotide encoding artificial human antibody CDR-L2 region
aaagataac

SEQ ID NO: 3770 - DNA, 9 bp, Artificial Sequence
  Synthetic polynucleotide encoding artificial human antibody CDR-L2 region
ttgggttct

SEQ ID NO: 3771 - DNA, 9 bp, Artificial Sequence
  Synthetic polynucleotide encoding artificial human antibody CDR-L2 region
gacaataat

SEQ ID NO: 3772 - DNA, 9 bp, Artificial Sequence
  Synthetic polynucleotide encoding artificial human antibody CDR-L2 region
aaggcgtct

SEQ ID NO: 3773 - DNA, 9 bp, Artificial Sequence
  Synthetic polynucleotide encoding artificial human antibody CDR-L2 region
aaggcgtct

SEQ ID NO: 3774 - DNA, 9 bp, Artificial Sequence
  Synthetic polynucleotide encoding artificial human antibody CDR-L2 region
ggtaacagc

SEQ ID NO: 3775 - DNA, 9 bp, Artificial Sequence
  Synthetic polynucleotide encoding artificial human antibody CDR-L2 region
aaagacagt

SEQ ID NO: 3776 - DNA, 9 bp, Artificial Sequence
  Synthetic polynucleotide encoding artificial human antibody CDR-L2 region
tctgcttcc

SEQ ID NO: 3777 - DNA, 9 bp, Artificial Sequence
  Synthetic polynucleotide encoding artificial human antibody CDR-L2 region
ggtgcatcc

SEQ ID NO: 3778 - DNA, 9 bp, Artificial Sequence
  Synthetic polynucleotide encoding artificial human antibody CDR-L2 region
gctgcatcc

SEQ ID NO: 3779 - DNA, 9 bp, Artificial Sequence
  Synthetic polynucleotide encoding artificial human antibody CDR-L2 region
gctgcatcc

SEQ ID NO: 3780 - DNA, 9 bp, Artificial Sequence
  Synthetic polynucleotide encoding artificial human antibody CDR-L2 region
ggtgcatcc

SEQ ID NO: 3781 - DNA, 9 bp, Artificial Sequence
  Synthetic polynucleotide encoding artificial human antibody CDR-L2 region
tatgataga

SEQ ID NO: 3782 - DNA, 9 bp, Artificial Sequence
  Synthetic polynucleotide encoding artificial human antibody CDR-L2 region
gaggataaa

SEQ ID NO: 3783 - DNA, 9 bp, Artificial Sequence
  Synthetic polynucleotide encoding artificial human antibody CDR-L2 region
ttgggttct

SEQ ID NO: 3784 - DNA, 9 bp, Artificial Sequence
  Synthetic polynucleotide encoding artificial human antibody CDR-L2 region
aaggcgtct

SEQ ID NO: 3785 - DNA, 9 bp, Artificial Sequence
  Synthetic polynucleotide encoding artificial human antibody CDR-L2 region
tcgggatct

SEQ ID NO: 3786 - DNA, 9 bp, Artificial Sequence
  Synthetic polynucleotide encoding artificial human antibody CDR-L2 region
gctgcatcc

SEQ ID NO: 3787 - DNA, 9 bp, Artificial Sequence
  Synthetic polynucleotide encoding artificial human antibody CDR-L2 region
tgggcatct

SEQ ID NO: 3788 - DNA, 9 bp, Artificial Sequence
  Synthetic polynucleotide encoding artificial human antibody CDR-L2 region
aggaataat

SEQ ID NO: 3789 - DNA, 9 bp, Artificial Sequence
  Synthetic polynucleotide encoding artificial human antibody CDR-L2 region
gaggtcagt

SEQ ID NO: 3790 - DNA, 9 bp, Artificial Sequence
  Synthetic polynucleotide encoding artificial human antibody CDR-L2 region
ggtaacggc

SEQ ID NO: 3791 - DNA, 21 bp, Artificial Sequence
  Synthetic polynucleotide encoding artificial human antibody CDR-L2 region
cagtactcagactcagataag

SEQ ID NO: 3792 - DNA, 9 bp, Artificial Sequence
  Synthetic polynucleotide encoding artificial human antibody CDR-L2 region
ttgggttct

SEQ ID NO: 3793 - DNA, 9 bp, Artificial Sequence
  Synthetic polynucleotide encoding artificial human antibody CDR-L2 region
gctgcatcc

SEQ ID NO: 3794 - DNA, 9 bp, Artificial Sequence
  Synthetic polynucleotide encoding artificial human antibody CDR-L2 region
gaagtttcc

SEQ ID NO: 3795 - DNA, 42 bp, Artificial Sequence
  Synthetic polynucleotide encoding artificial human antibody CDR-H3 region
gcgagggttacccttgggagttacttttacggcatggacgtc

SEQ ID NO: 3796 - DNA, 45 bp, Artificial Sequence
  Synthetic polynucleotide encoding artificial human antibody CDR-H3 region
gcgagagatgggggatcagggagttacttcgactgctttgactac

SEQ ID NO: 3797 - DNA, 54 bp, Artificial Sequence
  Synthetic polynucleotide encoding artificial human antibody CDR-H3 region
gcaaaagatataaacttttttgggttagggacagggggaggtgctatggacgtc

SEQ ID NO: 3798 - DNA, 33 bp, Artificial Sequence
  Synthetic polynucleotide encoding artificial human antibody CDR-H3 region
gcacacagagcaatagtaggactctttgactac

SEQ ID NO: 3799 - DNA, 42 bp, Artificial Sequence
  Synthetic polynucleotide encoding artificial human antibody CDR-H3 region
gcgcgaggaggggatgggggaccccaagatgcttttgatatc

SEQ ID NO: 3800 - DNA, 51 bp, Artificial Sequence
  Synthetic polynucleotide encoding artificial human antibody CDR-H3 region
gtgaagtcattttcggctgaatattactactattactacggtatggacgtc

SEQ ID NO: 3801 - DNA, 45 bp, Artificial Sequence
  Synthetic polynucleotide encoding artificial human antibody CDR-H3 region
gcgagagttgttccaggtgactccgtctatggtgcttttgatatc

SEQ ID NO: 3802 - DNA, 39 bp, Artificial Sequence
  Synthetic polynucleotide encoding artificial human antibody CDR-H3 region
gcaaagcggaccccgttcggggagtgggcatttgactac

SEQ ID NO: 3803 - DNA, 51 bp, Artificial Sequence
  Synthetic polynucleotide encoding artificial human antibody CDR-H3 region
gcgaaagatccggggacctttagggaccatctttggagtggtgttgactac

SEQ ID NO: 3804 - DNA, 48 bp, Artificial Sequence
  Synthetic polynucleotide encoding artificial human antibody CDR-H3 region
gcaaaagcggcggctacactcccctacttccgcttcgctatggacgtc

SEQ ID NO: 3805 - DNA, 51 bp, Artificial Sequence
  Synthetic polynucleotide encoding artificial human antibody CDR-H3 region
gcgagagtgggagtctttaagggcctggctcctttcggggggttcgacccc

SEQ ID NO: 3806 - DNA, 33 bp, Artificial Sequence
  Synthetic polynucleotide encoding artificial human antibody CDR-H3 region
gcgagagacagtggtggcactccggggccctac

SEQ ID NO: 3807 - DNA, 48 bp, Artificial Sequence
  Synthetic polynucleotide encoding artificial human antibody CDR-H3 region
gtgaggtcgttcgtcggcgcagttcccgcttatcccaactttgacttc

SEQ ID NO: 3808 - DNA, 33 bp, Artificial Sequence
  Synthetic polynucleotide encoding artificial human antibody CDR-H3 region
gtaagaggggtagtgggggctactctcgacaac

SEQ ID NO: 3809 - DNA, 51 bp, Artificial Sequence
  Synthetic polynucleotide encoding artificial human antibody CDR-H3 region
gtgaaagattcccgggttacggggcaaagcagtggttatatctttgactct

SEQ ID NO: 3810 - DNA, 33 bp, Artificial Sequence
  Synthetic polynucleotide encoding artificial human antibody CDR-H3 region
gcgagaccccgtttaggctggtacttcgatctc

SEQ ID NO: 3811 - DNA, 39 bp, Artificial Sequence
  Synthetic polynucleotide encoding artificial human antibody CDR-H3 region
gcgagagaaaccgccgggcagctcatcccctttgactac

SEQ ID NO: 3812 - DNA, 51 bp, Artificial Sequence
  Synthetic polynucleotide encoding artificial human antibody CDR-H3 region
gcgagagattatatgggtgtggatttctactactactacggtatggacgtc

SEQ ID NO: 3813 - DNA, 42 bp, Artificial Sequence
  Synthetic polynucleotide encoding artificial human antibody CDR-H3 region
gcgagagatatagcagtggctattactaactactttggctcc

SEQ ID NO: 3814 - DNA, 33 bp, Artificial Sequence
  Synthetic polynucleotide encoding artificial human antibody CDR-H3 region
gcgagagaacatcgtagtgggtatcagcgatac

SEQ ID NO: 3815 - DNA, 33 bp, Artificial Sequence
  Synthetic polynucleotide encoding artificial human antibody CDR-H3 region
gcacacttctctacggtgattaactttggccac

SEQ ID NO: 3816 - DNA, 33 bp, Artificial Sequence
  Synthetic polynucleotide encoding artificial human antibody CDR-H3 region
gcgtgccgacggatatatcaggggttcgacccc

SEQ ID NO: 3817 - DNA, 30 bp, Artificial Sequence
  Synthetic polynucleotide encoding artificial human antibody CDR-H3 region
gcgagagatcgagctacctcgtttgattac

SEQ ID NO: 3818 - DNA, 27 bp, Artificial Sequence
  Synthetic polynucleotide encoding artificial human antibody CDR-H3 region
gcgagaggtcggggggaaatggacgtc

SEQ ID NO: 3819 - DNA, 42 bp, Artificial Sequence
  Synthetic polynucleotide encoding artificial human antibody CDR-H3 region
gcgactacccctagcagcagctggtactggtacttcgacccc

SEQ ID NO: 3820 - DNA, 48 bp, Artificial Sequence
  Synthetic polynucleotide encoding artificial human antibody CDR-H3 region
gcgagagatcttgaacttattattgcagcaggtgctccccttgaccac

SEQ ID NO: 3821 - DNA, 48 bp, Artificial Sequence
  Synthetic polynucleotide encoding artificial human antibody CDR-H3 region
gcgagactggtaacatcacctgaagaagggggtccctggttcgacccc

SEQ ID NO: 3822 - DNA, 36 bp, Artificial Sequence
  Synthetic polynucleotide encoding artificial human antibody CDR-H3 region
gcgagagatacggaagtggggcatcactttgactac

SEQ ID NO: 3823 - DNA, 33 bp, Artificial Sequence
  Synthetic polynucleotide encoding artificial human antibody CDR-H3 region
gcgaagccctggagaagtgatggttttgatgtc

SEQ ID NO: 3824 - DNA, 33 bp, Artificial Sequence
  Synthetic polynucleotide encoding artificial human antibody CDR-H3 region
gcagtgggcatggttacagatggttttgaaatc

SEQ ID NO: 3825 - DNA, 36 bp, Artificial Sequence
  Synthetic polynucleotide encoding artificial human antibody CDR-H3 region
gccaggctggatttgcggaccgtgaggttcgacccc

SEQ ID NO: 3826 - DNA, 42 bp, Artificial Sequence
  Synthetic polynucleotide encoding artificial human antibody CDR-H3 region
gcgagacatagcagtggccccccccggctcgcttttgatatc

SEQ ID NO: 3827 - DNA, 39 bp, Artificial Sequence
  Synthetic polynucleotide encoding artificial human antibody CDR-H3 region
gcgaaagatttcgctatgcctacagtaactacggactac

SEQ ID NO: 3828 - DNA, 39 bp, Artificial Sequence
  Synthetic polynucleotide encoding artificial human antibody CDR-H3 region
gtacacagaccatccctggcctattggtacttcgatgtc

SEQ ID NO: 3829 - DNA, 42 bp, Artificial Sequence
  Synthetic polynucleotide encoding artificial human antibody CDR-H3 region
gtgagagagggtgattcacggaaatattatagtcttgactat

SEQ ID NO: 3830 - DNA, 39 bp, Artificial Sequence
  Synthetic polynucleotide encoding artificial human antibody CDR-H3 region
gcgagagatccaatgtgggtctcttatgcttttgatatc

SEQ ID NO: 3831 - DNA, 27 bp, Artificial Sequence
  Synthetic polynucleotide encoding artificial human antibody CDR-H3 region
gcgagtggttatgtttctttcgatctc

SEQ ID NO: 3832 - DNA, 48 bp, Artificial Sequence
  Synthetic polynucleotide encoding artificial human antibody CDR-H3 region
gcgagagagggggcctatgagagtagtggacctgatccttttgatatc

SEQ ID NO: 3833 - DNA, 45 bp, Artificial Sequence
  Synthetic polynucleotide encoding artificial human antibody CDR-H3 region
gcgagcctctttctaacatactatggttcggggacttattatcgc

SEQ ID NO: 3834 - DNA, 33 bp, Artificial Sequence
  Synthetic polynucleotide encoding artificial human antibody CDR-H3 region
gcgaaatcgaccctcggtggtggttttgacttc

SEQ ID NO: 3835 - DNA, 54 bp, Artificial Sequence
  Synthetic polynucleotide encoding artificial human antibody CDR-H3 region
gcgagagttggtagcagcagctggtacagctccgggcgatccccttttgactac

SEQ ID NO: 3836 - DNA, 48 bp, Artificial Sequence
  Synthetic polynucleotide encoding artificial human antibody CDR-H3 region
gcgaaagatcaaatcgtcctagagatggctacaagcccctttgactac

SEQ ID NO: 3837 - DNA, 51 bp, Artificial Sequence
  Synthetic polynucleotide encoding artificial human antibody CDR-H3 region
gcgagagatctcagttgtagtagtaccagctgccatgatgcttttgatatc

SEQ ID NO: 3838 - DNA, 48 bp, Artificial Sequence
  Synthetic polynucleotide encoding artificial human antibody CDR-H3 region
gcgagaggacccaatttccatgagagtatacgtgatggctttgatatc

SEQ ID NO: 3839 - DNA, 36 bp, Artificial Sequence
  Synthetic polynucleotide encoding artificial human antibody CDR-H3 region
gcaagagttaactggaattccgatacctttgactcc

SEQ ID NO: 3840 - DNA, 60 bp, Artificial Sequence
  Synthetic polynucleotide encoding artificial human antibody CDR-H3 region
gcgagagatccggggagagatccgtatttggacttggactatcactacggcatggacgtc

SEQ ID NO: 3841 - DNA, 48 bp, Artificial Sequence
  Synthetic polynucleotide encoding artificial human antibody CDR-H3 region
gcgagagataagaggagcggtatgacttccgacagacgaattgactac

SEQ ID NO: 3842 - DNA, 36 bp, Artificial Sequence
  Synthetic polynucleotide encoding artificial human antibody CDR-H3 region
tcggggggctattactcctcctcccacatggacgtc

SEQ ID NO: 3843 - DNA, 39 bp, Artificial Sequence
  Synthetic polynucleotide encoding artificial human antibody CDR-H3 region
gcgagagtgaatatagcagcagctggtactcttgactac

SEQ ID NO: 3844 - DNA, 63 bp, Artificial Sequence
  Synthetic polynucleotide encoding artificial human antibody CDR-H3 region
gtaaaagatatggggcctgctggaactgcttcggcttatcactaccacaatggaatggacgtc

SEQ ID NO: 3845 - DNA, 36 bp, Artificial Sequence
  Synthetic polynucleotide encoding artificial human antibody CDR-H3 region
gcgagactaactactagtaccagcgcgctgagctac

SEQ ID NO: 3846 - DNA, 48 bp, Artificial Sequence
  Synthetic polynucleotide encoding artificial human antibody CDR-H3 region
gcgagagagaactggaactccgctggaactacggagtggttcgacccc

SEQ ID NO: 3847 - DNA, 30 bp, Artificial Sequence
  Synthetic polynucleotide encoding artificial human antibody CDR-H3 region
gcgagagatactctacaaaagggggactac

SEQ ID NO: 3848 - DNA, 57 bp, Artificial Sequence
  Synthetic polynucleotide encoding artificial human antibody CDR-H3 region
gcgagagcctcccgcgttctagaaagtaagagctggcacggggatgcttttgatgtc

SEQ ID NO: 3849 - DNA, 39 bp, Artificial Sequence
  Synthetic polynucleotide encoding artificial human antibody CDR-H3 region
gcgaggggtcttggcggtagtggttattattttgactac

SEQ ID NO: 3850 - DNA, 51 bp, Artificial Sequence
  Synthetic polynucleotide encoding artificial human antibody CDR-H3 region
gcgagacaggcattttgtggtgctaattgctggtcgggcgcttatgatatc

SEQ ID NO: 3851 - DNA, 57 bp, Artificial Sequence
  Synthetic polynucleotide encoding artificial human antibody CDR-H3 region
gtgagaaggggggcgactgtatttcagggaaagataattaaaggctacatggacgtc

SEQ ID NO: 3852 - DNA, 30 bp, Artificial Sequence
  Synthetic polynucleotide encoding artificial human antibody CDR-H3 region
gcgaaagtgaagggggggtccaatgactac

SEQ ID NO: 3853 - DNA, 39 bp, Artificial Sequence
  Synthetic polynucleotide encoding artificial human antibody CDR-H3 region
gcgagacacctctacggtgacttttactacttagactac

SEQ ID NO: 3854 - DNA, 39 bp, Artificial Sequence
  Synthetic polynucleotide encoding artificial human antibody CDR-H3 region
gcgagagaccatcgtacggggagttattatcccgactac

SEQ ID NO: 3855 - DNA, 45 bp, Artificial Sequence
  Synthetic polynucleotide encoding artificial human antibody CDR-H3 region
gcgagaggggtgaggcagcagcaggttcggaagtggttcgacccc

SEQ ID NO: 3856 - DNA, 36 bp, Artificial Sequence
  Synthetic polynucleotide encoding artificial human antibody CDR-H3 region
gcgatggataattcggggagcgggggcgttgactac

SEQ ID NO: 3857 - DNA, 36 bp, Artificial Sequence
  Synthetic polynucleotide encoding artificial human antibody CDR-H3 region
gcgagagatagttatcactactacggtatggacgtc

SEQ ID NO: 3858 - DNA, 48 bp, Artificial Sequence
  Synthetic polynucleotide encoding artificial human antibody CDR-H3 region
gcaagagagaccgtttacatctctacttactactacggtttggacgtc

SEQ ID NO: 3859 - DNA, 39 bp, Artificial Sequence
  Synthetic polynucleotide encoding artificial human antibody CDR-H3 region
gcaacagatgggcccttacatacgtcgggacttgactac

SEQ ID NO: 3860 - DNA, 39 bp, Artificial Sequence
  Synthetic polynucleotide encoding artificial human antibody CDR-H3 region
gcgtgcttgggggctgaggcgaacgatgcttttgatatc

SEQ ID NO: 3861 - DNA, 21 bp, Artificial Sequence
  Synthetic polynucleotide encoding artificial human antibody CDR-H3 region
gcgaaagtccctggggactac

SEQ ID NO: 3862 - DNA, 45 bp, Artificial Sequence
  Synthetic polynucleotide encoding artificial human antibody CDR-H3 region
gcgagagcgggccttagtaccagttggccgagctggttcgacccc

SEQ ID NO: 3863 - DNA, 42 bp, Artificial Sequence
  Synthetic polynucleotide encoding artificial human antibody CDR-H3 region
gcgagaaacgatatttccttcaaacagagtgctatcgacgtc

SEQ ID NO: 3864 - DNA, 51 bp, Artificial Sequence
  Synthetic polynucleotide encoding artificial human antibody CDR-H3 region
gcgaaaacgaagactatgggtgtggggggagagtatttcggcttggacgtc

SEQ ID NO: 3865 - DNA, 48 bp, Artificial Sequence
  Synthetic polynucleotide encoding artificial human antibody CDR-H3 region
gcgagacacaaggccctctggttcggggaggcaggggcttttgatatc

SEQ ID NO: 3866 - DNA, 54 bp, Artificial Sequence
  Synthetic polynucleotide encoding artificial human antibody CDR-H3 region
gcaaaagatttgttagggttcagggaccaaaggaactactacggtatggacgtc

SEQ ID NO: 3867 - DNA, 39 bp, Artificial Sequence
  Synthetic polynucleotide encoding artificial human antibody CDR-H3 region
gcgagaagcttctacgacacccttttctactttgagaac

SEQ ID NO: 3868 - DNA, 36 bp, Artificial Sequence
  Synthetic polynucleotide encoding artificial human antibody CDR-H3 region
gcacgcgtttatagtaccaagtgggactttgactac

SEQ ID NO: 3869 - DNA, 33 bp, Artificial Sequence
  Synthetic polynucleotide encoding artificial human antibody CDR-H3 region
gcgaaagggggccctttacgtccttttgatatc

SEQ ID NO: 3870 - DNA, 45 bp, Artificial Sequence
  Synthetic polynucleotide encoding artificial human antibody CDR-H3 region
gcgagacttagtagagacggctacaccattgagcactttgactac

SEQ ID NO: 3871 - DNA, 57 bp, Artificial Sequence
  Synthetic polynucleotide encoding artificial human antibody CDR-H3 region
gcgagacgcggggttagtggtgggagcgcctggacgtattacaactttttcgacccc

SEQ ID NO: 3872 - DNA, 42 bp, Artificial Sequence
  Synthetic polynucleotide encoding artificial human antibody CDR-H3 region
gcgagagaacttcccgtgattggtagacgtacttttgatatc

SEQ ID NO: 3873 - DNA, 66 bp, Artificial Sequence
  Synthetic polynucleotide encoding artificial human antibody CDR-H3 region
gcgagagattccgaggtggaaaagagtgatgggtacatggcctcgaccgctgaatacttccaactc

SEQ ID NO: 3874 - DNA, 45 bp, Artificial Sequence
  Synthetic polynucleotide encoding artificial human antibody CDR-H3 region
gtaaaagcaggtgtcccgtgggaggtccagcgatggttcgacccc

SEQ ID NO: 3875 - DNA, 36 bp, Artificial Sequence
  Synthetic polynucleotide encoding artificial human antibody CDR-H3 region
gcgagagatcgtcagggcctaggccgtatggacgtc

SEQ ID NO: 3876 - DNA, 36 bp, Artificial Sequence
  Synthetic polynucleotide encoding artificial human antibody CDR-H3 region
gcgagggaactgggtgcgaactactactttgcctat

SEQ ID NO: 3877 - DNA, 45 bp, Artificial Sequence
  Synthetic polynucleotide encoding artificial human antibody CDR-H3 region
gcgagggaagtcgatatacgtggagacagcgatgcttttgatatt

SEQ ID NO: 3878 - DNA, 30 bp, Artificial Sequence
  Synthetic polynucleotide encoding artificial human antibody CDR-H3 region
gcgactacccgaaactcagctttcctcaac

SEQ ID NO: 3879 - DNA, 42 bp, Artificial Sequence
  Synthetic polynucleotide encoding artificial human antibody CDR-H3 region
gcgaagtccgcatttgggggagttcctgatggttttgatatc

SEQ ID NO: 3880 - DNA, 21 bp, Artificial Sequence
  Synthetic polynucleotide encoding artificial human antibody CDR-H3 region
gcgagagatgggtttgactac

SEQ ID NO: 3881 - DNA, 39 bp, Artificial Sequence
  Synthetic polynucleotide encoding artificial human antibody CDR-H3 region
gcaaaagcgggatacagctttactaccgctcctgactac

SEQ ID NO: 3882 - DNA, 42 bp, Artificial Sequence
  Synthetic polynucleotide encoding artificial human antibody CDR-H3 region
gcgcgagagagaggccaggtccgttcctacggcatggacgtc

SEQ ID NO: 3883 - DNA, 57 bp, Artificial Sequence
  Synthetic polynucleotide encoding artificial human antibody CDR-H3 region
gtaaaaattggcggggatgggacagcctacgcttggacctttaggcactttgactcc

SEQ ID NO: 3884 - DNA, 39 bp, Artificial Sequence
  Synthetic polynucleotide encoding artificial human antibody CDR-H3 region
gcgagagggttgggtggagattggaactaccttgcctac

SEQ ID NO: 3885 - DNA, 63 bp, Artificial Sequence
  Synthetic polynucleotide encoding artificial human antibody CDR-H3 region
gcgaaagaaggtggatgggggaatacagtaactacgtcctactactactacggtatggatgtc

SEQ ID NO: 3886 - DNA, 42 bp, Artificial Sequence
  Synthetic polynucleotide encoding artificial human antibody CDR-H3 region
acgagggatgggggatacttcgcaactggcgagtttgactac

SEQ ID NO: 3887 - DNA, 36 bp, Artificial Sequence
  Synthetic polynucleotide encoding artificial human antibody CDR-H3 region
gcgagagagcgctttggccaaggtgcccttgactac

SEQ ID NO: 3888 - DNA, 45 bp, Artificial Sequence
  Synthetic polynucleotide encoding artificial human antibody CDR-H3 region
gcgaccatcgtcgctgcctacagctatggtttcgagttcgacccc

SEQ ID NO: 3889 - DNA, 63 bp, Artificial Sequence; identical to SEQ ID NO: 3885
  Synthetic polynucleotide encoding artificial human antibody CDR-H3 region

SEQ ID NO: 3890 - DNA, 45 bp, Artificial Sequence
  Synthetic polynucleotide encoding artificial human antibody CDR-H3 region
gcgcgacagggatttgaggctctggttattcgaggctttgactac

SEQ ID NO: 3891 - DNA, 45 bp, Artificial Sequence
  Synthetic polynucleotide encoding artificial human antibody CDR-H3 region
gcgaggagatctaccagtagcccctctttcagcactctggacgtc

SEQ ID NO: 3892 - DNA, 30 bp, Artificial Sequence
  Synthetic polynucleotide encoding artificial human antibody CDR-H3 region
gcgagacaaatggtgactacgaggggctac

SEQ ID NO: 3893 - DNA, 48 bp, Artificial Sequence
  Synthetic polynucleotide encoding artificial human antibody CDR-H3 region
gcgagagtcccatctcgctatggccgttccaggggcgcttttgatatc

SEQ ID NO: 3894 - DNA, 36 bp, Artificial Sequence
  Synthetic polynucleotide encoding artificial human antibody CDR-H3 region
gcgagaaatctttatcgtctgggctggttcgacccc

SEQ ID NO: 3895 - DNA, 39 bp, Artificial Sequence
  Synthetic polynucleotide encoding artificial human antibody CDR-H3 region
gcgaaatcgaaaggtaactaccgggacgctatggacgtc

SEQ ID NO: 3896 - DNA, 42 bp, Artificial Sequence
  Synthetic polynucleotide encoding artificial human antibody CDR-H3 region
gcgacctcatatacagtaacgactttctacggtatggacgtc

SEQ ID NO: 3897 - DNA, 36 bp, Artificial Sequence
  Synthetic polynucleotide encoding artificial human antibody CDR-H3 region
gccagaggggcggccttctactacggtatggacgtc

SEQ ID NO: 3898 - DNA, 45 bp, Artificial Sequence
  Synthetic polynucleotide encoding artificial human antibody CDR-H3 region
gcgagagatacctacggtgacccgaggggtgactactttgactac

SEQ ID NO: 3899 - DNA, 51 bp, Artificial Sequence
  Synthetic polynucleotide encoding artificial human antibody CDR-H3 region
gcgagactgtggggtagcggtgactggtggccctccctgtattttgactcc

SEQ ID NO: 3900 - DNA, 39 bp, Artificial Sequence
  Synthetic polynucleotide encoding artificial human antibody CDR-H3 region
gcgagaatccggcgtatagcagcaactagttttgactac

SEQ ID NO: 3901 - DNA, 48 bp, Artificial Sequence
  Synthetic polynucleotide encoding artificial human antibody CDR-H3 region
gcaaaaatagcacgtcgtcctcccagtttttacgactacatggacgtc

SEQ ID NO: 3902 - DNA, 48 bp, Artificial Sequence
  Synthetic polynucleotide encoding artificial human antibody CDR-H3 region
gcgaggtcgacaagtagttccacctccgacttccactacatggacgta

SEQ ID NO: 3903 - DNA, 30 bp, Artificial Sequence
  Synthetic polynucleotide encoding artificial human antibody CDR-H3 region
acaagaggatgggcattcaccagctccgac

SEQ ID NO: 3904 - DNA, 24 bp, Artificial Sequence
  Synthetic polynucleotide encoding artificial human antibody CDR-H3 region
gcaggaggatgggcccttggctac

SEQ ID NO: 3905 - DNA, 30 bp, Artificial Sequence
  Synthetic polynucleotide encoding artificial human antibody CDR-H3 region
gcgagacaccgaattttcggtttggacgtc

SEQ ID NO: 3906 - DNA, 57 bp, Artificial Sequence
  Synthetic polynucleotide encoding artificial human antibody CDR-H3 region
gcgagacgcggaccgaccgatacatggtcaggggaagttggctactactttgactac

SEQ ID NO: 3907 - DNA, 48 bp, Artificial Sequence
  Synthetic polynucleotide encoding artificial human antibody CDR-H3 region
gcgagagatggaaaaacattagggtacggtggtaactccgttgactac

SEQ ID NO: 3908 - DNA, 45 bp, Artificial Sequence
  Synthetic polynucleotide encoding artificial human antibody CDR-H3 region
gctcggacagaaactaaatgggaggacagggggctttgggactac

SEQ ID NO: 3909 - DNA, 30 bp, Artificial Sequence
  Synthetic polynucleotide encoding artificial human antibody CDR-H3 region
gcgagatcgttttatggttcaggtttgcag

SEQ ID NO: 3910 - DNA, 39 bp, Artificial Sequence
  Synthetic polynucleotide encoding artificial human antibody CDR-H3 region
gcgagggccatgggtggctacacttactaccttgacgac

SEQ ID NO: 3911 - DNA, 51 bp, Artificial Sequence
  Synthetic polynucleotide encoding artificial human antibody CDR-H3 region
gcgagggcggggaaagacggctacaattttttctactacggtatggacgtc

SEQ ID NO: 3912 - DNA, 45 bp, Artificial Sequence
  Synthetic polynucleotide encoding artificial human antibody CDR-H3 region
gcgagagggatcatgactacagcaatttcctactactttgactac

SEQ ID NO: 3913 - DNA, 54 bp, Artificial Sequence
  Synthetic polynucleotide encoding artificial human antibody CDR-H3 region
gcgaaaggagaaagggacctgacagactacggtgaccccgaatatttccagcac

SEQ ID NO: 3914 - DNA, 54 bp, Artificial Sequence
  Synthetic polynucleotide encoding artificial human antibody CDR-H3 region
gcgaaagatctgcgatattgtagcgctcgtagtagttgttttggcattgacttc

SEQ ID NO: 3915 - DNA, 27 bp, Artificial Sequence
  Synthetic polynucleotide encoding artificial human antibody CDR-H3 region
gcgagaagagcatacagctttgactac

SEQ ID NO: 3916 - DNA, 54 bp, Artificial Sequence
  Synthetic polynucleotide encoding artificial human antibody CDR-H3 region
gcaagagagggggccccagatgactacggtgactccgggactgcttttgatatt

SEQ ID NO: 3917 - DNA, 36 bp, Artificial Sequence
  Synthetic polynucleotide encoding artificial human antibody CDR-H3 region
accaccgatcacccctatggtgactactctgacaac

SEQ ID NO: 3918 - DNA, 30 bp, Artificial Sequence
  Synthetic polynucleotide encoding artificial human antibody CDR-H3 region
gcgaaggaattattagggggttttgactat

SEQ ID NO: 3919 - DNA, 39 bp, Artificial Sequence
  Synthetic polynucleotide encoding artificial human antibody CDR-H3 region
gcgagagtttttggatcagcagctggtgcttttgatatc

SEQ ID NO: 3920 - DNA, 36 bp, Artificial Sequence
  Synthetic polynucleotide encoding artificial human antibody CDR-H3 region
gcgagacacgattggcgcttatacgcatttgactac

SEQ ID NO: 3921 - DNA, 27 bp, Artificial Sequence
  Synthetic polynucleotide encoding artificial human antibody CDR-H3 region
gcaggaggggaaaccagtcctgactac

SEQ ID NO: 3922 - DNA, 45 bp, Artificial Sequence
  Synthetic polynucleotide encoding artificial human antibody CDR-H3 region
gtgagtagggggcccctagggggagcagcagctggaccggactac

SEQ ID NO: 3923 - DNA, 30 bp, Artificial Sequence
  Synthetic polynucleotide encoding artificial human antibody CDR-H3 region
gcgcgagatgtccgagggtggttcgtcccc

SEQ ID NO: 3924 - DNA, 57 bp, Artificial Sequence
  Synthetic polynucleotide encoding artificial human antibody CDR-H3 region
gtgagagatcgcaacattgtatctgtgccaggtgctatcccctacggaatggacgtc

SEQ ID NO: 3925 - DNA, 27 bp, Artificial Sequence
  Synthetic polynucleotide encoding artificial human antibody CDR-H3 region
gcaagagggagtgacacccttgactac

SEQ ID NO: 3926 - DNA, 36 bp, Artificial Sequence
  Synthetic polynucleotide encoding artificial human antibody CDR-H3 region
gccagagtggggctaacttttgccttgttcgacccc

SEQ ID NO: 3927 - DNA, 51 bp, Artificial Sequence
  Synthetic polynucleotide encoding artificial human antibody CDR-H3 region
gcgaacagtgcggggatacagctatggtcctcagacaactggttcgacccc

SEQ ID NO: 3928 - DNA, 30 bp, Artificial Sequence
  Synthetic polynucleotide encoding artificial human antibody CDR-H3 region
gcgaaagagggcatagaactcatgatcctc

SEQ ID NO: 3929 - DNA, 42 bp, Artificial Sequence
  Synthetic polynucleotide encoding artificial human antibody CDR-H3 region
gcgagaggcattaccctgactcggggagtctcctttgactac

SEQ ID NO: 3930 - DNA, 27 bp, Artificial Sequence
  Synthetic polynucleotide encoding artificial human antibody CDR-H3 region
gccagagatgggggagcttttgatatc

SEQ ID NO: 3931 - DNA, 48 bp, Artificial Sequence
  Synthetic polynucleotide encoding artificial human antibody CDR-H3 region
gcgagagatcggcttttcacagctattaacagtgggtactttgactac

SEQ ID NO: 3932 - DNA, 33 bp, Artificial Sequence
  Synthetic polynucleotide encoding artificial human antibody CDR-H3 region
gcgagagaggggagctactacgggattggctac

SEQ ID NO: 3933 - DNA, 42 bp, Artificial Sequence
  Synthetic polynucleotide encoding artificial human antibody CDR-H3 region
gcgagagatacggacagtggctggttggattcgtttgactac

SEQ ID NO: 3934 - DNA, 63 bp, Artificial Sequence
  Synthetic polynucleotide encoding artificial human antibody CDR-H3 region
gcgacagatcaggggtgtgatgatggcagctgctatgtaggccactactacggaatggacgtc

SEQ ID NO: 3935 - DNA, 30 bp, Artificial Sequence
  Synthetic polynucleotide encoding artificial human antibody CDR-H3 region
gggaggattatgactccctcgattgacctc

SEQ ID NO: 3936 - DNA, 39 bp, Artificial Sequence
  Synthetic polynucleotide encoding artificial human antibody CDR-H3 region
gcgagagaaggacgggggggaggagacttctttgactac

SEQ ID NO: 3937 - DNA, 45 bp, Artificial Sequence
  Synthetic polynucleotide encoding artificial human antibody CDR-H3 region
gcaaaagatggggacagtttgggggatttctctacttttgatatc

SEQ ID NO: 3938 - DNA, 36 bp, Artificial Sequence
  Synthetic polynucleotide encoding artificial human antibody CDR-H3 region
gcaagagacggctatgactttcgggcttttgaccac

SEQ ID NO: 3939 - DNA, 60 bp, Artificial Sequence
  Synthetic polynucleotide encoding artificial human antibody CDR-H3 region
gcgcgagctcgcggtgggggtttttgtagtaatatggactgcccggcaatgtttgactac

SEQ ID NO: 3940 - DNA, 27 bp, Artificial Sequence
  Synthetic polynucleotide encoding artificial human antibody CDR-H3 region
accacgattcatgactacggtgaccac

SEQ ID NO: 3941 - DNA, 30 bp, Artificial Sequence
  Synthetic polynucleotide encoding artificial human antibody CDR-H3 region
gcgaggggccttttacgatccctggacgtc

SEQ ID NO: 3942 - DNA, 42 bp, Artificial Sequence
  Synthetic polynucleotide encoding artificial human antibody CDR-H3 region
gctagagtgaaactgggggcatcgagccgtgtttttgatgtc

SEQ ID NO: 3943 - DNA, 39 bp, Artificial Sequence
  Synthetic polynucleotide encoding artificial human antibody CDR-H3 region
gcgacaaccgttacacctaaggtgaccagttttgcttcc

SEQ ID NO: 3944 - DNA, 45 bp, Artificial Sequence
  Synthetic polynucleotide encoding artificial human antibody CDR-H3 region
gcgagagaacagagccccctttatttcggtccatctttggacgtc

SEQ ID NO: 3945 - DNA, 36 bp, Artificial Sequence
  Synthetic polynucleotide encoding artificial human antibody CDR-H3 region
gcgagagagccttactcctcctacgctatggacgtc

SEQ ID NO: 3946 - DNA, 36 bp, Artificial Sequence
  Synthetic polynucleotide encoding artificial human antibody CDR-H3 region
gcgaaagatggatccgagatgttattgtgtgactac

SEQ ID NO: 3947 - DNA, 33 bp, Artificial Sequence
  Synthetic polynucleotide encoding artificial human antibody CDR-H3 region
gcgagagacactaggtggcgagggttggacagc

SEQ ID NO: 3948 - DNA, 39 bp, Artificial Sequence
  Synthetic polynucleotide encoding artificial human antibody CDR-H3 region
gcaaaagatctgttagcagtgcctggcctacttgacgac

SEQ ID NO: 3949 - DNA, 42 bp, Artificial Sequence
  Synthetic polynucleotide encoding artificial human antibody CDR-H3 region
gcgagtcggggtggatcttctcgccggtacggtatgggcgtc

SEQ ID NO: 3950 - DNA, 48 bp, Artificial Sequence
  Synthetic polynucleotide encoding artificial human antibody CDR-H3 region
gtgaaattgaagggcattggcgctatgtggacgtacgctatggacgtc

SEQ ID NO: 3951 - DNA, 54 bp, Artificial Sequence
  Synthetic polynucleotide encoding artificial human antibody CDR-H3 region
gcgagagatcagggctacggtgattacgactatcccagagactggatcgaaccc

SEQ ID NO: 3952 - DNA, 48 bp, Artificial Sequence
  Synthetic polynucleotide encoding artificial human antibody CDR-H3 region
gcgagcgtccgagacctcgtcagtggcaccacttactactatcactac

SEQ ID NO: 3953 - DNA, 30 bp, Artificial Sequence
  Synthetic polynucleotide encoding artificial human antibody CDR-H3 region
gcgagatacggtgactactcctttgacccc

SEQ ID NO: 3954 - DNA, 39 bp, Artificial Sequence
  Synthetic polynucleotide encoding artificial human antibody CDR-H3 region
gcgagagtcgtagacacagttttggcagactttgactac

SEQ ID NO: 3955 - DNA, 42 bp, Artificial Sequence
  Synthetic polynucleotide encoding artificial human antibody CDR-H3 region
gcgcgatcagggggctttggctggtcaagggaccttgactac

SEQ ID NO: 3956 - DNA, 48 bp, Artificial Sequence
  Synthetic polynucleotide encoding artificial human antibody CDR-H3 region
gcgagacatggattttggagtggccccatacccgacgcttttgatatc

SEQ ID NO: 3957 - DNA, 36 bp, Artificial Sequence
  Synthetic polynucleotide encoding artificial human antibody CDR-H3 region
gcgcacgaagactatggttcggggaatggtaattac

SEQ ID NO: 3958 - DNA, 45 bp, Artificial Sequence
  Synthetic polynucleotide encoding artificial human antibody CDR-H3 region
gcgagagaccgcgacagtggctacgagaggaattgtctcgacccc

SEQ ID NO: 3959 - DNA, 66 bp, Artificial Sequence
  Synthetic polynucleotide encoding artificial human antibody CDR-H3 region
gcgaggggggccccttatggttcgcgaatttattatgattacgactcctaccatggtatggacgtc

SEQ ID NO: 3960 - DNA, 48 bp, Artificial Sequence
  Synthetic polynucleotide encoding artificial human antibody CDR-H3 region
gcgagaggaaagtttgactggttccctcgtgtgtcctcctttgactac

SEQ ID NO: 3961 - DNA, 39 bp, Artificial Sequence
  Synthetic polynucleotide encoding artificial human antibody CDR-H3 region
gcggccgcctattatattgatactagcggctttgactac

SEQ ID NO: 3962 - DNA, 54 bp, Artificial Sequence
  Synthetic polynucleotide encoding artificial human antibody CDR-H3 region
gcgaaaggacggacgtatagcaataactggttatttcactggtacttcgatctc

SEQ ID NO: 3963 - DNA, 39 bp, Artificial Sequence
  Synthetic polynucleotide encoding artificial human antibody CDR-H3 region
gcgagagtttttagtacgatatttcatggggtcgacccc

SEQ ID NO: 3964 - DNA, 45 bp, Artificial Sequence
  Synthetic polynucleotide encoding artificial human antibody CDR-H3 region
gcgagacacttaagcagtggcgaataccactacggtttggacgtc

SEQ ID NO: 3965 - DNA, 39 bp, Artificial Sequence
  Synthetic polynucleotide encoding artificial human antibody CDR-H3 region
gcgaaaggaaagggtatagtgggagccacctttgactac

SEQ ID NO: 3966 - DNA, 54 bp, Artificial Sequence
  Synthetic polynucleotide encoding artificial human antibody CDR-H3 region
gcgagagatgcgctagattttgactggttattgtcagccgggggctttgactac

SEQ ID NO: 3967 - DNA, 33 bp, Artificial Sequence
  Synthetic polynucleotide encoding artificial human antibody CDR-H3 region
gcgagactacttgtggggggtgcttttgatatc

SEQ ID NO: 3968 - DNA, 54 bp, Artificial Sequence
  Synthetic polynucleotide encoding artificial human antibody CDR-H3 region
accccaggatcttgtagtggtggtagctgctactccggcgatgcttttgatatc

SEQ ID NO: 3969 - DNA, 45 bp, Artificial Sequence
  Synthetic polynucleotide encoding artificial human antibody CDR-H3 region
gcgagagagtcccttgatagtgcctcatatagtaccatcgcacat

SEQ ID NO: 3970 - DNA, 45 bp, Artificial Sequence
  Synthetic polynucleotide encoding artificial human antibody CDR-H3 region
gcgagagatcgaggaggcaacagctggcttgatgtttttgatatg

SEQ ID NO: 3971 - DNA, 45 bp, Artificial Sequence
  Synthetic polynucleotide encoding artificial human antibody CDR-H3 region
gcgagatcccccgccgcctttggctcagagagttactttgactcc

SEQ ID NO: 3972 - DNA, 51 bp, Artificial Sequence
  Synthetic polynucleotide encoding artificial human antibody CDR-H3 region
gcgaaagatcttctagaggacccatacttcggggacttattgtttgactac

SEQ ID NO: 3973 - DNA, 36 bp, Artificial Sequence
  Synthetic polynucleotide encoding artificial human antibody CDR-H3 region
gtgaggacccccgctgttggcaccgaccctgactac

SEQ ID NO: 3974 - DNA, 36 bp, Artificial Sequence
  Synthetic polynucleotide encoding artificial human antibody CDR-H3 region
tcgagtggggggtccacatcgatggttgggagatac

SEQ ID NO: 3975 - DNA, 42 bp, Artificial Sequence
  Synthetic polynucleotide encoding artificial human antibody CDR-H3 region
gcacggatgaccccattcaagtttggactatgccctgactac

SEQ ID NO: 3976 - DNA, 42 bp, Artificial Sequence
  Synthetic polynucleotide encoding artificial human antibody CDR-H3 region
gcgagagtagtggtggtaggtacagactacggtatggacgtc

SEQ ID NO: 3977 - DNA, 42 bp, Artificial Sequence
  Synthetic polynucleotide encoding artificial human antibody CDR-H3 region
gcgagagatcaaggactggagagggctaactggttcgacccc

SEQ ID NO: 3978 - DNA, 27 bp, Artificial Sequence
  Synthetic polynucleotide encoding artificial human antibody CDR-H3 region
gcaagaggtgtccgccactttgactac

SEQ ID NO: 3979 - DNA, 36 bp, Artificial Sequence
  Synthetic polynucleotide encoding artificial human antibody CDR-H3 region
gcgagagagtcacctttaactgtcgtctttgactac

SEQ ID NO: 3980 - DNA, 33 bp, Artificial Sequence
  Synthetic polynucleotide encoding artificial human antibody CDR-H3 region
gcgagggaatcctcagcagctggttatgactac

SEQ ID NO: 3981 - DNA, 48 bp, Artificial Sequence
  Synthetic polynucleotide encoding artificial human antibody CDR-H3 region
gcgagaaagcttatgtctggcatagtgtctcggggctggttcgacccc

SEQ ID NO: 3982 - DNA, 42 bp, Artificial Sequence
  Synthetic polynucleotide encoding artificial human antibody CDR-H3 region
gcgagagatcgcggtgactacgttacccactggttcgacccc

SEQ ID NO: 3983 - DNA, 39 bp, Artificial Sequence
  Synthetic polynucleotide encoding artificial human antibody CDR-H3 region
gcgagacatagggttggcgacagcccgggactccactac

SEQ ID NO: 3984 - DNA, 36 bp, Artificial Sequence
  Synthetic polynucleotide encoding artificial human antibody CDR-H3 region
gcgagccctatagcagtggctgccccctttgcctac

SEQ ID NO: 3985 - DNA, 51 bp, Artificial Sequence
  Synthetic polynucleotide encoding artificial human antibody CDR-H3 region
gtgaaggattatcttgctgttggtgggacctactacgactactttgactac

SEQ ID NO: 3986 - DNA, 33 bp, Artificial Sequence
  Synthetic polynucleotide encoding artificial human antibody CDR-H3 region
gcgagacatgactaccgtaactactttgactac

SEQ ID NO: 3987 - DNA, 45 bp, Artificial Sequence
  Synthetic polynucleotide encoding artificial human antibody CDR-H3 region
gcgaccccaccgtctcgatatggtggaaactactacgcagactac

SEQ ID NO: 3988 - DNA, 33 bp, Artificial Sequence
  Synthetic polynucleotide encoding artificial human antibody CDR-H3 region
gcgagacaagggccgacagtagcgattgacttc

SEQ ID NO: 3989 - DNA, 27 bp, Artificial Sequence
  Synthetic polynucleotide encoding artificial human antibody CDR-H3 region
gcgagacggggtagagagtttgattac

SEQ ID NO: 3990 - DNA, 51 bp, Artificial Sequence
  Synthetic polynucleotide encoding artificial human antibody CDR-H3 region
gcgatccaggaaaaacgggaactgcaactacgtcgagaactagataactac

SEQ ID NO: 3991 - DNA, 30 bp, Artificial Sequence
  Synthetic polynucleotide encoding artificial human antibody CDR-H3 region
gcgagagtatttcgatacggtatggacgtc

SEQ ID NO: 3992 - DNA, 30 bp, Artificial Sequence
  Synthetic polynucleotide encoding artificial human antibody CDR-H3 region
gcgatcaaagaaggctacggtctttcagac

SEQ ID NO: 3993 - DNA, 36 bp, Artificial Sequence
  Synthetic polynucleotide encoding artificial human antibody CDR-H3 region
gcgaaagaggatggctacactcaaaattttgactac

SEQ ID NO: 3994 - DNA, 42 bp, Artificial Sequence
  Synthetic polynucleotide encoding artificial human antibody CDR-H3 region
gcgagagttctggacttttatggaagtagtgtcctagactac

SEQ ID NO: 3995 - DNA, 24 bp, Artificial Sequence
  Synthetic polynucleotide encoding artificial human antibody CDR-H3 region
gcgagagatcggcccggggactac

SEQ ID NO: 3996 - DNA, 33 bp, Artificial Sequence
  Synthetic polynucleotide encoding artificial human antibody CDR-H3 region
gcgagagatcttggtgtgggatctactacctac

SEQ ID NO: 3997 - DNA, 42 bp, Artificial Sequence
  Synthetic polynucleotide encoding artificial human antibody CDR-H3 region
gtgaaagatttggaggtttctataggtcacaattttgacttt

SEQ ID NO: 3998 - DNA, 60 bp, Artificial Sequence
  Synthetic polynucleotide encoding artificial human antibody CDR-H3 region
gcgagagataggggggtagtggtggtagctgctaccccttactactacggtatggacgtc

SEQ ID NO: 3999 - DNA, 51 bp, Artificial Sequence
  Synthetic polynucleotide encoding artificial human antibody CDR-H3 region
gtacacgcacgagatgactacggtgactccgcttggtcaactgggcctgtc

SEQ ID NO: 4000 - DNA, 51 bp, Artificial Sequence
  Synthetic polynucleotide encoding artificial human antibody CDR-H3 region
ggacacagacgtctgttaaggggggttactactactgtctatttcgacccc

SEQ ID NO: 4001 - DNA, 51 bp, Artificial Sequence
  Synthetic polynucleotide encoding artificial human antibody CDR-H3 region
gcgagaggaggggagctgctgggcggattcggctacagtggtatggacgtc

SEQ ID NO: 4002 - DNA, 57 bp, Artificial Sequence
  Synthetic polynucleotide encoding artificial human antibody CDR-H3 region
gcgcattattattatgatagtagtggttattaccaaaacgctgaatacttccagtac

SEQ ID NO: 4003 - DNA, 63 bp, Artificial Sequence
  Synthetic polynucleotide encoding artificial human antibody CDR-H3 region
gcgagaacccagtgggggaccgatgtagaggcaacgaatccctactactatttcatggacgtc

SEQ ID NO: 4004 - DNA, 36 bp, Artificial Sequence
  Synthetic polynucleotide encoding artificial human antibody CDR-H3 region
gcgcgagatcagagtggagctgacagatttgactcc

SEQ ID NO: 4005 - DNA, 39 bp, Artificial Sequence
  Synthetic polynucleotide encoding artificial human antibody CDR-H3 region
gcgagatcttcgaagtggacggactggcattttgactac

SEQ ID NO: 4006 - DNA, 42 bp, Artificial Sequence
  Synthetic polynucleotide encoding artificial human antibody CDR-H3 region
gcgagagatctcgacgaaataaatagttcttggctcgacccc

SEQ ID NO: 4007 - DNA, 51 bp, Artificial Sequence
  Synthetic polynucleotide encoding artificial human antibody CDR-H3 region
gcgaaacgccccaccgctggaaacagctatggtggatactactttgaccat

SEQ ID NO: 4008 - DNA, 57 bp, Artificial Sequence
  Synthetic polynucleotide encoding artificial human antibody CDR-H3 region
gcgagacggggcgaagtcgggactatggttcgggttttccgaaagccgtttgactac

SEQ ID NO: 4009 - DNA, 54 bp, Artificial Sequence
  Synthetic polynucleotide encoding artificial human antibody CDR-H3 region
gcgacaacctcgactatgccaatgcctactagagggagagactggttcgacccc

SEQ ID NO: 4010 - DNA, 33 bp, Artificial Sequence
  Synthetic polynucleotide encoding artificial human antibody CDR-H3 region
gcgggtgcccacggtgactacggtcttgactat

SEQ ID NO: 4011 - DNA, 45 bp, Artificial Sequence
  Synthetic polynucleotide encoding artificial human antibody CDR-H3 region
gcgagacatcagcagaagtatagccccatttccccgcttgactac

SEQ ID NO: 4012 - DNA, 39 bp, Artificial Sequence
  Synthetic polynucleotide encoding artificial human antibody CDR-H3 region
gcaaaagacgcacgcctggcttattatggtatggacgtc

SEQ ID NO: 4013 - DNA, 36 bp, Artificial Sequence
  Synthetic polynucleotide encoding artificial human antibody CDR-H3 region
gcgagacactcgagtggttattcagaacttgcctac

SEQ ID NO: 4014 - DNA, 42 bp, Artificial Sequence
  Synthetic polynucleotide encoding artificial human antibody CDR-H3 region
gcgagagtccacaattgggacttctactacggtatggacgtc

SEQ ID NO: 4015 - DNA, 45 bp, Artificial Sequence
  Synthetic polynucleotide encoding artificial human antibody CDR-H3 region
actagagagaggccccctaattgtggatctagctgccccgagacc

SEQ ID NO: 4016 - DNA, 36 bp, Artificial Sequence
  Synthetic polynucleotide encoding artificial human antibody CDR-H3 region
gcgagagtcgggacatctcattggtactctgattct

SEQ ID NO: 4017 - DNA, 30 bp, Artificial Sequence
  Synthetic polynucleotide encoding artificial human antibody CDR-H3 region
gcgagagacgaggggcgaagagagggcgcc

SEQ ID NO: 4018 - DNA, 39 bp, Artificial Sequence
  Synthetic polynucleotide encoding artificial human antibody CDR-H3 region
gcgagagatatcgcgctgggacggggcggtatggacgtc

SEQ ID NO: 4019 - DNA, 36 bp, Artificial Sequence
  Synthetic polynucleotide encoding artificial human antibody CDR-H3 region
gcgagacatagaacgggccaatattactataatagt

SEQ ID NO: 4020 - DNA, 33 bp, Artificial Sequence
  Synthetic polynucleotide encoding artificial human antibody CDR-H3 region
gcggcgtccggctacggtgaccacgtggcctac

SEQ ID NO: 4021 - DNA, 48 bp, Artificial Sequence
  Synthetic polynucleotide encoding artificial human antibody CDR-H3 region
gcgagagggaatggacctaagagtgggaagtactcggactttgactac

SEQ ID NO: 4022 - DNA, 30 bp, Artificial Sequence
  Synthetic polynucleotide encoding artificial human antibody CDR-H3 region
gcgagagataagtcctggtactttgactac

SEQ ID NO: 4023 - DNA, 45 bp, Artificial Sequence
  Synthetic polynucleotide encoding artificial human antibody CDR-H3 region
gcgagatccaccgctagtagtggttattatgatgcttttgatatc

SEQ ID NO: 4024 - DNA, 66 bp, Artificial Sequence
  Synthetic polynucleotide encoding artificial human antibody CDR-H3 region
gcgagagatcgtcgagagtatagcagctcgtcccggccttcatatcactactactacatggacgtc

SEQ ID NO: 4025 - DNA, 39 bp, Artificial Sequence
  Synthetic polynucleotide encoding artificial human antibody CDR-H3 region
gcgtcccgatatagaagcccgtccggtgcttttgacatc

SEQ ID NO: 4026 - DNA, 24 bp, Artificial Sequence
  Synthetic polynucleotide encoding artificial human antibody CDR-H3 region
accagaggagcagtggccgactac

SEQ ID NO: 4027 - DNA, 42 bp, Artificial Sequence
  Synthetic polynucleotide encoding artificial human antibody CDR-H3 region
gcgacctcccacggaggactagtgcctggcggcgaaaactac

SEQ ID NO: 4028 - DNA, 48 bp, Artificial Sequence
  Synthetic polynucleotide encoding artificial human antibody CDR-H3 region
gtgagagaggagtttggagtggttcgtggacctaatccctttgatgtc

SEQ ID NO: 4029 - DNA, 57 bp, Artificial Sequence
  Synthetic polynucleotide encoding artificial human antibody CDR-H3 region
gcgaaaacccgttcttatagttccgctgacactactcgtcccaatgccccgggctac

SEQ ID NO: 4030 - DNA, 45 bp, Artificial Sequence
  Synthetic polynucleotide encoding artificial human antibody CDR-H3 region
gcgaaagatggccaaactggaactacaaccccatactttgactac

SEQ ID NO: 4031 - DNA, 30 bp, Artificial Sequence
  Synthetic polynucleotide encoding artificial human antibody CDR-H3 region
gcgagagccggggctgagggcgttgactat

SEQ ID NO: 4032 - DNA, 42 bp, Artificial Sequence
  Synthetic polynucleotide encoding artificial human antibody CDR-H3 region
gcgagacgatccgataaagcagtgcctgggacctttgaccag

SEQ ID NO: 4033 - DNA, 45 bp, Artificial Sequence
  Synthetic polynucleotide encoding artificial human antibody CDR-H3 region
gcacacagggggggaaagaaccctcgttattggtacttcgatctc

SEQ ID NO: 4034 - DNA, 39 bp, Artificial Sequence
  Synthetic polynucleotide encoding artificial human antibody CDR-H3 region
gcgagaggggaggggggggaattatgggcctttgactac

SEQ ID NO: 4035 - DNA, 42 bp, Artificial Sequence
  Synthetic polynucleotide encoding artificial human antibody CDR-H3 region
gcgagagaggggcttcgtctggcacgtggctggtttcacccc

SEQ ID NO: 4036 - DNA, 36 bp, Artificial Sequence
  Synthetic polynucleotide encoding artificial human antibody CDR-H3 region
gcgagagattttgatgatggctacgacatccgttac

SEQ ID NO: 4037 - DNA, 39 bp, Artificial Sequence
  Synthetic polynucleotide encoding artificial human antibody CDR-H3 region
gtgaaatcaccagtggccgcaaatgatgcttttgatatc

SEQ ID NO: 4038 - DNA, 39 bp, Artificial Sequence
  Synthetic polynucleotide encoding artificial human antibody CDR-H3 region
gcgagagtgtctgtggccgccccaacgtgcttggactac

SEQ ID NO: 4039 - DNA, 45 bp, Artificial Sequence
  Synthetic polynucleotide encoding artificial human antibody CDR-H3 region
gcgagacattcagggcacgatcagttgccgctagactttgacaac

SEQ ID NO: 4040 - DNA, 27 bp, Artificial Sequence
  Synthetic polynucleotide encoding artificial human antibody CDR-H3 region
gcaggaggaggaagtcaagtggacttc

SEQ ID NO: 4041 - DNA, 51 bp, Artificial Sequence
  Synthetic polynucleotide encoding artificial human antibody CDR-H3 region
gcacacagattcgggagaggggtgtcctactactactacggtatggacgtc

SEQ ID NO: 4042 - DNA, 36 bp, Artificial Sequence
  Synthetic polynucleotide encoding artificial human antibody CDR-H3 region
gcgaaagatagtgggagcaacgacgacatggacgtc

SEQ ID NO: 4043 - DNA, 39 bp, Artificial Sequence
  Synthetic polynucleotide encoding artificial human antibody CDR-H3 region
gcgagaagaggtttttactactactacggtatggacgtc

SEQ ID NO: 4044 - DNA, 30 bp, Artificial Sequence
  Synthetic polynucleotide encoding artificial human antibody CDR-H3 region
gcgagtctcctcgggggcgatcctgactac

SEQ ID NO: 4045 - DNA, 60 bp, Artificial Sequence
  Synthetic polynucleotide encoding artificial human antibody CDR-H3 region
gcacggatgcaaatagtggctacgacacagacctactactactactacggtatggacgtc

SEQ ID NO: 4046 - DNA, 39 bp, Artificial Sequence
  Synthetic polynucleotide encoding artificial human antibody CDR-H3 region
gcgagagcgggctacgatcttttcggctggttcgacccc

SEQ ID NO: 4047 - DNA, 57 bp, Artificial Sequence
  Synthetic polynucleotide encoding artificial human antibody CDR-H3 region
gcgaaacccaactcccctttcactggcagtggaagtttccacaactactttgactac

SEQ ID NO: 4048 - DNA, 18 bp, Artificial Sequence
  Synthetic polynucleotide encoding artificial human antibody CDR-H3 region
gcgagtcccgttcgaccc

SEQ ID NO: 4049 - DNA, 63 bp, Artificial Sequence
  Synthetic polynucleotide encoding artificial human antibody CDR-H3 region
gcgagaggattttgtgatcttcccgcctgttatcccgtacctcaatacaactggttcgacccc

SEQ ID NO: 4050 - DNA, 39 bp, Artificial Sequence
  Synthetic polynucleotide encoding artificial human antibody CDR-H3 region
gcgcgatatagtgggagctaccctttgggctttgactac

SEQ ID NO: 4051 - DNA, 27 bp, Artificial Sequence
  Synthetic polynucleotide encoding artificial human antibody CDR-H3 region
gcgagacatgaaggtgcttttgatatc

SEQ ID NO: 4052 - DNA, 36 bp, Artificial Sequence
  Synthetic polynucleotide encoding artificial human antibody CDR-H3 region
accacagatcttgcggtgactacgcgatttgactac

SEQ ID NO: 4053 - DNA, 33 bp, Artificial Sequence
  Synthetic polynucleotide encoding artificial human antibody CDR-H3 region
gcgagaagcacacgtacagacgctttggacgtc

SEQ ID NO: 4054 - DNA, 39 bp, Artificial Sequence
  Synthetic polynucleotide encoding artificial human antibody CDR-H3 region
gctaaaaatgacgagatggactttaagggctatgactac

SEQ ID NO: 4055 - DNA, 27 bp, Artificial Sequence
  Synthetic polynucleotide encoding artificial human antibody CDR-H3 region
gcgagaggggagttattattcgaccac

SEQ ID NO: 4056 - DNA, 30 bp, Artificial Sequence
  Synthetic polynucleotide encoding artificial human antibody CDR-H3 region
gctagagaatctacggtggttcttgacttc

SEQ ID NO: 4057 - DNA, 36 bp, Artificial Sequence
  Synthetic polynucleotide encoding artificial human antibody CDR-H3 region
gcgaaaaggtcaacagcagtgggggacttcgacccc

SEQ ID NO: 4058 - DNA, 48 bp, Artificial Sequence
  Synthetic polynucleotide encoding artificial human antibody CDR-H3 region
gcgcgggggccgtccaactggaacgggggtccggagcacatggacgtc

SEQ ID NO: 4059 - DNA, 18 bp, Artificial Sequence
  Synthetic polynucleotide encoding artificial human antibody CDR-H3 region
gcgagagattttgactac

SEQ ID NO: 4060 - DNA, 42 bp, Artificial Sequence
  Synthetic polynucleotide encoding artificial human antibody CDR-H3 region
gcgagagatccctatggttcggggacggtctggttcgacccc

SEQ ID NO: 4061 - DNA, 60 bp, Artificial Sequence
  Synthetic polynucleotide encoding artificial human antibody CDR-H3 region
gcgaaaactgagtacacttttttgagtggctccgactactaccagtacggtatggacgtc

SEQ ID NO: 4062 - DNA, 48 bp, Artificial Sequence
  Synthetic polynucleotide encoding artificial human antibody CDR-H3 region
gcgagacgggggttattgcgtgggagcaacgagggaaggtttgactac

SEQ ID NO: 4063 - DNA, 45 bp, Artificial Sequence
  Synthetic polynucleotide encoding artificial human antibody CDR-H3 region
actagacgcggcagtgcctggacggacccctactacacggacgtc

SEQ ID NO: 4064 - DNA, 33 bp, Artificial Sequence
  Synthetic polynucleotide encoding artificial human antibody CDR-H3 region
gcgagagatgatgtccctaggggttatgactac

SEQ ID NO: 4065 - DNA, 39 bp, Artificial Sequence
  Synthetic polynucleotide encoding artificial human antibody CDR-H3 region
gcgagagagtacattgtacccttctacggtatggacgtc

SEQ ID NO: 4066 - DNA, 27 bp, Artificial Sequence
  Synthetic polynucleotide encoding artificial human antibody CDR-L3 region
caacagactaacactttccccctcact

SEQ ID NO: 4067 - DNA, 27 bp, Artificial Sequence
  Synthetic polynucleotide encoding artificial human antibody CDR-L3 region
caacagagttacagtacccctccgcgt

SEQ ID NO: 4068 - DNA, 27 bp, Artificial Sequence
  Synthetic polynucleotide encoding artificial human antibody CDR-L3 region
caacagtctaacagtttccccgggact

SEQ ID NO: 4069 - DNA, 33 bp, Artificial Sequence
  Synthetic polynucleotide encoding artificial human antibody CDR-L3 region
gcagcatgggaggacagcctgagtggtccggtg

SEQ ID NO: 4070 - DNA, 27 bp, Artificial Sequence
  Synthetic polynucleotide encoding artificial human antibody CDR-L3 region
aactcccgggacaggagtggttatgtc

SEQ ID NO: 4071 - DNA, 33 bp, Artificial Sequence
  Synthetic polynucleotide encoding artificial human antibody CDR-L3 region
caggtgtgggataatggtcattctcattgggtg

SEQ ID NO: 4072 - DNA, 27 bp, Artificial Sequence
  Synthetic polynucleotide encoding artificial human antibody CDR-L3 region
caacagagttacagaatgccttgcagt

SEQ ID NO: 4073 - DNA, 30 bp, Artificial Sequence
  Synthetic polynucleotide encoding artificial human antibody CDR-L3 region
cagcagtatggtagctcacctcccatcacc

SEQ ID NO: 4074 - DNA, 27 bp, Artificial Sequence
  Synthetic polynucleotide encoding artificial human antibody CDR-L3 region
cagtcttatgatacaaccaatgtgata

SEQ ID NO: 4075 - DNA, 27 bp, Artificial Sequence
  Synthetic polynucleotide encoding artificial human antibody CDR-L3 region
caacagtatgatagttcacccttcact

SEQ ID NO: 4076 - DNA, 30 bp, Artificial Sequence
  Synthetic polynucleotide encoding artificial human antibody CDR-L3 region
ggaacatgggatgacaacctgagtgctgta

SEQ ID NO: 4077 - DNA, 27 bp, Artificial Sequence
  Synthetic polynucleotide encoding artificial human antibody CDR-L3 region
ctgcaaggtacacactggcctccgacg

SEQ ID NO: 4078 - DNA, 33 bp, Artificial Sequence
  Synthetic polynucleotide encoding artificial human antibody CDR-L3 region
gcagcatgggatgacaatgtgagtggtcctggc

SEQ ID NO: 4079 - DNA, 33 bp, Artificial Sequence
  Synthetic polynucleotide encoding artificial human antibody CDR-L3 region
gcaacatgggatgacagcctgaatggtccggtg

SEQ ID NO: 4080 - DNA, 24 bp, Artificial Sequence
  Synthetic polynucleotide encoding artificial human antibody CDR-L3 region
cagcagtataataactggtggacg

SEQ ID NO: 4081 - DNA, 27 bp, Artificial Sequence
  Synthetic polynucleotide encoding artificial human antibody CDR-L3 region
cagcaatatggtagttttcggtacact

SEQ ID NO: 4082 - DNA, 30 bp, Artificial Sequence
  Synthetic polynucleotide encoding artificial human antibody CDR-L3 region
caatcagcagacagcagtgatacttatgtg

SEQ ID NO: 4083 - DNA, 27 bp, Artificial Sequence
  Synthetic polynucleotide encoding artificial human antibody CDR-L3 region
cagcagcgtagcaactggcctctcact

SEQ ID NO: 4084 - DNA, 30 bp, Artificial Sequence
  Synthetic polynucleotide encoding artificial human antibody CDR-L3 region
cagcagggtagcaactggttggcgctcact

SEQ ID NO: 4085 - DNA, 27 bp, Artificial Sequence
  Synthetic polynucleotide encoding artificial human antibody CDR-L3 region
caacagtattatattaaccctcggacg

SEQ ID NO: 4086 - DNA, 27 bp, Artificial Sequence
  Synthetic polynucleotide encoding artificial human antibody CDR-L3 region
cagcaatattatagtactccgtacact

SEQ ID NO: 4087 - DNA, 27 bp, Artificial Sequence
  Synthetic polynucleotide encoding artificial human antibody CDR-L3 region
caacagagtttcaacaccgtgctcact

SEQ ID NO: 4088 - DNA, 33 bp, Artificial Sequence
  Synthetic polynucleotide encoding artificial human antibody CDR-L3 region
agctcatatacaatcaccagcacgctttgggtg

SEQ ID NO: 4089 - DNA, 33 bp, Artificial Sequence
  Synthetic polynucleotide encoding artificial human antibody CDR-L3 region
gcagcatgggatgacagcctgagtggtccggta

SEQ ID NO: 4090 - DNA, 27 bp, Artificial Sequence
  Synthetic polynucleotide encoding artificial human antibody CDR-L3 region
cagcagacttacagtaatccttggacg

SEQ ID NO: 4091 - DNA, 27 bp, Artificial Sequence
  Synthetic polynucleotide encoding artificial human antibody CDR-L3 region
caacagacttacagtcaccctcgcacg

SEQ ID NO: 4092 - DNA, 33 bp, Artificial Sequence
  Synthetic polynucleotide encoding artificial human antibody CDR-L3 region
cagtcctatgacagcagcctgagtggttatgtc

SEQ ID NO: 4093 - DNA, 33 bp, Artificial Sequence
  Synthetic polynucleotide encoding artificial human antibody CDR-L3 region
caggtgtgggatagtagtagtgatcattatgtc

SEQ ID NO: 4094 - DNA, 27 bp, Artificial Sequence
  Synthetic polynucleotide encoding artificial human antibody CDR-L3 region
caacagactagcagtttccctcgaact

SEQ ID NO: 4095 - DNA, 30 bp, Artificial Sequence
  Synthetic polynucleotide encoding artificial human antibody CDR-L3 region
caatcagtagacattacttctacttgggtg

SEQ ID NO: 4096 - DNA, 33 bp, Artificial Sequence
  Synthetic polynucleotide encoding artificial human antibody CDR-L3 region
agctcatatataagtagcctcacttatgtgctg

SEQ ID NO: 4097 - DNA, 33 bp, Artificial Sequence
  Synthetic polynucleotide encoding artificial human antibody CDR-L3 region
ggaacatgggatagtagcctgagtgttggggtg

SEQ ID NO: 4098 - DNA, 27 bp, Artificial Sequence
  Synthetic polynucleotide encoding artificial human antibody CDR-L3 region
atgcaaggtacacactggccgatcacc

SEQ ID NO: 4099 - DNA, 27 bp, Artificial Sequence
  Synthetic polynucleotide encoding artificial human antibody CDR-L3 region
cagcagtatgatagctcatcgtggacg

SEQ ID NO: 4100 - DNA, 33 bp, Artificial Sequence
  Synthetic polynucleotide encoding artificial human antibody CDR-L3 region
cagtcgtatgacagcagcctgagaggtgtggtg

SEQ ID NO: 4101 - DNA, 27 bp, Artificial Sequence
  Synthetic polynucleotide encoding artificial human antibody CDR-L3 region
caacagagttacagtacccctcggacg

SEQ ID NO: 4102 - DNA, 27 bp, Artificial Sequence
  Synthetic polynucleotide encoding artificial human antibody CDR-L3 region
cagcaatattatagcactccgtggacg

SEQ ID NO: 4103 - DNA, 39 bp, Artificial Sequence
  Synthetic polynucleotide encoding artificial human antibody CDR-L3 region
cagtcctatgacagcggcctgagtggttcgaaggtggtc

SEQ ID NO: 4104 - DNA, 27 bp, Artificial Sequence
  Synthetic polynucleotide encoding artificial human antibody CDR-L3 region
cagtcttatgatctcagcacttgggtg

SEQ ID NO: 4105 - DNA, 27 bp, Artificial Sequence
  Synthetic polynucleotide encoding artificial human antibody CDR-L3 region
caccagagttacagtacctctctcact

SEQ ID NO: 4106 - DNA, 33 bp, Artificial Sequence
  Synthetic polynucleotide encoding artificial human antibody CDR-L3 region
caggtgtgggatagtagtagtgatcattgggtg

SEQ ID NO: 4107 - DNA, 30 bp, Artificial Sequence
  Synthetic polynucleotide encoding artificial human antibody CDR-L3 region
agctcatatacaagcagcagcactcaggta

SEQ ID NO: 4108 - DNA, 27 bp, Artificial Sequence
  Synthetic polynucleotide encoding artificial human antibody CDR-L3 region
caacagagttacagtacccctaagacg

SEQ ID NO: 4109 - DNA, 30 bp, Artificial Sequence
  Synthetic polynucleotide encoding artificial human antibody CDR-L3 region
caacagtttaatacttaccctctgtacacc

SEQ ID NO: 4110 - DNA, 33 bp, Artificial Sequence
  Synthetic polynucleotide encoding artificial human antibody CDR-L3 region
gactcccgggacagcagtggtaacctcgtggta

SEQ ID NO: 4111 - DNA, 27 bp, Artificial Sequence
  Synthetic polynucleotide encoding artificial human antibody CDR-L3 region
caacagactaacagtttcccccggact

SEQ ID NO: 4112 - DNA, 30 bp, Artificial Sequence
  Synthetic polynucleotide encoding artificial human antibody CDR-L3 region
caacagagttacagtgtccctccgtggacg

SEQ ID NO: 4113 - DNA, 30 bp, Artificial Sequence
  Synthetic polynucleotide encoding artificial human antibody CDR-L3 region
cagcaatatggtagctcacctcggtacact

SEQ ID NO: 4114 - DNA, 24 bp, Artificial Sequence
  Synthetic polynucleotide encoding artificial human antibody CDR-L3 region
cagcagtatggtagcgcgtggacg

SEQ ID NO: 4115 - DNA, 30 bp, Artificial Sequence
  Synthetic polynucleotide encoding artificial human antibody CDR-L3 region
cagcagcgtgccaactggcctcctatcacc

SEQ ID NO: 4116 - DNA, 27 bp, Artificial Sequence
  Synthetic polynucleotide encoding artificial human antibody CDR-L3 region
caacagtataatagttacccgtggacg

SEQ ID NO: 4117 - DNA, 36 bp, Artificial Sequence
  Synthetic polynucleotide encoding artificial human antibody CDR-L3 region
caggtgtgggatagtagtagtgatcattatgtggta

SEQ ID NO: 4118 - DNA, 30 bp, Artificial Sequence
  Synthetic polynucleotide encoding artificial human antibody CDR-L3 region
cagcagcgtagcaactggcctccgctcact

SEQ ID NO: 4119 - DNA, 27 bp, Artificial Sequence
  Synthetic polynucleotide encoding artificial human antibody CDR-L3 region
atgcaagctctacaaactccctacact

SEQ ID NO: 4120 - DNA, 24 bp, Artificial Sequence
  Synthetic polynucleotide encoding artificial human antibody CDR-L3 region
caacagtataatagttattcgacg

SEQ ID NO: 4121 - DNA, 30 bp, Artificial Sequence
  Synthetic polynucleotide encoding artificial human antibody CDR-L3 region
ttgctatatatgggcagtggcatttcggtt

SEQ ID NO: 4122 - DNA, 30 bp, Artificial Sequence
  Synthetic polynucleotide encoding artificial human antibody CDR-L3 region
cagcactatggtgcctcaccgccgtggacg

SEQ ID NO: 4123 - DNA, 36 bp, Artificial Sequence
  Synthetic polynucleotide encoding artificial human antibody CDR-L3 region
caggtgtgggatagtaataatgatcaccgggaggtg

SEQ ID NO: 4124 - DNA, 27 bp, Artificial Sequence
  Synthetic polynucleotide encoding artificial human antibody CDR-L3 region
caacagtatgatagttatcctctctct

SEQ ID NO: 4125 - DNA, 27 bp, Artificial Sequence
  Synthetic polynucleotide encoding artificial human antibody CDR-L3 region
ctacaacatgataatttcccgtacact

SEQ ID NO: 4126 - DNA, 27 bp, Artificial Sequence
  Synthetic polynucleotide encoding artificial human antibody CDR-L3 region
cagcaatacggcagttcaccgctcacc

SEQ ID NO: 4127 - DNA, 33 bp, Artificial Sequence
  Synthetic polynucleotide encoding artificial human antibody CDR-L3 region
tactcaacagacagcagtggtaatcatggggtg

SEQ ID NO: 4128 - DNA, 27 bp, Artificial Sequence
  Synthetic polynucleotide encoding artificial human antibody CDR-L3 region
atgcaagctctacaaactcctaacact

SEQ ID NO: 4129 - DNA, 33 bp, Artificial Sequence
  Synthetic polynucleotide encoding artificial human antibody CDR-L3 region
aactcatattcaagcagcagcactctttatgtc

SEQ ID NO: 4130 - DNA, 30 bp, Artificial Sequence
  Synthetic polynucleotide encoding artificial human antibody CDR-L3 region
caacaacatagcaactggcctgagctcact

SEQ ID NO: 4131 - DNA, 30 bp, Artificial Sequence
  Synthetic polynucleotide encoding artificial human antibody CDR-L3 region
agctcgtatagaagcagcggcgtttatgtc

SEQ ID NO: 4132 - DNA, 27 bp, Artificial Sequence
  Synthetic polynucleotide encoding artificial human antibody CDR-L3 region
atgcaaagtatacaccttccgtacact

SEQ ID NO: 4133 - DNA, 30 bp, Artificial Sequence
  Synthetic polynucleotide encoding artificial human antibody CDR-L3 region
caccagtatggtggctcacctccaaacact

SEQ ID NO: 4134 - DNA, 30 bp, Artificial Sequence
  Synthetic polynucleotide encoding artificial human antibody CDR-L3 region
caacaacttaatagttaccctccactcact

SEQ ID NO: 4135 - DNA, 33 bp, Artificial Sequence
  Synthetic polynucleotide encoding artificial human antibody CDR-L3 region
gcaacatgggatagcagcctgactgctggggtg

SEQ ID NO: 4136 - DNA, 27 bp, Artificial Sequence
  Synthetic polynucleotide encoding artificial human antibody CDR-L3 region
cagcagcgtagcgcctggcctatcact

SEQ ID NO: 4137 - DNA, 30 bp, Artificial Sequence
  Synthetic polynucleotide encoding artificial human antibody CDR-L3 region
cagcagtatggtagctcacggaagctcact

SEQ ID NO: 4138 - DNA, 27 bp, Artificial Sequence
  Synthetic polynucleotide encoding artificial human antibody CDR-L3 region
caacactatgacagttatccgtggacg

SEQ ID NO: 4139 - DNA, 33 bp, Artificial Sequence
  Synthetic polynucleotide encoding artificial human antibody CDR-L3 region
tgttcccgggacagcagtggtaacccttgggta

SEQ ID NO: 4140 - DNA, 27 bp, Artificial Sequence
  Synthetic polynucleotide encoding artificial human antibody CDR-L3 region
caacagagttacagcacgtcgctcact

SEQ ID NO: 4141 - DNA, 33 bp, Artificial Sequence
  Synthetic polynucleotide encoding artificial human antibody CDR-L3 region
cagcagtatgatagctcacctcccatgtacact

SEQ ID NO: 4142 - DNA, 36 bp, Artificial Sequence
  Synthetic polynucleotide encoding artificial human antibody CDR-L3 region
ggaacatgggatagcagcctgagtcctgggggggta

SEQ ID NO: 4143 - DNA, 24 bp, Artificial Sequence
  Synthetic polynucleotide encoding artificial human antibody CDR-L3 region
caacagagttacaatgcccggacg

SEQ ID NO: 4144 - DNA, 30 bp, Artificial Sequence
  Synthetic polynucleotide encoding artificial human antibody CDR-L3 region
cagcaatattatgatactgctccgctcact

SEQ ID NO: 4145 - DNA, 27 bp, Artificial Sequence
  Synthetic polynucleotide encoding artificial human antibody CDR-L3 region
cagcagtatagtaaatggcccatcacc

SEQ ID NO: 4146 - DNA, 27 bp, Artificial Sequence
  Synthetic polynucleotide encoding artificial human antibody CDR-L3 region
caacagacttacactacccctaggacg

SEQ ID NO: 4147 - DNA, 33 bp, Artificial Sequence
  Synthetic polynucleotide encoding artificial human antibody CDR-L3 region
cagtcctatgacagccgcctgagtggtgtggta

SEQ ID NO: 4148 - DNA, 27 bp, Artificial Sequence
  Synthetic polynucleotide encoding artificial human antibody CDR-L3 region
cagcagtatactaccaggcctctcact

SEQ ID NO: 4149 - DNA, 27 bp, Artificial Sequence
  Synthetic polynucleotide encoding artificial human antibody CDR-L3 region
caacagcggagcaagtggcctctcact

SEQ ID NO: 4150 - DNA, 36 bp, Artificial Sequence
  Synthetic polynucleotide encoding artificial human antibody CDR-L3 region
gcaacatgggatgacagcctgggtggccgtgtggtt

SEQ ID NO: 4151 - DNA, 27 bp, Artificial Sequence
  Synthetic polynucleotide encoding artificial human antibody CDR-L3 region
atgcaacgtatagagtttcctttcact

SEQ ID NO: 4152 - DNA, 27 bp, Artificial Sequence
  Synthetic polynucleotide encoding artificial human antibody CDR-L3 region
caggcgtgggacagcagcactgcggta

SEQ ID NO: 4153 - DNA, 27 bp, Artificial Sequence
  Synthetic polynucleotide encoding artificial human antibody CDR-L3 region
cagtcgtgggacagtagttctgtgcta

SEQ ID NO: 4154 - DNA, 27 bp, Artificial Sequence
  Synthetic polynucleotide encoding artificial human antibody CDR-L3 region
cagcaatattatggtcgtctattcact

SEQ ID NO: 4155 - DNA, 33 bp, Artificial Sequence
  Synthetic polynucleotide encoding artificial human antibody CDR-L3 region
cagcagcgtagcaactggcctccgaggctccct

SEQ ID NO: 4156 - DNA, 30 bp, Artificial Sequence
  Synthetic polynucleotide encoding artificial human antibody CDR-L3 region
cagcagcgtagcaactggcctccgtacact

SEQ ID NO: 4157 - DNA, 27 bp, Artificial Sequence
  Synthetic polynucleotide encoding artificial human antibody CDR-L3 region
atgcaagctctacaaactccgtacact

SEQ ID NO: 4158 - DNA, 27 bp, Artificial Sequence
  Synthetic polynucleotide encoding artificial human antibody CDR-L3 region
caacactatgatagttatattggaacg

SEQ ID NO: 4159 - DNA, 33 bp, Artificial Sequence
  Synthetic polynucleotide encoding artificial human antibody CDR-L3 region
ggaacatgggatagcagtttgggtggcggagtg

SEQ ID NO: 4160 - DNA, 30 bp, Artificial Sequence; identical to SEQ ID NO: 4156
  Synthetic polynucleotide encoding artificial human antibody CDR-L3 region

SEQ ID NO: 4161 - DNA, 27 bp, Artificial Sequence
  Synthetic polynucleotide encoding artificial human antibody CDR-L3 region
atggaagctgaacaaactccggggact

SEQ ID NO: 4162 - DNA, 30 bp, Artificial Sequence
  Synthetic polynucleotide encoding artificial human antibody CDR-L3 region
agctcatatacaagcagcaccactgtgctt

SEQ ID NO: 4163 - DNA, 30 bp, Artificial Sequence
  Synthetic polynucleotide encoding artificial human antibody CDR-L3 region
atgcaaggtacacactggcctccgatcacc

SEQ ID NO: 4164 - DNA, 27 bp, Artificial Sequence
  Synthetic polynucleotide encoding artificial human antibody CDR-L3 region
caccagacttacagtacccggctcact

SEQ ID NO: 4165 - DNA, 27 bp, Artificial Sequence
  Synthetic polynucleotide encoding artificial human antibody CDR-L3 region
caacagtatgataatctcccgctcact

SEQ ID NO: 4166 - DNA, 33 bp, Artificial Sequence
  Synthetic polynucleotide encoding artificial human antibody CDR-L3 region
caggtgtgggatagcagtagtgatccttgggtg

SEQ ID NO: 4167 - DNA, 30 bp, Artificial Sequence
  Synthetic polynucleotide encoding artificial human antibody CDR-L3 region
caacaactgaatagttaccctccggtcacc

SEQ ID NO: 4168 - DNA, 27 bp, Artificial Sequence
  Synthetic polynucleotide encoding artificial human antibody CDR-L3 region
caacagagttacagtaccccgtacact

SEQ ID NO: 4169 - DNA, 30 bp, Artificial Sequence
  Synthetic polynucleotide encoding artificial human antibody CDR-L3 region
caacagtatagtagttcttctccaagaacg

SEQ ID NO: 4170 - DNA, 27 bp, Artificial Sequence
  Synthetic polynucleotide encoding artificial human antibody CDR-L3 region
atgcaaagtttacaacttccgattacc

SEQ ID NO: 4171 - DNA, 30 bp, Artificial Sequence
  Synthetic polynucleotide encoding artificial human antibody CDR-L3 region
caacagagttacagtacccgtttactcact

SEQ ID NO: 4172 - DNA, 33 bp, Artificial Sequence
  Synthetic polynucleotide encoding artificial human antibody CDR-L3 region
cagtcctttgacagcagcctgagaggttatgtc

SEQ ID NO: 4173 - DNA, 33 bp, Artificial Sequence
  Synthetic polynucleotide encoding artificial human antibody CDR-L3 region
cagcaccgtatcacctggcctcccctgatcacc

SEQ ID NO: 4174 - DNA, 27 bp, Artificial Sequence
  Synthetic polynucleotide encoding artificial human antibody CDR-L3 region
cagcaatatgcttatgtaccgatcacc

SEQ ID NO: 4175 - DNA, 27 bp, Artificial Sequence
  Synthetic polynucleotide encoding artificial human antibody CDR-L3 region
cagcaatattatagtattcccctcact

SEQ ID NO: 4176 - DNA, 27 bp, Artificial Sequence
  Synthetic polynucleotide encoding artificial human antibody CDR-L3 region
cagcagtatggtagctcacccctgtgg

SEQ ID NO: 4177 - DNA, 30 bp, Artificial Sequence
  Synthetic polynucleotide encoding artificial human antibody CDR-L3 region
agctcatatacaagcagcagcactcaagtc

SEQ ID NO: 4178 - DNA, 33 bp, Artificial Sequence
  Synthetic polynucleotide encoding artificial human antibody CDR-L3 region
tactcaacagacagcagtggtaatcatagggtg

SEQ ID NO: 4179 - DNA, 30 bp, Artificial Sequence
  Synthetic polynucleotide encoding artificial human antibody CDR-L3 region
cagcagtataataactggcctcagtacact

SEQ ID NO: 4180 - DNA, 33 bp, Artificial Sequence
  Synthetic polynucleotide encoding artificial human antibody CDR-L3 region
cagcactttcgtagctcacctcccacgtacact

SEQ ID NO: 4181 - DNA, 30 bp, Artificial Sequence
  Synthetic polynucleotide encoding artificial human antibody CDR-L3 region
agctcatattcaaggaccaccactctcgta

SEQ ID NO: 4182 - DNA, 36 bp, Artificial Sequence
  Synthetic polynucleotide encoding artificial human antibody CDR-L3 region
cagtcctatgacagcggcctgagtgctccttgggtg

SEQ ID NO: 4183 - DNA, 27 bp, Artificial Sequence
  Synthetic polynucleotide encoding artificial human antibody CDR-L3 region
cagcaatatggtaactcacctcccact

SEQ ID NO: 4184 - DNA, 33 bp, Artificial Sequence
  Synthetic polynucleotide encoding artificial human antibody CDR-L3 region
gcaacctgggatgacgacctgagtggtccggtc

SEQ ID NO: 4185 - DNA, 27 bp, Artificial Sequence
  Synthetic polynucleotide encoding artificial human antibody CDR-L3 region
ctacaacatgatactttccctctgacg

SEQ ID NO: 4186 - DNA, 27 bp, Artificial Sequence
  Synthetic polynucleotide encoding artificial human antibody CDR-L3 region
caacagtataatagttattcgtggacg

SEQ ID NO: 4187 - DNA, 27 bp, Artificial Sequence
  Synthetic polynucleotide encoding artificial human antibody CDR-L3 region
caacaccttactagtttcccgtacact

SEQ ID NO: 4188 - DNA, 33 bp, Artificial Sequence
  Synthetic polynucleotide encoding artificial human antibody CDR-L3 region
ggctcccgggacagtagtggtaacccttctgtc

SEQ ID NO: 4189 - DNA, 27 bp, Artificial Sequence
  Synthetic polynucleotide encoding artificial human antibody CDR-L3 region
cagcagcgtagcaactggctgtacact

SEQ ID NO: 4190 - DNA, 36 bp, Artificial Sequence
  Synthetic polynucleotide encoding artificial human antibody CDR-L3 region
caggtgtgggatagtagtagtgatcatcaagaggta

SEQ ID NO: 4191 - DNA, 30 bp, Artificial Sequence
  Synthetic polynucleotide encoding artificial human antibody CDR-L3 region
tgctcatatgcacctagtaacacttatgtc

SEQ ID NO: 4192 - DNA, 27 bp, Artificial Sequence
  Synthetic polynucleotide encoding artificial human antibody CDR-L3 region
cagcagcgtagcaactggcctctcact

SEQ ID NO: 4193 - DNA, 36 bp, Artificial Sequence
  Synthetic polynucleotide encoding artificial human antibody CDR-L3 region
aactcccgagacagcagtgctcatgaccatctgtta

SEQ ID NO: 4194 - DNA, 30 bp, Artificial Sequence
  Synthetic polynucleotide encoding artificial human antibody CDR-L3 region
caacactttggtgactcacccttgtacatt

SEQ ID NO: 4195 - DNA, 27 bp, Artificial Sequence
  Synthetic polynucleotide encoding artificial human antibody CDR-L3 region
caggtgtgggacagcagtactgcggtg

SEQ ID NO: 4196 - DNA, 33 bp, Artificial Sequence
  Synthetic polynucleotide encoding artificial human antibody CDR-L3 region
caggtgtgggatagtagtagtgatcatgtggta

SEQ ID NO: 4197 - DNA, 33 bp, Artificial Sequence
  Synthetic polynucleotide encoding artificial human antibody CDR-L3 region
caatcagcagacagcagtggtttttatgtggta

SEQ ID NO: 4198 - DNA, 27 bp, Artificial Sequence
  Synthetic polynucleotide encoding artificial human antibody CDR-L3 region
caatcagcagacagcagtagtcccgtg

SEQ ID NO: 4199 - DNA, 30 bp, Artificial Sequence
  Synthetic polynucleotide encoding artificial human antibody CDR-L3 region
tactcaacagacagtagggctaccggggtt

SEQ ID NO: 4200 - DNA, 27 bp, Artificial Sequence
  Synthetic polynucleotide encoding artificial human antibody CDR-L3 region
caacagagttacagtacccctcagacg

SEQ ID NO: 4201 - DNA, 27 bp, Artificial Sequence
  Synthetic polynucleotide encoding artificial human antibody CDR-L3 region
caacagtatgaaaatctcccgctcact

SEQ ID NO: 4202 - DNA, 27 bp, Artificial Sequence
  Synthetic polynucleotide encoding artificial human antibody CDR-L3 region
caacagtttgataatctcccgctcact

SEQ ID NO: 4203 - DNA, 30 bp, Artificial Sequence
  Synthetic polynucleotide encoding artificial human antibody CDR-L3 region
tcctcatatgcaggcagctacacttgggtg

SEQ ID NO: 4204 - DNA, 27 bp, Artificial Sequence
  Synthetic polynucleotide encoding artificial human antibody CDR-L3 region
caggcgtgggacagcagcactgtggta

SEQ ID NO: 4205 - DNA, 33 bp, Artificial Sequence
  Synthetic polynucleotide encoding artificial human antibody CDR-L3 region
ggaacatgggatagcagcctgggtgcttatgtc

SEQ ID NO: 4206 - DNA, 24 bp, Artificial Sequence
  Synthetic polynucleotide encoding artificial human antibody CDR-L3 region
cagcagtatggtagctcactcact

SEQ ID NO: 4207 - DNA, 27 bp, Artificial Sequence
  Synthetic polynucleotide encoding artificial human antibody CDR-L3 region
cagcagtatggtagctcacctctcact

SEQ ID NO: 4208 - DNA, 30 bp, Artificial Sequence
  Synthetic polynucleotide encoding artificial human antibody CDR-L3 region
agctcatatacaagcagcaggagtctggtg

SEQ ID NO: 4209 - DNA, 27 bp, Artificial Sequence
  Synthetic polynucleotide encoding artificial human antibody CDR-L3 region
caacagacttacagcaccccgtggacg

SEQ ID NO: 4210 - DNA, 24 bp, Artificial Sequence
  Synthetic polynucleotide encoding artificial human antibody CDR-L3 region
caacaatataataattggctcact

SEQ ID NO: 4211 - DNA, 27 bp, Artificial Sequence
  Synthetic polynucleotide encoding artificial human antibody CDR-L3 region
tactctacgcctgacaacaatggggtg

SEQ ID NO: 4212 - DNA, 30 bp, Artificial Sequence
  Synthetic polynucleotide encoding artificial human antibody CDR-L3 region
agctcatatacaacctccaacagtgtggtg

SEQ ID NO: 4213 - DNA, 27 bp, Artificial Sequence
  Synthetic polynucleotide encoding artificial human antibody CDR-L3 region
cagcagtatgataactcacctctcact

SEQ ID NO: 4214 - DNA, 27 bp, Artificial Sequence
  Synthetic polynucleotide encoding artificial human antibody CDR-L3 region
cagcaatattggggtactccgtacact

SEQ ID NO: 4215 - DNA, 30 bp, Artificial Sequence
  Synthetic polynucleotide encoding artificial human antibody CDR-L3 region
cagtcctatgacagtggcctgggggtggta

SEQ ID NO: 4216 - DNA, 30 bp, Artificial Sequence
  Synthetic polynucleotide encoding artificial human antibody CDR-L3 region
agctcatatgcaggcatcaacaatttggtt

SEQ ID NO: 4217 - DNA, 27 bp, Artificial Sequence
  Synthetic polynucleotide encoding artificial human antibody CDR-L3 region
caacagtataatagttattctcagacg

SEQ ID NO: 4218 - DNA, 27 bp, Artificial Sequence
  Synthetic polynucleotide encoding artificial human antibody CDR-L3 region
cagcagtatactgactggccgtacact

SEQ ID NO: 4219 - DNA, 24 bp, Artificial Sequence
  Synthetic polynucleotide encoding artificial human antibody CDR-L3 region
cagacctggggcactgttggcgtg

SEQ ID NO: 4220 - DNA, 27 bp, Artificial Sequence
  Synthetic polynucleotide encoding artificial human antibody CDR-L3 region
cagcagtatggtagctcaccgtggacg

SEQ ID NO: 4221 - DNA, 33 bp, Artificial Sequence
  Synthetic polynucleotide encoding artificial human antibody CDR-L3 region
cagtcttatgacagcagcctgagtggttatgtc

SEQ ID NO: 4222 - DNA, 33 bp, Artificial Sequence
  Synthetic polynucleotide encoding artificial human antibody CDR-L3 region
cagtgttttgacaccagcctgactgcaaaggtg

SEQ ID NO: 4223 - DNA, 27 bp, Artificial Sequence
  Synthetic polynucleotide encoding artificial human antibody CDR-L3 region
atgcaagctctacaagttcctcggacg

SEQ ID NO: 4224 - DNA, 27 bp, Artificial Sequence
  Synthetic polynucleotide encoding artificial human antibody CDR-L3 region
caacaacttaatagttacccgctcact

SEQ ID NO: 4225 - DNA, 33 bp, Artificial Sequence
  Synthetic polynucleotide encoding artificial human antibody CDR-L3 region
gcagcatgggatgacagcctgagtggtccggtg

SEQ ID NO: 4226 - DNA, 27 bp, Artificial Sequence
  Synthetic polynucleotide encoding artificial human antibody CDR-L3 region
atgcaagctctgcaaactccgtggacg

SEQ ID NO: 4227 - DNA, 36 bp, Artificial Sequence
  Synthetic polynucleotide encoding artificial human antibody CDR-L3 region
aactcccgggacagcagtgatgaccatctggaagta

SEQ ID NO: 4228 - DNA, 27 bp, Artificial Sequence
  Synthetic polynucleotide encoding artificial human antibody CDR-L3 region
caacagtataatagttacccgaggacg

SEQ ID NO: 4229 - DNA, 27 bp, Artificial Sequence
  Synthetic polynucleotide encoding artificial human antibody CDR-L3 region
cagcaatattttactactcctcgcacg

SEQ ID NO: 4230 - DNA, 36 bp, Artificial Sequence
  Synthetic polynucleotide encoding artificial human antibody CDR-L3 region
gcagcatgggatgacggcctgggtggcctttatgtg

SEQ ID NO: 4231 - DNA, 24 bp, Artificial Sequence
  Synthetic polynucleotide encoding artificial human antibody CDR-L3 region
caacagtataatagggggtccact

SEQ ID NO: 4232 - DNA, 33 bp, Artificial Sequence
  Synthetic polynucleotide encoding artificial human antibody CDR-L3 region
caggtgtgggacaggaatagtcatcgtgtgatt

SEQ ID NO: 4233 - DNA, 33 bp, Artificial Sequence
  Synthetic polynucleotide encoding artificial human antibody CDR-L3 region
cagtcctatgacaacagtctgagtgcttgggtg

SEQ ID NO: 4234 - DNA, 33 bp, Artificial Sequence
  Synthetic polynucleotide encoding artificial human antibody CDR-L3 region
aactcccgggacagcagtggtaaccattgggtg

SEQ ID NO: 4235 - DNA, 33 bp, Artificial Sequence
  Synthetic polynucleotide encoding artificial human antibody CDR-L3 region
agctcatatataaggagcagcactcctgtggta

SEQ ID NO: 4236 - DNA, 27 bp, Artificial Sequence
  Synthetic polynucleotide encoding artificial human antibody CDR-L3 region
cagcagtattatgatactccctacact

SEQ ID NO: 4237 - DNA, 30 bp, Artificial Sequence
  Synthetic polynucleotide encoding artificial human antibody CDR-L3 region
agctcatatacaagcagcagcactctggtg

SEQ ID NO: 4238 - DNA, 24 bp, Artificial Sequence
  Synthetic polynucleotide encoding artificial human antibody CDR-L3 region
caacagtatgataatctctggacg

SEQ ID NO: 4239 - DNA, 36 bp, Artificial Sequence
  Synthetic polynucleotide encoding artificial human antibody CDR-L3 region
caggtgtgggatagtagtagtgatcatctttatgtc

SEQ ID NO: 4240 - DNA, 27 bp, Artificial Sequence
  Synthetic polynucleotide encoding artificial human antibody CDR-L3 region
caccagtatggtagctcaccaaggacg

SEQ ID NO: 4241 - DNA, 36 bp, Artificial Sequence
  Synthetic polynucleotide encoding artificial human antibody CDR-L3 region
ggaacatgggacagcagcctgactggtggttttgtc

SEQ ID NO: 4242 - DNA, 33 bp, Artificial Sequence
  Synthetic polynucleotide encoding artificial human antibody CDR-L3 region
caggtgtgggacacttctaatgatgtgggggtg

SEQ ID NO: 4243 - DNA, 27 bp, Artificial Sequence
  Synthetic polynucleotide encoding artificial human antibody CDR-L3 region
cagcagtatggtagctcacctccgact

SEQ ID NO: 4244 - DNA, 30 bp, Artificial Sequence
  Synthetic polynucleotide encoding artificial human antibody CDR-L3 region
tgctcatatgcaggtagtagcaattgggtg

SEQ ID NO: 4245 - DNA, 24 bp, Artificial Sequence
  Synthetic polynucleotide encoding artificial human antibody CDR-L3 region
atgcaaggtacacactggtccgct

SEQ ID NO: 4246 - DNA, 33 bp, Artificial Sequence
  Synthetic polynucleotide encoding artificial human antibody CDR-L3 region
gcagcatgggatgacagcctgagtggtcaggtg

SEQ ID NO: 4247 - DNA, 30 bp, Artificial Sequence
  Synthetic polynucleotide encoding artificial human antibody CDR-L3 region
aactcccgggacagcagtggtaaccatgtc

SEQ ID NO: 4248 - DNA, 24 bp, Artificial Sequence
  Synthetic polynucleotide encoding artificial human antibody CDR-L3 region
caacagagttacagtactcccacc

SEQ ID NO: 4249 - DNA, 33 bp, Artificial Sequence
  Synthetic polynucleotide encoding artificial human antibody CDR-L3 region
caggtgtgggaaagtggtggtgatcatccggtg

SEQ ID NO: 4250 - DNA, 27 bp, Artificial Sequence
  Synthetic polynucleotide encoding artificial human antibody CDR-L3 region
ctacagcataataattacccgttgacg

SEQ ID NO: 4251 - DNA, 27 bp, Artificial Sequence
  Synthetic polynucleotide encoding artificial human antibody CDR-L3 region
caacagtataatagttatccgtacact

SEQ ID NO: 4252 - DNA, 27 bp, Artificial Sequence
  Synthetic polynucleotide encoding artificial human antibody CDR-L3 region
atgcaagctctacagatcccccggacg

SEQ ID NO: 4253 - DNA, 27 bp, Artificial Sequence
  Synthetic polynucleotide encoding artificial human antibody CDR-L3 region
caggcgtgggacagcaacgtccatgtc

SEQ ID NO: 4254 - DNA, 33 bp, Artificial Sequence
  Synthetic polynucleotide encoding artificial human antibody CDR-L3 region
tactcaacagacagcagtggtaatgtctgggtg

SEQ ID NO: 4255 - DNA, 33 bp, Artificial Sequence
  Synthetic polynucleotide encoding artificial human antibody CDR-L3 region
aactcccgggacagcagtggtaacctttatgtc

SEQ ID NO: 4256 - DNA, 27 bp, Artificial Sequence
  Synthetic polynucleotide encoding artificial human antibody CDR-L3 region
cagcaatattatagtagtcctctcact

SEQ ID NO: 4257 - DNA, 30 bp, Artificial Sequence
  Synthetic polynucleotide encoding artificial human antibody CDR-L3 region
atgcaagctctacaaactcccccgtacact

SEQ ID NO: 4258 - DNA, 30 bp, Artificial Sequence
  Synthetic polynucleotide encoding artificial human antibody CDR-L3 region
agctcatatacaagcagcagcacttgggtg

SEQ ID NO: 4259 - DNA, 27 bp, Artificial Sequence
  Synthetic polynucleotide encoding artificial human antibody CDR-L3 region
cagcaaagttacagtactccgtacacc

SEQ ID NO: 4260 - DNA, 33 bp, Artificial Sequence
  Synthetic polynucleotide encoding artificial human antibody CDR-L3 region
tgctcatatgcaggtagtagcactccttgggtg

SEQ ID NO: 4261 - DNA, 33 bp, Artificial Sequence
  Synthetic polynucleotide encoding artificial human antibody CDR-L3 region
tactcaccagacagcagtggtaatgtttgggtg

SEQ ID NO: 4262 - DNA, 15 bp, Artificial Sequence
  Synthetic polynucleotide encoding artificial human antibody CDR-L3 region
cagtcccggggcact

SEQ ID NO: 4263 - DNA, 27 bp, Artificial Sequence
  Synthetic polynucleotide encoding artificial human antibody CDR-L3 region
cagcagtatggtagctcacattacact

SEQ ID NO: 4264 - DNA, 36 bp, Artificial Sequence
  Synthetic polynucleotide encoding artificial human antibody CDR-L3 region
caggtgtgggatagtagtagtgatcatccttgggtg

SEQ ID NO: 4265 - DNA, 33 bp, Artificial Sequence
  Synthetic polynucleotide encoding artificial human antibody CDR-L3 region
tgctcgtatagaagtagtacggctcccgtggtc

SEQ ID NO: 4266 - DNA, 27 bp, Artificial Sequence
  Synthetic polynucleotide encoding artificial human antibody CDR-L3 region
cagcaatattttagtactccgtggacg

SEQ ID NO: 4267 - DNA, 33 bp, Artificial Sequence
  Synthetic polynucleotide encoding artificial human antibody CDR-L3 region
caggtgtgggatggttatagtgatccattggta

SEQ ID NO: 4268 - DNA, 27 bp, Artificial Sequence
  Synthetic polynucleotide encoding artificial human antibody CDR-L3 region
caacagagttactatacccctcccact

SEQ ID NO: 4269 - DNA, 36 bp, Artificial Sequence
  Synthetic polynucleotide encoding artificial human antibody CDR-L3 region
gcagcatgggatgacagcctgaatgggctttgggtg

SEQ ID NO: 4270 - DNA, 30 bp, Artificial Sequence
  Synthetic polynucleotide encoding artificial human antibody CDR-L3 region
cagtcttctgacagcaacaatcatgtggtc

SEQ ID NO: 4271 - DNA, 33 bp, Artificial Sequence
  Synthetic polynucleotide encoding artificial human antibody CDR-L3 region
cagtcctatgacagcagcctgagtggtgtgcta

SEQ ID NO: 4272 - DNA, 27 bp, Artificial Sequence
  Synthetic polynucleotide encoding artificial human antibody CDR-L3 region
caacagagttacagtacccccttcact

SEQ ID NO: 4273 - DNA, 27 bp, Artificial Sequence
  Synthetic polynucleotide encoding artificial human antibody CDR-L3 region
caacagtatgatagtctccctctcact

SEQ ID NO: 4274 - DNA, 30 bp, Artificial Sequence
  Synthetic polynucleotide encoding artificial human antibody CDR-L3 region
cagtactatggtggctcaccgggattcact

SEQ ID NO: 4275 - DNA, 30 bp, Artificial Sequence
  Synthetic polynucleotide encoding artificial human antibody CDR-L3 region
tgctcatatgcaggtagtagcacttatgtc

SEQ ID NO: 4276 - DNA, 30 bp, Artificial Sequence
  Synthetic polynucleotide encoding artificial human antibody CDR-L3 region
caggagtatgttaaatcacctggattcgct

SEQ ID NO: 4277 - DNA, 27 bp, Artificial Sequence
  Synthetic polynucleotide encoding artificial human antibody CDR-L3 region
cagcagtatggtacttcacctcagacg

SEQ ID NO: 4278 - DNA, 30 bp, Artificial Sequence
  Synthetic polynucleotide encoding artificial human antibody CDR-L3 region
atgttgtatatgggtagtggcatttcgctc

SEQ ID NO: 4279 - DNA, 36 bp, Artificial Sequence
  Synthetic polynucleotide encoding artificial human antibody CDR-L3 region
cagtccaatgacatcagcctgagtggttctgtggta

SEQ ID NO: 4280 - DNA, 33 bp, Artificial Sequence
  Synthetic polynucleotide encoding artificial human antibody CDR-L3 region
caatcctatgacaatagcctgagtgggggggtg

SEQ ID NO: 4281 - DNA, 27 bp, Artificial Sequence
  Synthetic polynucleotide encoding artificial human antibody CDR-L3 region
cagcagtttgatatttcacccttcact

SEQ ID NO: 4282 - DNA, 30 bp, Artificial Sequence
  Synthetic polynucleotide encoding artificial human antibody CDR-L3 region
agctcatatacaagcagcagctccttggtg

SEQ ID NO: 4283 - DNA, 30 bp, Artificial Sequence
  Synthetic polynucleotide encoding artificial human antibody CDR-L3 region
tgctcatttacaggtactagcacttttgtc

SEQ ID NO: 4284 - DNA, 27 bp, Artificial Sequence
  Synthetic polynucleotide encoding artificial human antibody CDR-L3 region
cagcaatattatagtactccgtacact

SEQ ID NO: 4285 - DNA, 33 bp, Artificial Sequence
  Synthetic polynucleotide encoding artificial human antibody CDR-L3 region
gcaacatgggatgacagcctgaatggaggggtg

SEQ ID NO: 4286 - DNA, 27 bp, Artificial Sequence
  Synthetic polynucleotide encoding artificial human antibody CDR-L3 region
tggctcatctctggtggtgcccctgta

SEQ ID NO: 4287 - DNA, 33 bp, Artificial Sequence
  Synthetic polynucleotide encoding artificial human antibody CDR-L3 region
cagtcctttgacagcagcctgagtcgttctgtc

SEQ ID NO: 4288 - DNA, 27 bp, Artificial Sequence
  Synthetic polynucleotide encoding artificial human antibody CDR-L3 region
cagcagcgtaacaactggcctatcact

SEQ ID NO: 4289 - DNA, 27 bp, Artificial Sequence
  Synthetic polynucleotide encoding artificial human antibody CDR-L3 region
ctacaagattacaattaccctccgacg

SEQ ID NO: 4290 - DNA, 33 bp, Artificial Sequence
  Synthetic polynucleotide encoding artificial human antibody CDR-L3 region
aactcccgggacagcagcggtcaccattgggtg

SEQ ID NO: 4291 - DNA, 27 bp, Artificial Sequence
  Synthetic polynucleotide encoding artificial human antibody CDR-L3 region
cagcaatattattctactccatacact

SEQ ID NO: 4292 - DNA, 30 bp, Artificial Sequence
  Synthetic polynucleotide encoding artificial human antibody CDR-L3 region
atgcaaggtgcacactggcctccaatcacc

SEQ ID NO: 4293 - DNA, 30 bp, Artificial Sequence
  Synthetic polynucleotide encoding artificial human antibody CDR-L3 region
tactcaacagacactattggaaattgggtg

SEQ ID NO: 4294 - DNA, 33 bp, Artificial Sequence
  Synthetic polynucleotide encoding artificial human antibody CDR-L3 region
caggtgtgggatagtagtagtgatcattggatt

SEQ ID NO: 4295 - DNA, 27 bp, Artificial Sequence
  Synthetic polynucleotide encoding artificial human antibody CDR-L3 region
caacagagttacagtccccctctcact

SEQ ID NO: 4296 - DNA, 30 bp, Artificial Sequence
  Synthetic polynucleotide encoding artificial human antibody CDR-L3 region
cagcattatagtgactggcgagcactcact

SEQ ID NO: 4297 - DNA, 27 bp, Artificial Sequence
  Synthetic polynucleotide encoding artificial human antibody CDR-L3 region
caacaatattatggtcctctgtggacg

SEQ ID NO: 4298 - DNA, 33 bp, Artificial Sequence
  Synthetic polynucleotide encoding artificial human antibody CDR-L3 region
caatcagcagacagcagtcttacttattggctc

SEQ ID NO: 4299 - DNA, 24 bp, Artificial Sequence
  Synthetic polynucleotide encoding artificial human antibody CDR-L3 region
caacaatattccgattactccact

SEQ ID NO: 4300 - DNA, 27 bp, Artificial Sequence
  Synthetic polynucleotide encoding artificial human antibody CDR-L3 region
caccaatattatactactcctttcact

SEQ ID NO: 4301 - DNA, 27 bp, Artificial Sequence
  Synthetic polynucleotide encoding artificial human antibody CDR-L3 region
caggcgtgggacagcagcactgcagaa

SEQ ID NO: 4302 - DNA, 33 bp, Artificial Sequence
  Synthetic polynucleotide encoding artificial human antibody CDR-L3 region
gtgacatgggatgacgacctgcatggttgggtg

SEQ ID NO: 4303 - DNA, 39 bp, Artificial Sequence
  Synthetic polynucleotide encoding artificial human antibody CDR-L3 region
gcaacgtgggatagcagcctgcgtgctggccctgtagta

SEQ ID NO: 4304 - DNA, 27 bp, Artificial Sequence
  Synthetic polynucleotide encoding artificial human antibody CDR-L3 region
caacagtacaatgcttacccggtcact

SEQ ID NO: 4305 - DNA, 27 bp, Artificial Sequence
  Synthetic polynucleotide encoding artificial human antibody CDR-L3 region
caacaatattatagtactccgtggacg

SEQ ID NO: 4306 - DNA, 27 bp, Artificial Sequence
  Synthetic polynucleotide encoding artificial human antibody CDR-L3 region
cagcaatattatagtcctcctctcact

SEQ ID NO: 4307 - DNA, 30 bp, Artificial Sequence
  Synthetic polynucleotide encoding artificial human antibody CDR-L3 region
tgctcatatacaagcagcctcacttatgtc

SEQ ID NO: 4308 - DNA, 27 bp, Artificial Sequence
  Synthetic polynucleotide encoding artificial human antibody CDR-L3 region
atgcaaggtacacactggccgtacact

SEQ ID NO: 4309 - DNA, 27 bp, Artificial Sequence
  Synthetic polynucleotide encoding artificial human antibody CDR-L3 region
caggcgtgggacagcagcacttatgtc

SEQ ID NO: 4310 - DNA, 30 bp, Artificial Sequence
  Synthetic polynucleotide encoding artificial human antibody CDR-L3 region
cagcagtatggtggctcacctctattcact

SEQ ID NO: 4311 - DNA, 27 bp, Artificial Sequence
  Synthetic polynucleotide encoding artificial human antibody CDR-L3 region
cagacgtgggacagcagcactgtgata

SEQ ID NO: 4312 - DNA, 27 bp, Artificial Sequence
  Synthetic polynucleotide encoding artificial human antibody CDR-L3 region
atgcaagctctacaaactccgtacact

SEQ ID NO: 4313 - DNA, 33 bp, Artificial Sequence
  Synthetic polynucleotide encoding artificial human antibody CDR-L3 region
ggaacatgggatagcagtctgagtgctggcgtc

SEQ ID NO: 4314 - DNA, 24 bp, Artificial Sequence
  Synthetic polynucleotide encoding artificial human antibody CDR-L3 region
caacagtataatagttattggacg

SEQ ID NO: 4315 - DNA, 27 bp, Artificial Sequence
  Synthetic polynucleotide encoding artificial human antibody CDR-L3 region
caacagtataatagttatccgtggacg

SEQ ID NO: 4316 - DNA, 36 bp, Artificial Sequence
  Synthetic polynucleotide encoding artificial human antibody CDR-L3 region
cagtcctatgacagcagcctgagtggttcaggggtg

SEQ ID NO: 4317 - DNA, 30 bp, Artificial Sequence
  Synthetic polynucleotide encoding artificial human antibody CDR-L3 region
caatcagcagacagcagtggtacttatgtc

SEQ ID NO: 4318 - DNA, 27 bp, Artificial Sequence
  Synthetic polynucleotide encoding artificial human antibody CDR-L3 region
caacaggctcacggtttcccaatcact

SEQ ID NO: 4319 - DNA, 24 bp, Artificial Sequence
  Synthetic polynucleotide encoding artificial human antibody CDR-L3 region
cagcagtataatagctggcccgct

SEQ ID NO: 4320 - DNA, 27 bp, Artificial Sequence
  Synthetic polynucleotide encoding artificial human antibody CDR-L3 region
caacagagttacaataccccgtacact

SEQ ID NO: 4321 - DNA, 27 bp, Artificial Sequence
  Synthetic polynucleotide encoding artificial human antibody CDR-L3 region
caacagagttacaataccccgctcact

SEQ ID NO: 4322 - DNA, 30 bp, Artificial Sequence
  Synthetic polynucleotide encoding artificial human antibody CDR-L3 region
cagcagtatggtagctcacctccgaacagt

SEQ ID NO: 4323 - DNA, 33 bp, Artificial Sequence
  Synthetic polynucleotide encoding artificial human antibody CDR-L3 region
caggtgtgggatagtagtagtgatcatccggta

SEQ ID NO: 4324 - DNA, 30 bp, Artificial Sequence
  Synthetic polynucleotide encoding artificial human antibody CDR-L3 region
cagtcttatgatagcaacactcattgggtg

SEQ ID NO: 4325 - DNA, 27 bp, Artificial Sequence
  Synthetic polynucleotide encoding artificial human antibody CDR-L3 region
atgcaagctctagaaactcctcgcact

SEQ ID NO: 4326 - DNA, 24 bp, Artificial Sequence
  Synthetic polynucleotide encoding artificial human antibody CDR-L3 region
caacagtataatagttattcgacg

SEQ ID NO: 4327 - DNA, 27 bp, Artificial Sequence
  Synthetic polynucleotide encoding artificial human antibody CDR-L3 region
atgcaagctctacaacctccgtacact

SEQ ID NO: 4328 - DNA, 30 bp, Artificial Sequence
  Synthetic polynucleotide encoding artificial human antibody CDR-L3 region
caacagagttacagtacccctccgtggacg

SEQ ID NO: 4329 - DNA, 27 bp, Artificial Sequence
  Synthetic polynucleotide encoding artificial human antibody CDR-L3 region
cagcaatattatcttgttcccgtcacc

SEQ ID NO: 4330 - DNA, 36 bp, Artificial Sequence
  Synthetic polynucleotide encoding artificial human antibody CDR-L3 region
gcagcatgggatgacagcctgagtggcccttatgtc

SEQ ID NO: 4331 - DNA, 33 bp, Artificial Sequence
  Synthetic polynucleotide encoding artificial human antibody CDR-L3 region
agctcatatgcaggcagcaacaatttttatgtc

SEQ ID NO: 4332 - DNA, 36 bp, Artificial Sequence
  Synthetic polynucleotide encoding artificial human antibody CDR-L3 region
cagtcctatgacagcagcctgagtggttcaatgata

SEQ ID NO: 4333 - DNA, 24 bp, Artificial Sequence
  Synthetic polynucleotide encoding artificial human antibody CDR-L3 region
atgatttggtcaagccttgtggta

SEQ ID NO: 4334 - DNA, 27 bp, Artificial Sequence
  Synthetic polynucleotide encoding artificial human antibody CDR-L3 region
atgcaagctctacaaactccgtggacg

SEQ ID NO: 4335 - DNA, 27 bp, Artificial Sequence
  Synthetic polynucleotide encoding artificial human antibody CDR-L3 region
ctacaaaattacaattacccttggacg

SEQ ID NO: 4336 - DNA, 27 bp, Artificial Sequence
  Synthetic polynucleotide encoding artificial human antibody CDR-L3 region
atgcaaggtatacaccttcctaggact

SEQ ID NO: 4337 - protein, 263 aa, Homo sapiens
MRLGLCVVALVLSWTHLTISSRGIKGKRQRRISAEGSQACAKGCELCSEVNGCLKCSPKLFILLERNDIRQVGVCLPSCPPGYFDARNPDMNKCIKCKIEHCEACFSHNFCTKCKEGLYLHKGRCYPACPEGSSAANGTMECSSPAQCEMSEWSPWGPCSKKQQLCGFRRGSEERTRRVLHAPVGDHAACSDTKETRRCTVRRVPCPEGQKRRKGGQGRRENANRNLARKESKEAGAGSRRRKGQQQQQQQGTVGPLTSAGPA

SEQ ID NO: 4338 - protein, 485 aa, Homo sapiens
MYKMNICNKPSNKTAPEKSVWTAPAQPSGPSPELQGQRSRRNGWSWPPHPLQIVAWLLYLFFAVIGFGILVPLLPHHWVPAGYACMGAIFAGHLVVHLTAVSIDPADANVRDKSYAGPLPIFNRSQHAHVIEDLHCNLCNVDVSARSKHCSACNKCVCGFDHHCKWLNNCVGERNYRLFLHSVASALLGVLLLVLVATYVFVEFFVNPMRLRTNRHFEVLKNHTDVWFVFLPAAPVETQAPAILALAALLILLGLLSTALLGHLLCFHIYLMWHKLTTYEYIVQHRPPQEAKGVHRELESCPPKMRPIQEMEFYMRTFRHMRPEPPGQAGPAAVNAKHSRPASPDPTPGRRDCAGPPVQVEWDRKKPLPWRSPLLLLAMWGPQAPPCLCRKRGRGACIKCERLRPRIRRRGLGPPAAAPARRRIPRTPALCTPLALPAPTTRRRQSPWTRFQWRRRAWAAPLWPPRGAGADSPRWRGRRVRPPFS

SEQ ID NO: 4339 - protein, 462 aa, Homo sapiens
MDTKHFLPLDFSTQVNSSLTSPTGRGSMAAPSLHPSLGPGIGSPGQLHSPISTLSSPINGMGPPFSVISSPMGPHSMSVPTTPTLGFSTGSPQLSSPMNPVSSSEDIKPPLGLNGVLKVPAHPSGNMASFTKHICAICGDRSSGKHYGVYSCEGCKGFFKRTVRKDLTYTCRDNKDCLIDKRQRNRCQYCRYQKCLAMGMKREAVQEERQRGKDRNENEVESTSSANEDMPVERILEAELAVEPKTETYVEANMGLNPSSPNDPVTNICQAADKQLFTLVEWAKRIPHFSELPLDDQVILLRAGWNELLIASFSHRSIAVKDGILLATGLHVHRNSAHSAGVGAIFDRVLTELVSKMRDMQMDKTELGCLRAIVLFNPDSKGLSNPAEVEALREKVYASLEAYCKHKYPEQPGRFAKLLLRLPALRSIGLKCLEHLFFFKLIGDTPIDTFLMEMLEAPHQMT

SEQ ID NO: 4340 - protein, 463 aa, Homo sapiens
MYGNYSHFMKFPAGYGGSPGHTGSTSMSPSAALSTGKPMDSHPSYTDTPVSAPRTLSAVGTPLNALGSPYRVITSAMGPPSGALAAPPGINLVAPPSSQLNVVNSVSSSEDIKPLPGLPGIGNMNYPSTSPGSLVKHICAICGDRSSGKHYGVYSCEGCKGFFKRTIRKDLIYTCRDNKDCLIDKRQRNRCQYCRYQKCLVMGMKREAVQEERQRSRERAESEAECATSGHEDMPVERILEAELAVEPKTESYGDMNMENSTNDPVTNICHAADKQLFTLVEWAKRIPHFSDLTLEDQVILLRAGWNELLIASFSHRSVSVQDGILLATGLHVHRSSAHSAGVGSIFDRVLTELVSKMKDMQMDKSELGCLRAIVLFNPDAKGLSNPSEVETLREKVYATLEAYTKQKYPEQPGRFAKLLLRLPALRSIGLKCLEHLFFFKLIGDTPIDTFLMEMLETPLQIT

SEQ ID NO: 4341 - protein, 183 aa, Homo sapiens
MQAPRAALVFALVIALVPVGRGNYEELENSGDTTVESERPNKVTIPSTFAAVTIKETLNANINSTNFAPDENQLEFILMVLIPLILLVLLLLFVVFLATYYKRKRTKQEPSSQGSQSALQTYELGSENVKVPIFEEDTPSVMEIEMEELDKWMNSMNRNADFECLPTLKEEKESNHNPSDSES

SEQ ID NO: 4342 - protein, 136 aa, Homo sapiens
MAGAGSAAVSGAGTPVAGPTGRDLFAEGLLEFLRPAVQQLDSHVHAVRESQVELREQIDNLATELCRINEDQKVALDLDPYVKKLLNARRRVVLVNNILQNAQERLRRLNHSVAKETARRRAMLDSGIYPPGSPGK

SEQ ID NO: 4343 - protein, 847 aa, Homo sapiens
MAKPLTDQEKRRQISIRGIVGVENVAELKKSFNRHLHFTLVKDRNVATTRDYYFALAHTVRDHLVGRWIRTQQHYYDKCPKRVYYLSLEFYMGRTLQNTMINLGLQNACDEAIYQLGLDIEELEEIEEDAGLGNGGLGRLAACFLDSMATLGLAAYGYGIRYEYGIFNQKIRDGWQVEEADDWLRYGNPWEKSRPEFMLPVHFYGKVEHTNTGTKWIDTQVVLALPYDTPVPGYMNNTVNTMRLWSARAPNDFNLRDFNVGDYIQAVLDRNLAENISRVLYPNDNFFEGKELRLKQEYFVVAATLQDIIRRFKASKFGSTRGAGTVFDAFPDQVAIQLNDTHPALAIPELMRIFVDIEKLPWSKAWELTQKTFAYTNHTVLPEALERWPVDLVEKLLPRHLEIIYEINQKHLDRIVALFPKDVDRLRRMSLIEEEGSKRINMAHLCIVGSHAVNGVAKIHSDIVKTKVFKDFSELEPDKFQNKTNGITPRRWLLLCNPGLAELIAEKIGEDYVKDLSQLTKLHSFLGDDVFLRELAKVKQENKLKFSQFLETEYKVKINPSSMFDVQVKRIHEYKRQLLNCLHVITMYNRIKKDPKKLFVPRTVIIGGKAAPGYHMAKMIIKLITSVADVVNNDPMVGSKLKVIFLENYRVSLAEKVIPATDLSEQISTAGTEASGTGNMKFMLNGALTIGTMDGANVEMAEEAGEENLFIFGMRIDDVAALDKKGYEAKEYYEALPELKLVIDQIDNGFFSPKQPDLFKDIINMLFYHDRFKVFADYEAYVKCQDKVSQLYMNPKAWNTMVLKNIAASGKFSSDRTIKEYAQNIWNVEPSDLKISLSNESNKVNGN

SEQ ID NO: 4344 - protein, 328 aa, Homo sapiens
MMWRPSVLLLLLLLRHGAQGKPSPDAGPHGQGRVHQAAPLSDAPHDDAHGNFQYDHEAFLGREVAKEFDQLTPEESQARLGRIVDRMDRAGDGDGWVSLAELRAWIAHTQQRHIRDSVSAAWDTYDTDRDGRVGWEELRNATYGHYAPGEEFHDVEDAETYKKMLARDERRFRVADQDGDSMATREELTAFLHPEEFPHMRDIVIAETLEDLDRNKDGYVQVEEYIADLYSAEPGEEEPAWVQTERQQFRDFRDLNKDGHLDGSEVGHWVLPPAQDQPLVEANHLLHESDTDKDGRLSKAEILGNWNMFVGSQATNYGEDLTRHHDEL

SEQ ID NO: 4345 - protein, 421 aa, Homo sapiens
MAVDVAEYHLSVIKSPPGWEVGVYAAGALALLGIAAVSLWKLWTSGSFPSPSPFPNYDYRYLQQKYGESCAEAREKRVPAWNAQRASTRGPPSRKGSLSIEDTFESISELGPLELMGRELDLAPYGTLRKSQSADSLNSISSVSNTFGQDFTLGQVEVSMEYDTASHTLNVAVMQGKDLLEREEASFESCFMRVSLLPDEQIVGISRIQRNAYSIFFDEKFSIPLDPTALEEKSLRFSVFGIDEDERNVSTGVVELKLSVLDLPLQPFSGWLYLQDQNKAADAVGEILLSLSYLPTAERLTVVVVKAKNLIWTNDKTTADPFVKVYLLQDGRKMSKKKTAVKRDDPNPVFNEAMIFSVPAIVLQDLSLRVTVAESSSDGRGDNVGHVIIGPSASGMGTTHWNQMLATLRRPVSMWHAVRRN

SEQ ID NO: 4346 - protein, 390 aa, Homo sapiens
MAMVTGGWGDPGGDTNGVDKAGGSYPRATEDDSASPPGATSDAEPGDEERPGLQVDCVVCGDKSSGKHYGVFTCEGCKSFFKRSIRRNLSYTCRSNRDCQIDQHHRNQCQYCRLKKCFRVGMRKEAVQRGRIPHALPGPAACSPPGATGVEPFTGPPVSELIAQLLRAEPYPAAGRFGGGGAVLGIDNVCELAARLLFSTVEWARHAPFFPELPAADQVALLRLSWSELFVLNAAQAALPLHTAPLLAAAGLHAAPMAAERAVAFMDQVRAFQEQVDKLGRLQVDAAEYGCLKAIALFTPDACGLSDPAHVESLQEKAQVALTEYVRAQYPSQPQRFGRLLLRLPALRAVPASLISQLFFMRLVGKTPIETLIRDMLLSGSTFNWPYGSG

SEQ ID NO: 4347 - protein, 828 aa, Homo sapiens
MDSEAFQSARDFLDMNFQSLAMKHMDLKQMELDTAAAKVDELTKQLESLWSDSPAPPGPQAGPPSRPPRYSSSSIPEPFGSRGSPRKAATDGADTPFGRSESAPTLHPYSPLSPKGRPSSPRTPLYLQPDAYGSLDRATSPRPRAFDGAGSSLGRAPSPRPGPGPLRQQGPPTPFDFLGRAGSPRGSPLAEGPQAFFSERGPSPRPPATAYDAPASAFGSSLLGSGGSAFAPPLRAQDDLTLRRRPPKAWNESDLDVAYEKKPSQTASYERLDVFARPASPSLQLLPWRESSLDGLGGTGKDNLTSATLPRNYKVSPLASDRRSDAGSYRRSLGSAGPSGTLPRSWQPVSRIPMPPSSPQPRGAPRQRPIPLSMIFKLQNAFWEHGASRAMLPGSPLFTRAPPPKLQPQPQPQPQPQSQPQPQLPPQPQTQPQTPTPAPQHPQQTWPPVNEGPPKPPTELEPEPEIEGLLTPVLEAGDVDEGPVARPLSPTRLQPALPPEAQSVPELEEVARVLAEIPRPLKRRGSMEQAPAVALPPTHKKQYQQIISRLFHRHGGPGPGGPEPELSPITEGSEARAGPPAPAPPAPIPPPAPSQSSPPEQPQSMEMRSVLRKAGSPRKARRARLNPLVLLLDAALTGELEVVQQAVKEMNDPSQPNEEGITALHNAICGANYSIVDFLITAGANVNSPDSHGWTPLHCAASCNDTVICMALVQHGAAIFATTLSDGATAFEKCDPYREGYADCATYLADVEQSMGLMNSGAVYALWDYSAEFGDELSFREGESVTVLRRDGPEETDWWWAALHGQEGYVPRNYFGLFPRVKPQRSKV

SEQ ID NO: 4348 - protein, 317 aa, Homo sapiens
MQPYTKNWTQVTEFVMMGFAGIHEAHLLFFILFLTMYLFTLVENLAIILVVGLDHRLRRPMYFFLTHLSCLEIWYTSVTVPKMLAGFIGVDGGKNISYADCLSQLFIFTFLGATECFLLAAMAYDRYVAICMPLHYGAFVSWGTCIRLAAACWLVGFLTPILPIYLLSQLTFYGPNVIDHFSCDASPLLALSCSDVTWKETVDFLVSLAVLLASSMVIAVSYGNIVWTLLHIRSAAERWKAFSTCAAHLTVVSLFYGTLFFMYVQTKVTSSINFNKVVSVFYSVVTPMLNPLIYSLRNKEVKGALGRVFSLNFWKGQ

SEQ ID NO: 4349 - protein, 180 aa, Homo sapiens
MQAEGRGTGGSTGDADGPGGPGIPDGPGGNAGGPGEAGATGGRGPRGAGAARASGPGGGAPRGPHGGAASGLNGCCRCGARGPESRLLEFYLAMPFATPMEAELARRSLAQDAPPLPVPGVLLKEFTVSGNILTIRLTAADHRQLQLSISSCLQQLSLLMWITQCFLPVFLAQPPSGQRR

SEQ ID NO: 4350 - protein, 365 aa, Homo sapiens
MNITNCTTEASMAIRPKTITEKMLICMTLVVITTLTTLLNLAVIMAIGTTKKLHQPANYLICSLAVTDLLVAVLVMPLSIIYIVMDRWKLGYFLCEVWLSVDMTCCTCSILHLCVIALDRYWAITNAIEYARKRTAKRAALMILTVWTISIFISMPPLFWRSHRRLSPPPSQCTIQHDHVIYTIYSTLGAFYIPLTLILILYYRIYHAAKSLYQKRGSSRHLSNRSTDSQNSFASCKLTQTFCVSDFSTSDPTTEFEKFHASIRIPPFDNDLDHPGERQQISSTRERKAARILGLILGAFILSWLPFFIKELIVGLSIYTVSSEVADFLTWLGYVNSLINPLLYTSFNEDFKLAFKKLIRCREHT

SEQ ID NO: 4351 - protein, 362 aa, Homo sapiens
MKLHCCLFTLVASIIVPAAFVLEDVDFDQMVSLEANRSSYNASFPSSFELSASSHSDDDVIIAKEGTSVSIECLLTASHYEDVHWHNSKGQQLDGRSRGGKWLVSDNFLNITNVAFDDRGLYTCFVTSPIRASYSVTLRVIFTSGDMSVYYMIVCLIAFTITLILNVTRLCMMSSHLRKTEKAINEFFRTEGAEKLQKAFEIAKRIPIITSAKTLELAKVTQFKTMEFARYIEELARSVPLPPLILNCRAFVEEMFEAVRVDDPDDLGERIKERPALNAQGGIYVINPEMGRSNSPGGDSDDGSLNEQGQEIAVQVSVHLQSETKSIDTESQGSSHFSPPDDIGSAESNCNYKDGAYENCQL

SEQ ID NO: 4352 - protein, 308 aa, Homo sapiens
MKGALGSPVAAAGAAMQESFGCVVANRFHQLLDDESDPFDILREAERRRQQQLQRKRRDEAAAAAGAGPRGGRSPAGASGHRAGAGGRRESQKERKSLPAPVAQRPDSPGGGLQAPGQKRTPRRGEQQGWNDSRGPEGMLERAERRSYREYRPYETERQADFTAEKFPDEKVPELEVEEETQVQEMTLDEWKNLQEQTRPKPEFNIRKPESTVPSKAVVIHKSKYRDDMVKDDYEDDSHVFRKPANDITSQLEINFGNLPRPGRGARGGTRGGRGRIRRAENYGPRAEVVMQDVAPNPDDPEDFPALS

SEQ ID NO: 4353 - protein, 141 aa, Homo sapiens
MDIPVPSSFNDVGQDWRLRHFVDQMWYEREVTFLEQWTQDLHTRVVLRIVSAHSYAIVWVNGVDALEHEGSTSPLTPTSVACSRWGPCPPASASLSPSATCSSPPPCHQGASSTWPTPPRGYHPASTADTHLRVPPRGALH

SEQ ID NO: 4354 - protein, 340 aa, Homo sapiens
MLEAPGPSDGCELSNPSASRVSCAGQMLEVQPGLYFGGAAAVAEPDHLREAGITAVLTVDSEEPSFKAGPGVEDLWRLFVPALDKPETDLLSHLDRCVAFIGQARAEGRAVLVHCHAGVSRSVAIITAFLMKTDQLPFEKAYEKLQILKPEAKMNEGFEWQLKLYQAMGYEVDTSSAIYKQYRLQKVTEKYPELQNLPQELFAVDPTTVSQGLKDEVLYKCRKCRRSLFRSSSILDHREGSGPIAFAHKRMTPSSMLTTGRQAQCTSYFIEPVQWMESALLGVMDGQLLCPKCSAKLGSFNWYGEQCSCGRWITPAFQIHKNRVDEMKILPVLGSQTGKI

SEQ ID NO: 4355 - protein, 892 aa, Homo sapiens
MDHYDSQQTNDYMQPEEDWDRDLLLDPAWEKQQRKTFTAWCNSHLRKAGTQIENIEEDFRDGLKLMLLLEVISGERLAKPERGKMRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAFDVAEKYLDIPKMLDAEDIVGTARPDEKAIMTYVSSFYHAFSGAQKAETAANRICKVLAVNQENEQLMEDYEKLASDLLEWIRRTIPWLENRVPENTMHAMQQKLEDFRDYRRLHKPPKVQEKCQLEINFNTLQTKLRLSNRPAFMPSEGRMVSDINNAWGCLEQVEKGYEEWLLNEIRRLERLDHLAEKFRQKASIHEAWTDGKEAMLRQKDYETATLSEIKALLKKHEAFESDLAAHQDRVEQIAAIAQELNELDYYDSPSVNARCQKICDQWDNLGALTQKRREALERTEKLLETIDQLYLEYAKRAAPFNNWMEGAMEDLQDTFIVHTIEEIQGLTTAHEQFKATLPDADKERLAILGIHNEVSKIVQTYHVNMAGTNPYTTITPQEINGKWDHVRQLVPRRDQALTEEHARQQHNERLRKQFGAQANVIGPWIQTKMEEIGRISIEMHGTLEDQLSHLRQYEKSIVNYKPKIDQLEGDHQLIQEALIFDNKHTNYTMEHIRVGWEQLLTTIARTINEVENQILTRDAKGISQEQMNEFRASFNHFDRDHSGTLGPEEFKACLISLGYDIGNDPQGEAEFARIMSIVDPNRLGVVTFQAFIDFMSRETADTDTADQVMASFKILAGDKNYITMDELRRELPPDQAEYCIARMAPYTGPDSVPGALDYMSFSTALYGESDL

SEQ ID NO: 4356 - protein, 545 aa, Homo sapiens
MAREPRKNAALDAQSAEDQTGLLTVKVEKEEASALTAEVRAPCSPARGPERSRQRFRGFRYPEAAGPREALSRLRELCGQWLQPEMHSKEQILELLVLEQFLTILPGNLQSWVREQHPESGEEVVVLLEYLERQLDEPAPQVPVGDQGQELLCCKMALLTQTQGSQSSQCQPMKALFKHESLGSQPLHDRVLQVPGLAQGGCCREDAMVASRLTPGSQGLLKMEDVALTLTPGWTQLDSSQVNLYRDEKQENHSSLVSLGGEIQTKSRDLPPVKKLPEKEHGKICHLREDIAQIPTHAEAGEQEGRLQRKQKNAIGSRRHYCHECGKSFAQSSGLTKHRRIHTGEKPYECEDCGKTFIGSSALVIHQRVHTGEKPYECEECGKVFSHSSNLIKHQRTHTGEKPYECDDCGKTFSQSCSLLEHHKIHTGEKPYQCNMCGKAFRRNSHLLRHQRIHGDKNVQNPEHGESWESQGRTESQWENTEAPVSYKCNECERSFTRNRSLIEHQKIHTGEKPYQCDTCGKGFTRTSYLVQHQRSHVGKKTLSQ

SEQ ID NO: 4357 - protein, 448 aa, Homo sapiens
MALTLLEDWCKGMDMDPRKALLIVGIPMECSEVEIQDTVKAGLQPLCAYRVLGRMFRREDNAKAVFIELADTVNYTTLPSHIPGKGGSWEVVVKPRNPDDEFLSRLNYFLKDEGRSMTDVARALGCCSLPAESLDAEVMPQVRSPPLEPPKESMWYRKLKVFSGTASPSPGEETFEDWLEQVTEIMPIWQVSEVEKRRRLLESLRGPALSIMRVLQANNDSITVEQCLDALKQIFGDKEDFGASQFRFLQTSPKIGEKVSTFLLRLEPLLQKAVHKSPLSVRSTDMIRLKHLLARVAMTPALRGKLELLDQRGCPPNFLELMKLIRDEEEWENTEAVMKNKEKPSGRGRGASGRQARAEASVSAPQATVQARSFSDSSPQTIQGGLPPLVKRRRLLGSESTRGEDHGQATYPKAENQTPGREGPQAAGEELGNEAGAGAMSHPKPWET

SEQ ID NO: 4358 - protein, 621 aa, Homo sapiens [sequence omitted]

SEQ ID NO: 4359 - protein, 552 aa, Homo sapiens
MPVAATNSETAMQQVLDNLGSLPSATGAAELDLIFLRGIMESPIVRSLAKAHERLEETKLEAVRDNNLELVQEILRDLAQLAEQSSTAAELAHILQEPHFQSLLETHDSVASKTYETPPPSPGLDPTFSNQPVPPDAVRMVGIRKTAGEHLGVTFRVEGGELVIARILHGGMVAQQGLLHVGDIIKEVNGQPVGSDPRALQELLRNASGSVILKILPSYQEPHLPRQVFVKCHFDYDPARDSLIPCKEAGLRFNAGDLLQIVNQDDANWWQACHVEGGSAGLIPSQLLEEKRKAFVKRDLELTPNSGTLCGSLSGKKKKRMMYLTTKNAEFDRHELLIYEEVARMPPFRRKTLVLIGAQGVGRRSLKNKLIMWDPDRYGTTVPYTSRRPKDSEREGQGYSFVSRGEMEADVRAGRYLEHGEYEGNLYGTRIDSIRGVVAAGKVCVLDVNPQAVKVLRTAEFVPYVVFIEAPDFETLRAMNRAALESGISTKQLTEADLRRTVEESSRIQRGYGHYFDLCLVNSNLERTFRELQTAMEKLRTEPQWVPVSWVY

SEQ ID NO: 4360 - protein, 526 aa, Homo sapiens
MAVFPSSGLPRCLLTLILLQLPKLDSAPFDVIGPPEPILAVVGEDAELPCRLSPNASAEHLELRWFRKKVSPAVLVHRDGREQEAEQMPEYRGRATLVQDGIAKGRVALRIRGVRVSDDGEYTCFFREDGSYEEALVHLKVAALGSDPHISMQVQENGEICLECTSVGWYPEPQVQWRTSKGEKFPSTSESRNPDEEGLFTVAASVIIRDTSAKNVSCYIQNLLLGQEKKVEISIPASSLPRLTPWIVAVAVILMVLGLLTIGSIFFTWRLYNERPRERRNEFSSKERLLEELKWKKATLHAVDVTLDPDTAHPHLFLYEDSKSVRLEDSRQKLPEKTERFDSWPCVLGRETFTSGRHYWEVEVGDRTDWAIGVCRENVMKKGFDPMTPENGFWAVELYGNGYWALTPLRTPLPLAGPPRRVGIFLDYESGDISFYNMNDGSDIYTFSNVTFSGPLRPFFCLWSSGKKPLTICPIADGPERVTVIANAQDLSKEIPLSPMGEDSAPRDADTLHSKLIPTQPSQGAP

SEQ ID NO: 4361 - protein, 241 aa, Homo sapiens
MASLSGLASALESYRGRDRLIRVLGYCCQLVGGVLVEQCPARSEVGTRLLVVSTQLSHCRTILRLFDDLAMFVYTKQYGLGAQEEDAFVRCVSVLGNLADQLYYPCEHVAWAADARVLHVDSSRWWTLSTTLWALSLLLGVARSLWMLLKLRQRLRSPTAPFTSPLPRGKRRAMEAQMQSEALSLLSNLADLANAVHWLPRGVLWAGRFPPWLVGLMGTISSILSMYQAARAGGQAEATTP

SEQ ID NO: 4362 - protein, 575 aa, Homo sapiens
MDPEDEGVAGVMSVGPPAARLQEPVTFRDVAVDFTQEEWGQLDPTQRILYRDVMLETFGHLLSIGPELPKPEVISQLEQGTELWVAERGTTQGCHPAWEPRSESQASRKEEGLPEEEPSHVTGREGFPTDAPYPTTLGKDRECQSQSLALKEQNNLKQLEFGLKEAPVQDQGYKTLRLRENCVLSSSPNPFPEISRGEYLYTYDSQITDSEHNSSLVSQQTGSPGKQPGENSDCHRDSSQAIPITELTKSQVQDKPYKCTDCGKSFNHNAHLTVHKRIHTGERPYMCKECGKAFSQNSSLVQHERIHTGDKPYKCAECGKSFCHSTHLTVHRRIHTGEKPYECQDCGRAFNQNSSLGRHKRTHTGEKPYTCSVCGKSFSRTTCLFLHLRTHTEERPYECNHCGKGFRHSSSLAQHQRKHAGEKPFECRQRLIFEQTPALTKHEWTEALGCDPPLSQDERTHRSDRPFKCNQCGKCFIQSSHLIRHQITHTREEQPHGRSRRREQSSSRNSHLVQHQHPNSRKSSAGGAKAGQPESRALALFDIQKIMQEKNPVHVIGVEEPSVGASMLFDIREST

SEQ ID NO: 4363 - protein, 733 aa, Homo sapiens
MERRSESPCLRDSPDRRSGSPDVKGPPPVKVARLEQNGSPMGARGRPNGAVAKAVGGLMIPVFCVVEQLDGSLEYDNREEHAEFVLVRKDVLFSQLVETALLALGYSHSSAAQAQGIIKLGRWNPLPLSYVTDAPDATVADMLQDVYHVVTLKIQLQSCSKLEDLPAEQWNHATVRNALKELLKEMNQSTLAKECPLSQSMISSIVNSTYYANVSATKCQEFGRWYKKYKKIKVERVERENLSDYCVLGQRPMHLPNMNQLASLGKTNEQSPHSQIHHSTPIRNQVPALQPIMSPGLLSPQLSPQLVRQQIAMAHLINQQIAVSRLLAHQHPQAINQQFLNHPPIPRAVKPEPTNSSVEVSPDIYQQVRDELKRASVSQAVFARVAFNRTQGLLSEILRKEEDPRTASQSLLVNLRAMQNFLNLPEVERDRIYQDERERSMNPNVSMVSSASSSPSSSRTPQAKTSTPTTDLPIKVDGANINITAAIYDEIQQEMKRAKVSQALFAKVAANKSQGWLCELLRWKENPSPENRTLWENLCTIRRFLNLPQHERDVIYEEESRHHHSERMQHVVQLPPEPVQVLHRQQSQPAKESSPPREEAPPPPPPTEDSCAKKPRSRTKISLEALGILQSFIHDVGLYPDQEAIHTLSAQLDLPKHTIIKFFQNQRYHVKHHGKLKEHLGSAVDVAEYKDEELLTESEENDSEEGSEEMYKVEAEEENADKSKAAPAEIDQR

SEQ ID NO: 4364 - protein, 290 aa, Homo sapiens
MRLNSTGEVPVLIHGENIICEATQIIDYLEQTFLDERTPRLMPDKESMYYPRVQHYRELLDSLPMDAYTHGCILHPELTVDSMIPAYATTRIRSQIGNTESELKKLAEENPDLQEAYIAKQKRLKSKLLDHDNVKYLKKILDELEKVLDQVETELQRRNEETPEEGQQPWLCGESFTLADVSLAVTLHRLKFLGFARRNWGNGKRPNLETYYERVLKRKTFNKVLGHVNNILISAVLPTAFRVAKKRAPKVLGTTLVVGLLAGVGYFAFMLFRKRLGSMILAFRPRPNYF

SEQ ID NO: 4365 - protein, 734 aa, Homo sapiens
MAASPGPAGVGGAGAVYGSGSSGFALDSGLEIKTRSVEQTLLPLVSQITTLINHKDNTKKSDKTLQAIQRVGQAVNLAVGRFVKVGEAIANENWDLKEEINIACIEAKQAGETIAALTDITNLNHLESDGQITIFTDKTGVIKAARLLLSSVTKVLLLADRVVIKQIITSRNKVLATMERLEKVNSFQEFVQIFSQFGNEMVEFAHLSGDRQNDLKDEKKKAKMAAARAVLEKCTMMLLTASKTCLRHPNCESAHKNKEGVFDRMKVALDKVIEIVTDCKPNGETDISSISIFTGIKEFKMNIEALRENLYFQSKENLSVTLEVILERMEDFTDSAYTSHEHRERILELSTQARMELQQLISVWIQAQSKKTKSIAEELELSILKISHSLNELKKELHSTATQLAADLLKYHADHVVLKALKLTGVEGNLEALAEYACKLSEQKEQLVETCRLLRHISGTEPLEITCIHAEETFQVTGQQIISAAETLTLHPSSKIAKENLDVFCEAWESQISDMSTLLREINDVFEGRRGEKYGYLSLPKPMKNNANLKSLKPDKPDSEEQAKIAKLGLKLGLLTSDADCEIEKWEDQENEIVQYGRNMSSMAYSLYLFTRGEGPLKTSQDLIHQLEVFAAEGLKLTSSVQAFSKQLKDDDKLMLLLEINKLIPLCHQLQTVTKTSLQNKVFLKVDKCITKTRSMMALLVQLLSLCYKLLKKLQMENNGWVSVTNKDTMDSKT

SEQ ID NO: 4366 - protein, 622 aa, Homo sapiens
MSRQTTSVGSSCLDLWREKNDRLVRQAKVAQNSGLTLRRQQLAQDALEGLRGLLHSLQGLPAAVPVLPLELTVTCNFIILRASLAQGFTEDQAQDIQRSLERVLETQEQQGPRLEQGLRELWDSVLRASCLLPELLSALHRLVGLQAALWLSADRLGDLALLLETLNGSQSGASKDLLLLLKTWSPPAEELDAPLTLQDAQGLKDVLLTAFAYRQGLQELITGNPDKALSSLHEAASGLCPRPVLVQVYTALGSCHRKMGNPQRALLYLVAALKEGSAWGPPLLEASRLYQQLGDTTAELESLELLVEALNVPCSSKAPQFLIEVELLLPPPDLASPLHCGTQSQTKHILASRCLQTGRAGDAAEHYLDLLALLLDSSEPRFSPPPSPPGPCMPEVFLEAAVALIQAGRAQDALTLCEELLSRTSSLLPKMSRLWEDARKGTKELPYCPLWVSATHLLQGQAWVQLGAQKVAISEFSRCLELLFRATPEEKEQGAAFNCEQGCKSDAALQQLRAAALISRGLEWVASGQDTKALQDFLLSVQMCPGNRDTYFHLLQTLKRLDRRDEATALWWRLEAQTKGSHEDALWSLPLYLESYLSWIRPSDRDAFLEEFRTSLPKSCDL

SEQ ID NO: 4367 - protein, 670 aa, Homo sapiens [sequence omitted]

SEQ ID NO: 4368 - protein, 288 aa, Homo sapiens
MKDRTQELRTAKDSDDDDDVAVTVDRDRFMDEFFEQVEEIRGFIDKIAENVEEVKRKHSAILASPNPDEKTKEELEELMSDIKKTANKVRSKLKSIEQSIEQEEGLNRSSADLRIRKTQHSTLSRKFVEVMSEYNATQSDYRERCKGRIQRQLEITGRTTTSEELEDMLESGNPAIFASGIIMDSSISKQALSEIETRHSEIIKLENSIRELHDMFMDMAMLVESQGEMIDRIEYNVEHAVDYVERAVSDTKKAVKYQSKARRKKIMIIICCVILGIVIASTVGGIFA

SEQ ID NO: 4369 - protein, 209 aa, Homo sapiens
MNPSMKQKQEEIKENIKNSSVPRRTLKMIQPSASGSLVGRENELSAGLSKRKHRNDHLTSTTSSPGVIVPESSENKNLGGVTQESFDLMIKENPSSQYWKEVAEKRRKALYEALKENEKLHKEIEQKDNEIARLKKENKELAEVAEHVQYMAELIERLNGEPLDNFESLDNQEFDSEEETVEDSLVEDSEIGTCAEGTVSSSTDAKPCI

SEQ ID NO: 4370 - protein, 561 aa, Homo sapiens
MAESGESGGPPGSQDSAAGAEGAGAPAAAASAEPKIMKVTVKTPKEKEEFAVPENSSVQQFKEEISKRFKSHTDQLVLIFAGKILKDQDTLSQHGIHDGLTVHLVIKTQNRPQDHSAQQTNTAGSNVTTSSTPNSNSTSGSATSNPFGLGGLGGLAGLSSLGLNTTNFSELQSQMQRQLLSNPEMMVQIMENPFVQSMLSNPDLMRQLIMANPQMQQLIQRNPEISHMLNNPDIMRQTLELARNPAMMQEMMRNQDRALSNLESIPGGYNALRRMYTDIQEPMLSAAQEQFGGNPFASLVSNTSSGEGSQPSRTENRDPLPNPWAPQTSQSSSASSGTASTVGGTTGSTASGTSGQSTTAPNLVPGVGASMFNTPGMQSLLQQITENPQLMQNMLSAPYMRSMMQSLSQNPDLAAQMQNPDTLSAMSNPRAMQALLQIQQGLQTLATEAPGLIPGFTPGLGALGSTGGSSGTNGSNATPSENTSPTAGTTEPGHQQFIQQMLQALAGVNPQLQNPEVRFQQQLEQLSAMGFLNREANLQALIATGGDINAAIERLLGSQPS

SEQ ID NO: 4371 - protein, 475 aa, Homo sapiens
MAALTTLFKYIDENQDRYIKKLAKWVAIQSVSAWPEKRGEIRRMMEVAAADVKQLGGSVELVDIGKQKLPDGSEIPLPPILLGRLGSDPQKKTVCIYGHLDVQPAALEDGWDSEPFTLVERDGKLYGRGSTDDKGPVAGWINALEAYQKTGQEIPVNVRFCLEGMEESGSEGLDELIFARKDTFFKDVDYVCISDNYWLGKKKPCITYGLRGICYFFIEVECSNKDLHSGVYGGSVHEAMTDLILLMGSLVDKRGNILIPGINEAVAAVTEEEHKLYDDIDFDIEEFAKDVGAQILLHSHKKDILMHRWRYPSLSLHGIEGAFSGSGAKTVIPRKVVGKFSIRLVPNMTPEVVGEQVTSYLTKKFAELRSPNEFKVYMGHGGKPWVSDFSHPHYLAGRRAMKTVFGVEPDLTREGGSIPVTLTFQEATGKNVMLLPVGSADDGAHSQNEKLNRYNYIEGTKMLAAYLYEVSQLKD

SEQ ID NO: 4372 - protein, 497 aa, Homo sapiens
MTFNSFEGSKTCVPADINKEEEFVEEFNRLKTFANFPSGSPVSASTLARAGFLYTGEGDTVRCFSCHAAVDRWQYGDSAVGRHRKVSPNCRFINGFYLENSATQSTNSGIQNGQYKVENYLGSRDHFALDRPSETHADYLLRTGQVVDISDTIYPRNPAMYSEEARLKSFQNWPDYAHLTPRELASAGLYYTGIGDQVQCFCCGGKLKNWEPCDRAWSEHRRHFPNCFFVLGRNLNIRSESDAVSSDRNFPNSTNLPRNPSMADYEARIFTFGTWIYSVNKEQLARAGFYALGEGDKVKCFHCGGGLTDWKPSEDPWEQHAKWYPGCKYLLEQKGQEYINNIHLTHSLEECLVRTTEKTPSLTRRIDDTIFQNPMVQEAIRMGFSFKDIKKIMEEKIQISGSNYKSLEVLVADLVNAQKDSMQDESSQTSLQKEISTEEQLRRLQEEKLCKICMDRNIAIVFVPCGHLVTCKQCAEAVDKCPMCYTVITFKQKIFMS

SEQ ID NO: 4373 - protein, 354 aa, Homo sapiens
MCYVPSPVLASVGDTDDRFEDLEEANPFSFREFLKTKNLGLSKEDPASRIYAKEASRHSLGLDHNSPPSQTGGYGLEYQQPFFEDPTGAGDLLDGEEDEDTGWSGAYLPSAIEQTHPERVPAGTSPCSTYLSFFSTPSELAGPESLPSWALSDTDSRVSPASPAGSPSADFAVHGESLGDRHLRTLQISYDALKDENSKLRRKLNEVQSFSEAQTEMVRTLERKLEAKMIKEESDYHDLESVVQQVEQNLELMTKRAVKAENHVVKLKQEISLLQAQVSNFQRENEALRCGQGASLTVVKQNADVALQNLRVVMNSAQASIKQLVSGAETLNLVAEILKSIDRISEIKDEEEDS

SEQ ID NO: 4374 - protein, 224 aa, Homo sapiens
MSVFGKLFGAGGGKAGKGGPTPQEAIQRLRDTEEMLSKKQEFLEKKIEQELTAAKKHGTKNKRAALQALKRKKRYEKQLAQIDGTLSTIEFQREALENANTNTEVLKNMGYAAKAMKAAHDNMDIDKVDELMQDIADQQELAEEISTAISKPVGFGEEFDEDELMAELEELEQEELDKNLLEISGPETVPLPNVPSIALPSKPAKKKEEEDDDMKELENWAGSM

SEQ ID NO: 4375 - protein, 470 aa, Homo sapiens
MSVTDQAFVTLATNDIYCQGALVLGQSLRRHRLTRKLVVLITPQVSSLLRVILSKVFDEVIEVNLIDSADYIHLAFLKRPELGLTLTKLHCWTLTHYSKCVFLDADTLVLSNVDELFDRGEFSAAPDPGWPDCFNSGVFVFQPSLHTHKLLLQHAMEHGSFDGADQGLLNSFFRNWSTTDIHKHLPFIYNLSSNTMYTYSPAFKQFGSSAKVVHFLGSMKPWNYKYNPQSGSVLEQGSVSSSQHQAAFLHLWWTVYQNNVLPLYKSVQAGEARASPGHTLCRSDVGGPCADSASGVGEPCENSTPSAGVPCANSPLGSNQPAQGLPEPTQIVDETLSLPEGRRSEDMIACPETETPAVITCDPLSQPSPQPADFTETETILQPANKVESVSSEETFEPSQELPAEALRDPSLQDALEVDLAVSVSQISIEEKVKELSPEEERRKWEEGRIDYMGKDAFARIQEKLDRFLQ

SEQ ID NO: 4376 - protein, 195 aa, Homo sapiens
MDELRWYHITVCLDHIFGHNCSLSCKDCMNGGKCQEGKSECSCPAGCRVILCNENCLEGAYGAGCTSECQCVEENTLECSAKNGSCTCKSGYQGNRCQKDGLWGPEGWFSSAPCENGGQCNKKTGNCDCTPDYTRKSCTILRCISLTNLALSRRSSPMKYQQNVSSHREVRQRQQCSSDRPFKKLLCKFSFKIGM

SEQ ID NO: 4377 - protein, 911 aa, Homo sapiens
MVDYHAANQSYQYGPSSAGNGAGGGGSMGDYMAQEDDWDRDLLLDPAWEKQQRKTFTAWCNSHLRKAGTQIENIDEDFRDGLKLMLLLEVISGERLPKPERGKMRVHKINNVNKALDFIASKGVKLVSIGAEEIVDGNAKMTLGMIWTIILRFAIQDISVEETSAKEGLLLWCQRKTAPYKNVNVQNFHISWKDGLAFNALIHRHRPELIEYDKLRKDDPVTNLNNAFEVAEKYLDIPKMLDAEDIVNTARPDEKAIMTYVSSFYHAFSGAQKAETAANRICKVLAVNQENEHLMEDYEKLASDLLEWIRRTIPWLEDRVPQKTIQEMQQKLEDFRDYRRVHKPPKVQEKCQLEINFNTLQTKLRLSNRPAFMPSEGKMVSDINNGWQHLEQAEKGYEEWLLNEIRRLERLDHLAEKFRQKASIHEAWTDGKEAMLKHRDYETATLSDIKALIRKHEAFESDLAAHQDRVEQIAAIAQELNELDYYDSHNVNTRCQKICDQWDALGSLTHSRREALEKTEKQLEAIDQLHLEYAKRAAPFNNWMESAMEDLQDMFIVHTIEEIEGLISAHDQFKSTLPDADREREAILAIHKEAQRIAESNHIKLSGSNPYTTVTPQIINSKWEKVQQLVPKRDHALLEEQSKQQSNEHLRRQFASQANVVGPWIQTKMEEIGRISIEMNGTLEDQLSHLKQYERSIVDYKPNLDLLEQQHQLIQEALIFDNKHTNYTMEHIRVGWEQLLTTIARTINEVENQILTRDAKGISQEQMQEFRASFNHFDKDHGGALGPEEFKACLISLGYDVENDRQGEAEFNRIMSLVDPNHSGLVTFQAFIDFMSRETTDTDTADQVIASFKVLAGDKNFITAEELRRELPPDQAEYCIARMAPYQGPDAVPGALDYKSFSTALYGESDL

SEQ ID NO: 4378 - protein, 756 aa, Homo sapiens
MDSGRDFLTLHGLQDDEDLQALLKGSQLLKVKSSSWRRERFYKLQEDCKTIWQESRKVMRTPESQLFSIEDIQEVRMGHRTEGLEKFARDVPEDRCFSIVFKDQRNTLDLIAPSPADAQHWVLGLHKIIHHSGSMDQRQKLQHWIHSCLRKADKNKDNKMSFKELQNFLKELNIQVDDSYARKIFRECDHSQTDSLEDEEIEAFYKMLTQRVEIDRTFAEAAGSGETLSVDQLVTFLQHQQREEAAGPALALSLIERYEPSETAKAQRQMTKDGFLMYLLSADGSAFSLAHRRVYQDMGQPLSHYLVSSSHNTYLLEDQLAGPSSTEAYIRALCKGCRCLELDCWDGPNQEPIIYHGYTFTSKILFCDVLRAIRDYAFKASPYPVILSLENHCTLEQQRVMARHLHAILGPMLLNRPLDGVTNSLPSPEQLKGKILLKGKKLGGLLPPGGEGGPEATVVSDEDEAAEMEDEAVRSRVQHKPKEDKLRLAQELSDMVIYCKSVHFGGFSSPGTPGQAFYEMASFSENRALRLLQESGNGFVRHNVGHLSRIYPAGWRTDSSNYSPVEMWNGGCQIVALNFQTPGPEMDVYQGRFQDNGACGYVLKPAFLRDPNGTFNPRALAQGPWWARKRLNIRVISGQQLPKVNKNKNSIVDPKVTVEIHGVSRDVASRQTAVITNNGFNPWWDTEFAFEVVVPDLALIRFLVEDYDASSKNDFIGQSTIPLNSLKQGYRHVHLMSKNGDQHPSATLFVKISLQD

SEQ ID NO: 4379 - protein, 582 aa, Homo sapiens [sequence omitted]

SEQ ID NO: 4380 - protein, 92 aa, Homo sapiens
MVTVRASLQSEFVCLILSDTSDAVKQGQSGSWIVTTHADIKQTLPSGTEGTTVTRNCCPFIPGFRRLYQKEWKMLVGSKIETASEDWFCTKP

SEQ ID NO: 4381 - protein, 55 aa, Homo sapiens
MHEQTENFHKEIKDNKKYKVEEYNNWTQKFNVSNRRIDEAEERAIKLVDRPLEIM

SEQ ID NO: 4382 - protein, 170 aa, Homo sapiens
MKTLFLGVTLGLAAALSFTLEEEDITGTWYVKAMVVDKDFPEDRRPRKVSPVKVTALGGGNLEATFTFMREDRCIQKKILMRKTEEPGKFSAYGGRKLIYLQELPGTDDYVFYCKDQRRGGLRYMGKLVGRNPNTNLEALEEFKKLVQHKGLSEEDIFMPLQTGSCVLEH

SEQ ID NO: 4383 - protein, 1184 aa, Homo sapiens
MEVDTEEKRHRTRSKGVRVPVEPAIQELFSCPTPGCDGSGHVSGKYARHRSVYGCPLAKKRKTQDKQPQEPAPKRKPFAVKADSSSVDECDDSDGTEDMDEKEEDEGEEYSEDNDEPGDEDEEDEEGDREEEEEIEEEDEDDDEDGEDVEDEEEEEEEEEEEEEEEENEDHQMNCHNTRIMQDTEKDDNNNDEYDNYDELVAKSLLNLGKIAEDAAYRARTESEMNSNTSNSLEDDSDKNENLGRKSELSLDLDSDVVRETVDSLKLLAQGHGVVLSENMNDRNYADSMSQQDSRNMNYVMLGKPMNNGLMEKMVEESDEEVCLSSLECLRNQCFDLARKLSETNPQERNPQQNMNIRQHVRPEEDFPGRTPDRNYSDMLNLMRLEEQLSPRSRVFASCAKEDGCHERDDDTTSVNSDRSEEVFDMTKGNLTLLEKAIALETERAKAMREKMAMEAGRRDNMRSYEDQSPRQLPGEDRKPKSSDSHVKKPYYDPSRTEKKESKCPTPGCDGTGHVTGLYPHHRSLSGCPHKDRVPPEILAMHESVLKCPTPGCTGRGHVNSNRNSHRSLSGCPIAAAEKLAKAQEKHQSCDVSKSSQASDRVLRPMCFVKQLEIPQYGYRNNVPTTTPRSNLAKELEKYSKTSFEYNSYDNHTYGKRAIAPKVQTRDISPKGYDDAKRYCKDPSPSSSSTSSYAPSSSSNLSCGGGSSASSTCSKSSFDYTHDMEAAHMAATAILNLSTRCREMPQNLSTKPQDLCATRNPDMEVDENGTLDLSMNKQRPRDSCCPILTPLEPMSPQQQAVMNNRCFQLGEGDCWDLPVDYTKMKPRRIDEDESKDITPEDLDPFQEALEERRYPGEVTIPSPKPKYPQCKESKKDLITLSGCPLADKSIRSMLATSSQELKCPTPGCDGSGHITGNYASHRSLSGCPRAKKSGIRIAQSKEDKEDQEPIRCPVPGCDGQGHITGKYASHRSASGCPLAAKRQKDGYLNGSQFSWKSVKTEGMSCPTPGCDGSGHVSGSFLTHRSLSGCPRATSAMKKAKLSGEQMLTIKQRASNGIENDEEIKQLDEEIKELNESNSQMEADMIKLRTQITTMESNLKTIEEENKVIEQQNESLLHELANLSQSLIHSLANIQLPHMDPINEQNFDAYVTTLTEMYTNQDRYQSPENKALLENIKQAVRGIQV

SEQ ID NO: 4384 - protein, 102 aa, Homo sapiens
MAGQAFRKFLPLFDRVLVERSAAETVTKGGIMLPEKSQGKVLQATVVAVGSGSKGKGGEIQPVSVKVGDKVLLPEYGGTKVVLDDKDYFLFRDGDILGKYVD

SEQ ID NO: 4385 - protein, 624 aa, Homo sapiens
MQPDPRPSGAGACCRFLPLQSQCPEGAGDAVMYASTECKAEVTPSQHGNRTFSYTLEDHTKQAFGIMNELRLSQQLCDVTLQVKYQDAPAAQFMAHKVVLASSSPVFKAMFTNGLREQGMEVVSIEGIHPKVMERLIEFAYTASISMGEKCVLHVMNGAVMYQIDSVVRACSDFLVQQLDPSNAIGIANFAEQIGCVELHQRAREYIYMHFGEVAKQEEFFNLSHCQLVTLISRDDLNVRCESEVFHACINWVKYDCEQRRFYVQALLRAVRCHSLTPNFLQMQLQKCEILQSDSRCKDYLVKIFEELTLHKPTQVMPCRAPKVGRLIYTAGGYFRQSLSYLEAYNPSDGTWLRLADLQVPRSGLAGCVVGGLLYAVGGRNNSPDGNTDSSALDCYNPMTNQWSPCAPMSVPRNRIGVGVIDGHIYAVGGSHGCIHHNSVERYEPERDEWHLVAPMLTRRIGVGVAVLNRLLYAVGGFDGTNRLNSAECYYPERNEWRMITAMNTIRSGAGVCVLHNCIYAAGGYDGQDQLNSVERYDVETETWTFVAPMKHRRSALGITVHQGRIYVLGGYDGHTFLDSVECYDPDTDTWSEVTRMTSGRSGVGVAVTMEPCRKQIDQQNCTC

SEQ ID NO: 4386 - protein, 391 aa, Homo sapiens
MADIDNKEQSELDQDLDDVEEVEEEETGEETKLKARQLTVQMMQNPQILAALQERLDGLVETPTGYIESLPRVVKRRVNALKNLQVKCAQIEAKFYEEVHDLERKYAVLYQPLFDKRFEIINAIYEPTEEECEWKPDEEDEISEELKEKAKIEDEKKDEEKEDPKGIPEFWLTVFKNVDLLSDMVQEHDEPILKHLKDIKVKFSDAGQPMSFVLEFHFEPNEYFTNEVLTKTYRMRSEPDDSDPFSFDGPEIMGCTGCQIDWKKGKNVTLKTIKKKQKHKGRGTVRTVTKTVSNDSFFNFFAPPEVPESGDLDDDAEAILAADFEIGHFLRERIIPRSVLYFTGEAIEDDDDDYDEEGEEADEEGEEEGDEENDPDYDPKKDQNPAECKQQ

SEQ ID NO: 4387 - protein, 335 aa, Homo sapiens
MEDSGKTFSSEEEEANYWKDLAMTYKQRAENTQEELREFQEGSREYEAELETQLQQIETRNRDLLSENNRLRMELETIKEKFEVQHSEGYRQISALEDDLAQTKAIKDQLQKYIRELEQANDDLERAKRATIMSLEDFEQRLNQAIERNAFLESELDEKENLLESVQRLKDEARDLRQELAVQQKQEKPRTPMPSSVEAERTDTAVQATGSVPSTPIAHRGPSSSLNTPGSFRRGLDDSTGGTPLTPAARISALNIVGDLLRKVGALESKLASCRNLVYDQSPNRTGGPASGRSSKNRDGGERRPSSTSVPLGDKGLDTSCRWLSKSTTRSSSSC

SEQ ID NO: 4388 - protein, 349 aa, Homo sapiens
MAASEAAVVSSPSLKTDTSPVLETAGTVAAMAATPSARAAAAVVAAAARTGSEARVSKAALATKLLSLSGVFAVHKPKGPTSAELLNRLKEKLLAEAGMPSPEWTKRKKQTLKIGHGGTLDSAARGVLVVGIGSGTKMLTSMLSGSKRYTAIGELGKATDTLDSTGRVTEEKPYDKITQEDIEGILQKFTGNIMQVPPLYSALKKDGQRLSTLMKRGEVVEAKPARPVTVYSISLQKFQPPFFTLDVECGGGFYIRSLVSDIGKELSSCANVLELTRTKQGPFTLEEHALPEDKWTIDDIAQSLEHCSSLFPAELALKKSKPESNEQVLSCEYITLNEPKREDDVIKTC

SEQ ID NO: 4389 - protein, 514 aa, Homo sapiens
MADYLISGGTSYVPDDGLTAQQLFNCGDGLTYNDFLILPGYIDFTADQVDLTSALTKKITLKTPLVSSPMDTVTEAGMAIAMALTGGIGFIHHNCTPEFQANEVRKVKKYEQGFITDPVVLSPKDRVRDVFEAKARHGFCGIPITDTGRMGSRLVGIISSRDIDFLKEEEHDCFLEEIMTKREDLVVAPAGITLKEANEILQRSKKGKLPIVNEDDELVAIIARTDLKKNRDYPLASKDAKKQLLCGAAIGTHEDDKYRLDLLAQAGVDVVVLDSSQGNSIFQINMIKYIKDKYPNLQVIGGNVVTAAQAKNLIDAGVDALRVGMGSGSICITQEVLACGRPQATAVYKVSEYARRFGVPVIADGGIQNVGHIAKALALGASTVMMGSLLAATTEAPGEYFFSDGIRLKKYRGMGSLDAMDKHLSSQNRYFSEADKIKVAQGVSGAVQDKGSIHKFVPYLIAGIQHSCQDIGAKSLTQVRAMMYSGELKFEKRTSSAQVEGGVHSLHSYEKRLF

SEQ ID NO: 4390 - protein, 329 aa, Homo sapiens
MSGVVPTAPEQPAGEMENQTKPPDPRPDAPPEYSSHFLPGPPGTAVPPPTGYPGGLPMGYYSPQQPSTFPLYQPVGGIHPVRYQPGKYPMPNQSVPITWMPGPTPMANCPPGLEYLVQLDNIHVLQHFEPLEMMTCFETNNRYDIKNNSDQMVYVVTEDTDDFTRNAYRTLRPFVLRVTDCMGREIMTMQRPFRCTCCCFCCPSARQELEVQCPPGVTIGFVAEHWNLCRAVYSIQNEKKENVMRVRGPCSTYGCGSDSVFEVKSLDGISNIGSIIRKWNGLLSAMADADHFDIHFPLDLDVKMKAMIFGACFLIDFMYFERSPPQRSR

SEQ ID NO: 4391 - protein, 642 aa, Homo sapiens [sequence omitted]

SEQ ID NO: 4392 - protein, 716 aa, Homo sapiens
MGETKIIYHLDGQETPYLVKLPLPAERVTLADFKGVLQRPSYKFFFKSMDDDFGVVKEEISDDNAKLPCFNGRVVSWLVSAEGSHPDPAPFCADNPSELPPPMERTGGIGDSRPPSFHPHAGGGSQENLDNDTETDSLVSAQRERPRRRDGPEHATRLNGTAKGERRREPGGYDSSSTLMSSELETTSFFDSDEDDSTSRFSSSTEQSSASRLMRRHKRRRRKQKVSRIERSSSFSSITDSTMSLNIITVTLNMEKYNFLGISIVGQSNERGDGGIYIGSIMKGGAVAADGRIEPGDMLLQVNEINFENMSNDDAVRVLREIVHKPGPITLTVAKCWDPSPRGCFTLPRSEPIRPIDPAAWVSHTAAMTGTFPAYGMSPSLSTITSTSSSITSSIPDTERLDDFHLSIHSDMAAIVKAMASPESGLEVRDRMLLKITIPNAFIGSDVVDWLYHNVEGFTDRREARKYASNLLKAGFIRHTVNKITFSEQCYYIFGDLCGNMANLSLHDHDGSSGASDQDTLAPLPHPGAAPWPMAFPYQYPPPPHPYNPHPGFPELGYSYGGGSASSQHSEGSRSSGSNRSGSDRRKEKDPKAGDSKSGGSGSESDHTTRSSLRGPRERAPSERSGPAASEHSHRSHHSLASSLRSHHTHPSYGPPGVPPLYGPPMLMMPPPPAAMGPPGAPPGRDLASVPPELTASRQSFRMAMGNPSEFFVDVM

SEQ ID NO: 4393 - protein, 412 aa, Homo sapiens
MIGMLESLQHESDLLQHDQIHTGEKPYECNECRKTFSLKQNLVEHKKMHTGEKSHECTECGKVCSRVSSLTLHLRSHTGKKAYKCNKCGKAFSQKENFLSHQKHHTGEKPYECEKVSIQMPTIIRHQKNHTGTKPYACKECGKAFNGKAYLTEHEKIHTGEKPFECNQCGRAFSQKQYLIKHQNIHTGKKPFKCSECGKAFSQKENLIIHQRIHTGEKPYECKGCGKAFIQKSSLIRHQRSHTGEKPYTCKECGKAFSGKSNLTEHEKIHIGEKPYKCNECGTIFRQKQYLIKHHNIHTGEKPYECNKCGKAFSRITSLIVHVRIHTGDKPYECKVCGKAFCQSSSLTVHMRSHTGEKPYGCNECGKAFSQFSTLALHMRIHTGEKPYQCSECGKAFSQKSHHIRHQRIHTH

SEQ ID NO: 4394 - protein, 574 aa, Homo sapiens
MALKGRALYDFHSENKEEISIQQDEDLVIFSETSLDGWLQGQNSRGETGLFPASYVEIVRSGISTNHADYSSSPAGSPGAQVSLYNSPSVASPARSGGGSGFLSNQGSFEEDDDDDWDDWDDGCTVVEEPRAGGLGTNGHPPLNLSYPGAYPSQHMAFRPKPPLERQDSLASAKRGSVVGRNLNRFSCFVRSGVEAFILGDVPMMAKIAETYSIEMGPRGPQWKANPHPFACSVEDPTKQTKFKGIKSYISYKLTPTHAASPVYRRYKHFDWLYNRLLHKFTVISVPHLPEKQATGRFEEDFIEKRKRRLILWMDHMTSHPVLSQYEGFQHFLSCLDDKQWKMGKRRAEKDEMVGASFLLTFQIPTEHQDLQDVEDRVDTFKAFSKKMDDSVLQLSTVASELVRKHVGGFRKEFQKLGSAFQAISHSFQMDPPFCSEALNSAISHTGRTYEAIGEMFAEQPKNDLFQMLDTLSLYQGLLSNFPDIIHLQKGAFAKVKESQRMSDEGRMVQDEADGIRRRCRVVGFALQAEMNHFHQRRELDFKHMMQNYLRQQILFYQRVGQQLEKTLRMYDNL

SEQ ID NO: 4395 - protein, 190 aa, Homo sapiens
MFQVPDSEGGRAGSRAMKPPGGESSNLFGSPEEATPSSRPNRMASNIFGPTEEPQNIPKRTNPPGGKGSGIFDESTPVQTRQHLNPPGGKTSDIFGSPVTATSRLAHPNKPKDHVFLCEGEEPKSDLKAARSIPAGAEPGEKGSARKAGPAKEQEPMPTVDSHEPRLGPRPRSHNKVLNPPGGKSSISFY

SEQ ID NO: 4396 - protein, 208 aa, Homo sapiens [sequence omitted]

SEQ ID NO: 4397 - protein, 349 aa, Homo sapiens
MEEEKYLPELMAEKDSLDPSFVHASRLLAEEIEKFQGSDGKKEDEEKKYLDVISNKNIKLSERVLIPVKQYPKFNFVGKLLGPRGNSLKRLQEETGAKMSILGKGSMRDKAKEEELRKSGEAKYAHLSDELHVLIEVFAPPGEAYSRMSHALEEIKKFLVPDYNDEIRQEQLRELSYLNGSEDSGRGRGIRGRGIRIAPTAPSRGRGGAIPPPPPPGRGVLTPRGSTVTRGALPVPPVARGVPTPRARGAPTVPGYRAPPPPAHEAYEEYGYDDGYGGEYDDQTYETYDNSYATQTQSVPEYYDYGHGVSEDAYDSYAPEEWATTSSSLKAPPQRSARGGYREHPYGRY

SEQ ID NO: 4398 - protein, 255 aa, Homo sapiens
MVLLLVILIPVLVSSAGTSAHYEMLGTCRMVCDPYGGTKAPSTAATPDRGLMQSLPTFIQGPKGEAGRPGKAGPRGPPGEPGPPGPMGPPGEKGEPGRQGLPGPPGAPGLNAAGAISAATYSTVPKIAFYAGLKRQHEGYEVLKFDDVVTNLGNHYDPTTGKFTCSIPGIYFFTYHVLMRGGDGTSMWADLCKNNQVRASAIAQDADQNYDYASNSVVLHLEPGDEVYIKLDGGKAHGGNNNKYSTFSGFIIYAD

SEQ ID NO: 4399 - protein, 154 aa, Homo sapiens
MPSRTARYARYSPRQRRRRMLADRSVRFPNDVLFLDHIRQGDLEQVGRFIRTRKVSLATIHPSGLAALHEAVLSGNLECVKLLVKYGADIHQRDEAGWTPLHIACSDGYPDIARYLISLGADRDATNDDGDLPSDLIDPDYKELVELFKGTTMD

SEQ ID NO: 4400 - protein, 299 aa, Homo sapiens
MGGPRALLAALWALEAAGTAALRIGAFNIQSFGDSKVSDPACGSIIAKILAGYDLALVQEVRDPDLSAVSALMEQINSVSEHEYSFVSSQPLGRDQYKEMYLFVYRKDAVSVVDTYLYPDPEDVFSREPFVVKFSAPGTGERAPPLPSRRALTPPPLPAAAQNLVLIPLHAAPHQAVAEIDALYDVYLDVIDKWGTDDMLFLGDFNADCSYVRAQDWAAIRLRSSEVFKWLIPDSADTTVGNSDCAYDRIVACGARLRRSLKPQSATVHDFQEEFGLDQTQALAISDHFPVEVTLKFHR

SEQ ID NO: 4401 - protein, 358 aa, Homo sapiens
MSVGHKAQESKIRYKTNEPVWEENFTFFIHNPKRQDLEVEVRDEQHQCSLGNLKVPLSQLLTSEDMTVSQRFQLSNSGPNSTIKMKIALRVLHLEKRERPPDHQHSAQVKRPSVSKEGRKTSIKSHMSGSPGPGGSNTAPSTPVIGGSDKPGMEEKAQPPEAGPQGLHDLGRSSSSLLASPGHISVKEPTPSIASDISLPIATQELRQRLRQLENGTTLGQSPLGQIQLTIRHSSQRNKLIVVVHACRNLIAFSEDGSDPYVRMYLLPDKRRSGRRKTHVSKKTLNPVFDQSFDFSVSLPEVQRRTLDVAVKNSGGFLSKDKGLLGKVLVALASEELAKGWTQWYDLTEDGTRPQAMT

SEQ ID NO: 4402 - protein, 89 aa, Homo sapiens
MKGLAAALLVLVCTMALCSCAQVGTNKELCCLVYTSWQIPQKFIVDYSETSPQCPKPGVILLTKRGRQICADPNKKWVQKYISDLKLNA

SEQ ID NO: 4403 - protein, 526 aa, Homo sapiens
MPPNKEASGLSSSPAGLICLPPISEELQLVWTQAAQTSELDSNEHLLKTFSYFPYPSLADIALLCLRYGLQMEKVKTWFMAQRLRCGISWSSEEIEETRARVVYRRDQLHFKSLLSFTHHAGRPPEEVPPPPVPAPEQVGIGIGPPTLSKPTQTKGLKVEPEEPSQMPPLPQSHQKLKESLMTPGSGAFPYQSDFWQHLQSSGLSKEQAGRGPNQSHGIGTASWNHSTTVPQPQARDKPPPIALIASSCKEESASSVTPSSSSTSSSFQVLANGATAASKPLQPLGCVPQSVSPSEQALPPHLEPAWPQGLRHNSVPGRVGPTEYLSPDMQRQRKTKRKTKEQLAILKSFFLQCQWARREDYQKLEQITGLPRPEIIQWFGDTRYALKHGQLKWFRDNAVPGAPSFQDPAIPTPPPSTRSLNERAETPPLPIPPPPPDIQPLERYWAAHQQLRETDIPQLSQASRLSTQQVLDWFDSRLPQPAEVVVCLDEEEEEEEEELPEDDEEEEEEEEEDDDDDDDDVIIQD

SEQ ID NO: 4404 - protein, 520 aa, Homo sapiens
MSLSRSEEMHRLTENVYKTIMEQFNPSLRNFIAMGKNYEKALAGVTYAAKGYFDALVKMGELASESQGSKELGDVLFQMAEVHRQIQNQLEEMLKSFHNELLTQLEQKVELDSRYLSAALKKYQTEQRSKGDALDKCQAELKKLRKKSQGSKNPQKYSDKELQYIDAISNKQGELENYVSDGYKTALTEERRRFCFLVEKQCAVAKNSAAYHSKGKELLAQKLPLWQQACADPSKIPERAVQLMQQVASNGATLPSALSASKSNLVISDPIPGAKPLPVPPELAPFVGRMSAQESTPIMNGVTGPDGEDYSPWADRKAAQPKSLSPPQSQSKLSDSYSNTLPVRKSVTPKNSYATTENKTLPRSSSMAAGLERNGRMRVKAIFSHAAGDNSTLLSFKEGDLITLLVPEARDGWHYGESEKTKMRGWFPFSYTRVLDSDGSDRLHMSLQQGKSSSTGNLLDKDDLAIPPPDYGAASRAFPAQTASGFKQRPYSVAVPAFSQGLDDYGARSMSSADVEVARF

SEQ ID NO: 4405 - protein, 469 aa, Homo sapiens
MSALTPPTDMPTPTTDKITQAAMETIYLCKFRVSMDGEWLCLRELDDISLTPDPEPTHEDPNYLMANERMNLMNMAKLSIKGLIESALNLGRTLDSDYAPLQQFFVVMEHCLKHGLKAKKTFLGQNKSFWGPLELVEKLVPEAAEITASVKDLPGLKTPVGRGRAWLRLALMQKKLSEYMKALINKKELLSEFYEPNALMMEEEGAIIAGLLVGLNVIDANFCMKGEDLDSQVGVIDFSMYLKDGNSSKGTEGDGQITAILDQKNYVEELNRHLNATVNNLQAKVDALEKSNTKLTEELAVANNRIITLQEEMERVKEESSYILESNRKGPKQDRTAEGQALSEARKHLKEETQLRLDVEKELEMQISMRQEMELAMKMLEKDVCEKQDALVSLRQQLDDLRALKHELAFKLQSSDLGVKQKSELNSRLEEKTNQMAATIKQLEQSEKDLVKQAKTLNSAANKLIPKHH

SEQ ID NO: 4406 - protein, 402 aa, Homo sapiens
MMVHCAGCERPILDRFLLNVLDRAWHIKCVQCCECKTNLSEKCFSREGKLYCKNDFFRRFGTKCAGCAQGISPSDLVRKARSKVFHLNCFTCMVCNKQLSTGEELYVIDENKFVCKDDYLSSSSLKEGSLNSVSSCTDRSLSPDLQDALQDDPKETDNSTSSDKETANNENEEQNSGTKRRGPRTTIKAKQLETLKAAFAATPKPTRHIREQLAQETGLNMRVIQVWFQNRRSKERRMKQLSALGARRHAFFRSPRRMRPLGGRLDESEMLGSTPYTYYGDYQGDYYAPGSNYDFFAHGPPSQAQSPADSSFLAASGPGSTPLGALEPPLAGPHAADNPRFTDMISHPDTPSPEPGLPGTLHPMPGEVFSGGPSPPFPMSGTSGYSGPLSHPNPELNEAAVW

SEQ ID NO: 4407 - protein, 217 aa, Homo sapiens [sequence omitted]

SEQ ID NO: 4408 - protein, 497 aa, Homo sapiens [sequence omitted]

SEQ ID NO: 4409 - protein, 367 aa, Homo sapiens
MASELCKTISVARLEKHKNLFLNYRNLHHFPLELLKDEGLQYLERLYMKRNSLTSLPENLAQKLPNLVELYLHSNNIVVVPEAIGSLVKLQCLDLSDNALEIVCPEIGRLRALRHLRLANNQLQFLPPEVGDLKELQTLDISTNRLLTLPERLHMCLSLQYLTVDRNRLWYVPRHLCQLPSLNELSMAGNRLAFLPLDLGRSRELQYVYVDNNIHLKGLPSYLYNKVIGCSGCGAPIQVSEVKLLSFSSGQRTVFLPAEVKAIGTEHDHVLPLQELAMRGLYHTYHSLLKDLNFLSPISLPRSLLELLHCPLGHCHRCSEPMFTIVYPKLFPLRETPMAGLHQWKTTVSFVAYCCSTQCLQTFDLLS

SEQ ID NO: 4410 - protein, 139 aa, Homo sapiens
MVTHAAGARTFCEEQKKGSTYSVPKSKEKLMEKHSQEARQADRESEKPVDSLHPGAGTAKHPPPAASLEEKPDVKQKSSRKKVVVPQIIITRASNETLVSCSSSGSDQQRTIREPEDWGPYRRHRNPSTADAYNSHLKE

SEQ ID NO: 4411 - protein, 939 aa, Homo sapiens
MKVARFQKIPNGENETMIPVLTSKKASELPVSEVASILQADLQNGLNKCEVSHRRAFHGWNEFDISEDEPLWKKYISQFKNPLIMLLLASAVISVLMHQFDDAVSITVAILIVVTVAFVQEYRSEKSLEELSKLVPPECHCVREGKLEHTLARDLVPGDTVCLSVGDRVPADLRLFEAVDLSIDESSLTGETTPCSKVTAPQPAATNGDLASRSNIAFMGTLVRCGKAKGVVIGTGENSEFGEVFKMMQAEEAPKTPLQKSMDLLGKQLSFYSFGIIGIIMLVGWLLGKDILEMFTISVSLAVAAIPEGLPIVVTVTLALGVMRMVKKRAIVKKLPIVETLGCCNVICSDKTGTLTKNEMTVTHIFTSDGLHAEVTGVGYNQFGEVIVDGDVVHGFYNPAVSRIVEAGCVCNDAVIRNNTLMGKPTEGALIALAMKMGLDGLQQDYIRKAEYPFSSEQKWMAVKCVHRTQQDRPEICFMKGAYEQVIKYCTTYQSKGQTLTLTQQQRDVYQQEKARMGSAGLRVLALASGPELGQLTFLGLVGIIDPPRTGVKEAVTTLIASGVSIKMITGDSQETAVAIASRLGLYSKTSQSVSGEEIDAMDVQQLSQIVPKVAVFYRASPRHKMKIIKSLQKNGSVVAMTGDGVNDAVALKAADIGVAMGQTGTDVCKEAADMILVDDDFQTIMSAIEEGKGIYNNIKNFVRFQLSTSIAALTLISLATLMNFPNPLNAMQILWINIIMDGPPAQSLGVEPVDKDVIRKPPRNWKDSILTKNLILKILVSSIIIVCGTLFVFWRELRDNVITPRDTTMTFTCFVFFDMFNALSSRSQTKSVFEIGLCSNRMFCYAVLGSIMGQLLVIYFPPLQKVFQTESLSILDLLFLLGLTSSVCIVAEIIKKVERSREKIQKHVWLWERSGQQLVEIHPHLETGLPLTEDVSCV

SEQ ID NO: 4412 - protein, 1034 aa, Homo sapiens
MPRRKQQAPKRAAGYAQEEQLKEEEEIKEEEEEEDSGSVAQLQGGNDTGTDEELETGPEQKGCFSYQNSPGSHLSNQDAENESLLSDASDQVSDIKSVCGRDASDKKAHTHVRLPNEAHNCMDKMTAVYANILSDSYWSGLGLGFKLSNSERRNCDTRNGSNKSDFDWHQDALSKSLQQNLPSRSVSKPSLFSSVQLYRQSSKMCGTVFTGASRFRCRQCSAAYDTLVELTVHMNETGHYQDDNRKKDKLRPTSYSKPRKRAFQDMDKEDAQKVLKCMFCGDSFDSLQDLSVHMIKTKHYQKVPLKEPVPTISSKMVTPAKKRVFDVNRPCSPDSTTGSFADSFSSQKNANLQLSSNNRYGYQNGASYTWQFEACKSQILKCMECGSSHDTLQQLTTHMMVTGHFLKVTSSASKKGKQLVLDPLAVEKMQSLSEAPNSDSLAPKPSSNSASDCTASTTELKKESKKERPEETSKDEKVVKSEDYEDPLQKPLDPTIKYQYLREEDLEDGSKGGGDILKSLENTVTTAINKAQNGAPSWSAYPSIHAAYQLSEGTKPPLPMGSQVLQIRPNLTNKLRPIAPKWKVMPLVSMPTHLAPYTQVKKESEDKDEAVKECGKESPHEEASSFSHSEGDSFRKSETPPEAKKTELGPLKEEEKLMKEGSEKEKPQPLEPTSALSNGCALANHAPALPCINPLSALQSVLNNHLGKATEPLRSPSCSSPSSSTISMFHKSNLNVMDKPVLSPASTRSASVSRRYLFENSDQPIDLTKSKSKKAESSQAQSCMSPPQKHALSDIADMVKVLPKATTPKPASSSRVPPMKLEMDVRRFEDVSSEVSTLHKRKGRQSNWNPQHLLILQAQFASSLFQTSEGKYLLSDLGPQERMQISKFTGLSMTTISHWLANVKYQLRKTGGTKFLKNMDKGHPIFYCSDCASQFRTPSTYISHLESHLGFQMKDMTRLSVDQQSKVEQEISRVSSAQRSPETIAAEEDTDSKFKCKLCCRTFVSKHAVKLHLSKTHSKSPEHHSQFVTDVDEE

SEQ ID NO: 4413 - protein, 252 aa, Homo sapiens
MFFWCACCLMVAWRVSASDAEHCPELPPVDNSIFVAKEVEGQILGTYVCIKGYHLVGKKTLFCNASKEWDNTTTECRLGHCPDPVLVNGEFSSSGPVNVSDKITFMCNDHYILKGSNRSQCLEDHTWAPPFPICKSRDCDPPGNPVHGYFEGNNFTLGSTISYYCEDRYYLVGVQEQQCVDGEWSSALPVCKLIQEAPKPECEKALLAFQESKNLCEAMENFMQQLKESGMTMEELKYSLELKKAELKAKLL

SEQ ID NO: 4414 - protein, 275 aa, Homo sapiens
MEEVREGHALGGGMEADGPASLQELPPSPRSPSPPPSPPPLPSPPSLPSPAAPEAPELPEPAQPSEAHARQLLLEEWGPLSGGLELPQRLTWKLLLLRRPLYRNLLRSPNPEGINIYEPAPPTGPTQRPLETLGNFRGWYIRTEKLQQNQSWTVKQQCVDLLAEGLWEELLDDEQPAITVMDWFEDSRLDACVYELHVWLLAADRRTVIAQHHVAPRTSGRGPPGRWVQVSHVFRHYGPGVRFIHFLHKAKNRMEPGGLRRTRVTDSSVSVQLRE

SEQ ID NO: 4415 - protein, 550 aa, Homo sapiens
MSHGPSPRLAESPQLSKGSLLTILGSPSPERMGPADSLPPTPPSGTPSPGPPPALPLPPAPALLADGDWESREELRLRELEEARARAAQMEKTMRWWSDCTANWREKWSKVRAERNRAREEVRQLRQRLDALTKELAGARRERQEAQGECEARGRELARLRGARGVADQTRDGPEPEAEREPVRDVGSERPPGSQELELVESLLKSMPEESEDCWEARSLGAGGPRGSSGRQERSRLPWEDTAATEEEASKLTALRLRLDESQKVLLKEREDKLALSRNIEKLEGELSQWKIKYEELSKTKQEMLKQLSILKEAHQDELGRMSEDLEDELGARSSMDRKMAELRGEMERLQAENAAEWGRRERLETEKLGLERENKKLRAQVGDLEEALARRRRQTASALDCDLRASQAALFEKNKELADLKHVHGKLKKQFQEKVAELAHANRRVEQHEAEVKKLRLRVEELKKELAQAEDELDEAHNQARKLQRSLDEQTEQSENLQVQLEHLQSRLRRQQQNAPLFGKIRSARFGTEEAEDGTSDLDEDEDLQIQVA

SEQ ID NO: 4416 - protein, 593 aa, Homo sapiens
MTAEDSTAAMSSDSAAGSSAKVPEGVAGAPNEAALLALMERTGYSMVQENGQRKYGGPPPGWEGPHPQRGCEVFVGKIPRDVYEDELVPVFEAVGRIYELRLMMDFDGKNRGYAFVMYCHKHEAKRAVRELNNYEIRPGRLLGVCCSVDNCRLFIGGIPKMKKREEILEEIAKVTEGVLDVIVYASAADKMKNRGFAFVEYESHRAAAMARRKLMPGRIQLWGHQIAVDWAEPEIDVDEDVMETVKILYVRNLMIETTEDTIKKSFGQFNPGCVERVKKIRDYAFVHFTSREDAVHAMNNLNGTELEGSCLEVTLAKPVDKEQYSRYQKAARGGGAAEAAQQPSYVYSCDPYTLAYYGYPYNALIGPNRDYFVKAGSIRGRGRGAAGNRAPGPRGSYLGGYSAGRGIYSRYHEGKGKQQEKGYELVPNLEIPTVNPVAIKPGTVAIPAIGAQYSMFPAAPAPKMIEDGKIHTVEHMISPIAVQPDPASAAAAAAAAAAAAAAVIPTVSTPPPFQGRPITPVYTVAPNVQRIPTAGIYGASYVPFAAPATATIATLQKNAAAAAAVYGGYAGYIPQAFPAAAIQVPIPDVYQTY

SEQ ID NO: 4417 - protein, 282 aa, Homo sapiens
MPLLTQQIQDEDDQYSLVASLDNVRNLSTILKAIHFREHATCFATKNGIKVTVENAKCVQANAFIQAGIFQEFKVQEESVTFRINLTVLLDCLSIFGSSPMPGTLTALRMCYQGYGYPLMLFLEEGGVVTVCKINTQEPEETLDFDFCSTNVINKIILQSEGLREAFSELDMTSEVLQITMSPDKPYFRLSTFGNAGSSHLDYPKDSDLMEAFHCNQTQVNRYKISLLKPSTKALVLSCKVSIRTDNRGFLSLQYMIRNEDGQICFVEYYCCPDEEVPESES

SEQ ID NO: 4418 - protein, 436 aa, Homo sapiens
MLLSPKFSLSTIHIRLTAKGLLRNLRLPSGFRRSTVVFHTVEKSRQKNPRSLCIQPQTAPDALPPEKTLELTQYKTKCENQSGFILQLKQLLACGNTKFEALTVVIQHLLSEREEALKQHKTLSQELVNLRGELVTASTTCEKLEKARNELQTVYEAFVQQHQAEKTERENRLKEFYTREYEKLRDTYIEEAEKYKMQLQEQFDNLNAAHETSKLEIEASHSEKLELLKKAYEASLSEIKKGHEIEKKSLEDLLSEKQESLEKQINDLKSENDALNEKLKSEEQKRRAREKANLKNPQIMYLEQELESLKAVLEIKNEKLHQQDIKLMKMEKLVDNNTALVDKLKRFQQENEELKARMDKHMAISRQLSTEQAVLQESLEKESKVNKRLSMENEELLWKLHNGDLCSPKRSPTSSAIPLQSPRNSGSFPSPSISPR

SEQ ID NO: 4419 - protein, 423 aa, Homo sapiens
MVPHLLLLCLLPLVRATEPHEGRADEQSAEAALAVPNASHFFSWNNYTFSDWQNFVGRRRYGAESQNPTVKALLIVAYSFIIVFSLFGNVLVCHVIFKNQRMHSATSLFIVNLAVADIMITLLNTPFTLVRFVNSTWIFGKGMCHVSRFAQYCSLHVSALTLTAIAVDRHQVIMHPLKPRISITKGVIYIAVIWTMATFFSLPHAICQKLFTFKYSEDIVRSLCLPDFPEPADLFWKYLDLATFILLYILPLLIISVAYARVAKKLWLCNMIGDVTTEQYFALRRKKKKTIKMLMLVVVLFALCWFPLNCYVLLLSSKVIRTNNALYFAFHWFAMSSTCYNPFIYCWLNENFRIELKALLSMCQRPPKPQEDRQPSPVPSFRVAWTEKNDGQRAPLANNLLPTSQLQSGKTDLSSVEPIVTMS

SEQ ID NO: 4420 - protein, 461 aa, Homo sapiens
MLELRHRGSCPGPREAVSPPHREGEAAGGDHETESTSDKETDIDDRYGDLDSRTDSDIPEIPPSSDRTPEILKKALSGLSSRWKNWWIRGILTLTMISLFFLIIYMGSFMLMLLVLGIQVKCFHEIITIGYRVYHSYDLPWFRTLSWYFLLCVNYFFYGETVADYFATFVQREEQLQFLIRYHRFISFALYLAGFCMFVLSLVKKHYRLQFYMFAWTHVTLLITVTQSHLVIQNLFEGMIWFLVPISSVICNDITAYLFGFFFGRTPLIKLSPKKTWEGFIGGFFSTVVFGFIAAYVLSKYQYFVCPVEYRSDVNSFVTECEPSELFQLQTYSLPPFLKAVLRQERVSLYPFQIHSIALSTFASLIGPFGGFFASGFKRAFKIKDFANTIPGHGGIMDRFDCQYLMATFVHVYITSFIRGPNPSKVLQQLLVLQPEQQLNIYKTLKTHLIEKGILQPTLKV

SEQ ID NO: 4421 - protein, 541 aa, Homo sapiens
MTTPAGSGSGFGSVSWWGLSPALDLQAESPPVDPDSQADTVHSNPELDVLLLGSVDGRHLLRTLSRAKFWPRRRFNFFVLENNLEAVARHMLIFSLALEEPEKMGLQERSETFLEVWGNALLRPPVAAFVRAQADLLAHLVPEPDRLEEQLPWLSLRALKFRERDALEAVFRFWAGGEKGPQAFPMSRLWDSRLRHYLGSRYDARRGVSDWDLRMKLHDRGAQVIHPQEFRRWRDTGVAFELRDSSAYHVPNRTLASGRLLSYRGERVAARGYWGDIATGPFVAFGIEADDESLLRTSNGQPVKTAGEITQHNVTELLRDVAAWGRARATGGDLEEQQHAEGSPEPGTPAAPTPESFTVHFLPLNSAQTLHHKSCYNGRFQLLYVACGMVHLLIPELGACVAPGGNLIVELARYLVDVRQEQLQGFNTRVRELAQAAGFAPQTGARPSETFARFCKSQESALGNTVPAVEPGTPPLDILAQPLEASNPALEGLTQPLQGGTPHCEPCQLPSESPGSLSEVLAQPQGALAPPNCESDSKTGV

SEQ ID NO: 4422 - protein, 537 aa, Homo sapiens
MAHCVTLVQLSISCDHLIDKDIGSKSDPLCVLLQDVGGGSWAELGRTERVRNCSSPEFSKTLQLEYRFETVQKLRFGIYDIDNKTPELRDDDFLGGAECSLGQIVSSQVLTLPLMLKPGKPAGRGTITVSAQELKDNRVVTMEVEARNLDKKDFLGKSDPFLEFFRQGDGKWHLVYRSEVIKNNLNPTWKRFSVPVQHFCGGNPSTPIQVQCSDYDSDGSHDLIGTFHTSLAQLQAVPAEFECIHPEKQQKKKSYKNSGTIRVKICRVETEYSFLDYVMGGCQINFTVGVDFTGSNGDPSSPDSLHYLSPTGVNEYLMALWSVGSVVQDYDSDKLFPAFGFGAQVPPDWQVSHEFALNFNPSNPYCAGIQGIVDAYRQALPQVRLYGPTNFAPIINHVARFAAQAAHQGTASQYFMLLLLTDGAVTDVEATREAVVRASNLPMSVIIVGVGGADFEAMEQLDADGGPLHTRSGQAAARDIVQFVPYRRFQNAPREALAQTVLAEVPTQLVSYFRAQGWAPLKPLPPSAKDPAQAPQA

SEQ ID NO: 4423 - protein, 580 aa, Homo sapiens
MWRPVQLCHFHSALLHRRQKPWPSPAVFFRRNVRGLPPRFSSPTPLWRKVLSTAVVGAPLLLGARYVMAEAREKRRMRLVVDGMGRFGRSLKVGLQISLDYWWCTNVVLRGVEENSPGYLEVMSACHQRAADALVAGAISNGGLYVKLGQGLCSFNHLLPPEYTRTLRVLEDRALKRGFQEVDELFLEDFQALPHELFQEFDYQPIAAASLAQVHRAKLHDGTSVAVKVQYIDLRDRFDGDIHTLELLLRLVEVMHPSFGFSWVLQDLKGTLAQELDFENEGRNAERCARELAHFPYVVVPRVHWDKSSKRVLTADFCAGCKVNDVEAIRSQGLAVHDIAEKLIKAFAEQIFYTGFIHSDPHPGNVLVRKGPDGKAELVLLDHGLYQFLEEKDRAALCQLWRAIILRDDAAMRAHAAALGVQDYLLFAEMLMQRPVRLGQLWGSHLLSREEAAYMVDMARERFEAVMAVLRELPRPMLLVLRNINTVRAINVALGAPVDRYFLMAKRAVRGWSRLAGATYRGVYGTSLLRHAKVVWEMLKFEVALRLETLAMRLTALLARALVHLSLVPPAEELYQYLET

SEQ ID NO: 4424 - protein, 175 aa, Homo sapiens
MDIAIHHPWIRRPFFPFHSPSRLFDQFFGEHLLESDLFPTSTSLSPFYLRPPSFLRAPSWFDTGLSEMRLEKDRFSVNLDVKHFSPEELKVKVLGDVIEVHGKHEERQDEHGFISREFHRKYRIPADVDPLTITSSLSSDGVLTVNGPRKQVSGPERTIPITREEKPAVTAAPKK

SEQ ID NO: 4425 - protein, 486 aa, Homo sapiens [sequence omitted]

SEQ ID NO: 4426 - protein, 316 aa, Homo sapiens
MASRLLLNNGAKMPILGLGTWKSPPGQVTEAVKVAIDVGYRHIDCAHVYQNENEVGVAIQEKLREQVVKREELFIVSKLWCTYHEKGLVKGACQKTLSDLKLDYLDLYLIHWPTGFKPGKEFFPLDESGNVVPSDTNILDTWAAMEELVDEGLVKAIGISNFNHLQVEMILNKPGLKYKPAVNQIECHPYLTQEKLIQYCQSKGIVVTAYSPLGSPDRPWAKPEDPSLLEDPRIKAIAAKHNKTTAQVLIRFPMQRNLVVIPKSVTPERIAENFKVFDFELSSQDMTTLLSYNRNWRVCALLSCTSHKDYPFHEEF

SEQ ID NO: 4427 - protein, 361 aa, Homo sapiens
MASLLAKDAYLQSLAKKICSHSAPEQQARTRAGKTQGSETAGPPKKKRKKTQKKFRKREEKAAEHKAKSLGEKSPAASGARRPEAAKEEAAWASSSAGNPADGLATEPESVFALDVLRQRLHEKIQEARGQGSAKELSPAALEKRRRRKQERDRKKRKRKELRAKEKARKAEEATEAQEVVEATPEGACTEPREPPGLIFNKVEVSEDEPASKAQRRKEKRQRVKGNLTPLTGRNYRQLLERLQARQSRLDELRGQDEGKAQELEAKMKWTNLLYKAEGVKIRDDERLLQEALKRKEKRRAQRQRRWEKRTAGVVEKMQQRQDRRRQNLRRKKAARAERRLLRARKKGRILPQDLERAGLV

SEQ ID NO: 4428 - protein, 261 aa, Homo sapiens
MFEARLVQGSILKKVLEALKDLINEACWDISSSGVNLQSMDSSHVSLVQLTLRSEGFDTYRCDRNLAMGVNLTSMSKILKCAGNEDIITLRAEDNADTLALVFEAPNQEKVSDYEMKLMDLDVEQLGIPEQEYSCVVKMPSGEFARICRDLSHIGDAVVISCAKDGVKFSASGELGNGNIKLSQTSNVDKEEEAVTIEMNEPVQLTFALRYLNFFTKATPLSSTVTLSMSADVPLVVEYKIADMGHLKYYLAPKIEDEEGS

SEQ ID NO: 4429 - protein, 92 aa, Homo sapiens
MSELEKAMVALIDVFHQYSGREGDKHKLKKSELKELINNELSHFLEEIKEQEVVDKVMETLDNDGDGECDFQEFMAFVAMVTTACHEFFEHE

SEQ ID NO: 4430 - protein, 586 aa, Homo sapiens
MSRESDVEAQQSHGSSACSQPHGSVTQSQGSSSQSQGISSSSTSTMPNSSQSSHSSSGTLSSLETVSTQELYSIPEDQEPEDQEPEEPTPAPWARLWALQDGFANLETESGHVTQSDLELLLSSDPPASASQSAGIRGVRHHPRPVCSLKCVNDNYWFGRDKSCEYCFDEPLLKRTDKYRTYSKKHFRIFREVGPKNSYIAYIEDHSGNGTFVNTELVGKGKRRPLNNNSEIALSLSRNKVFVFFDLTVDDQSVYPKALRDEYIMSKTLGSGACGEVKLAFERKTCKKVAIKIISKRKFAIGSAREADPALNVETEIEILKKLNHPCIIKIKNFFDAEDYYIVLELMEGGELFDKVVGNKRLKEATCKLYFYQMLLAVQYLHENGIIHRDLKPENVLLSSQEEDCLIKITDFGHSKILGETSLMRTLCGTPTYLAPEVLVSVGTAGYNRAVDCWSLGVILFICLSGYPPFSEHRTQVSLKDQITSGKYNFIPEVWAEVSEKALDLVKKLLVVDPKARFTTEEALRHPWLQDEDMKRKFQDLLSEENESTALPQVLAQPSTSRKRPREGEAEGAETTKRPAVCAAVL

SEQ ID NO: 4431 - protein, 343 aa, Homo sapiens
MASAGSTARRAGSGSWHSERGEGRGARPQPTPSGSMQQANKVSLKATWTDAESKQPSQPLPDLADHLSAQATALARPRRPASLTPPRADPSPSKESDQTAIDQTAIGSYYQLFAAAVGNVEWLRFCLNQSLREIPTDDKGFTAIHFAAQWGKLACLQVLVEEYKFPVDLLTNNSQTPLHLVIHRDNTTVALPCIYYLLEKGADLNAQTCNGSTPLHLAARDGLLDCVKVLVQSGANVHAQDAMGYKPIDFCKIWNHRACARFLKDAMWKKDKKDFAREMTKMKMFKSQLTLMEHNYLIEYQGQGCSVHFPFAFSPITPETLLWQDISLLSDCGFLWRRRELSF

SEQ ID NO: 4432 - protein, 409 aa, Homo sapiens
MEESWEAAPGGQAGAELPMEPVGSLVPTLEQPQVPAKVRQPEGPESSPSPAGAVEKAAGAGLEPSSKKKPPSPRPGSPRVPPLSLGYGVCPEPPSPGPALVKLPRNGEAPGAEPAPSAWAPMELQVDVRVKPVGAAGGSSTPSPRPSTRFLKVPVPESPAFSRHADPAHQLLLRAPSQGGTWGRRSPLAAARTESGCDAEGRASPAEGSAGSPGSPTCCRCKELGLEKEDAALLPRAGLDGDEKLPRAVTLTGLPMYVKSLYWALAFMAVLLAVSGVVIVVLASRAGARCQQCPPGWVLSEEHCYYFSAEAQAWEASQAFCSAYHATLPLLSHTQDFLGRYPVSRHSWVGAWRGPQGWHWIDEAPLPPQLLPEDGEDNLDINCGALEEGTLVAANCSTPRPWVCAKGTQ

SEQ ID NO: 4433 - protein, 493 aa, Homo sapiens
MERSPDVSPGPSRSFKEELLCAVCYDPFRDAVTLRCGHNFCRGCVSRCWEVQVSPTCPVCKDRASPADLRTNHTLNNLVEKLLREEAEGARWTSYRFSRVCRLHRGQLSLFCLEDKELLCCSCQADPRHQGHRVQPVKDTAHDFRAKCRNMEHALREKAKAFWAMRRSYEAIAKHNQVEAAWLEGRIRQEFDKLREFLRVEEQAILDAMAEETRQKQLLADEKMKQLTEETEVLAHEIERLQMEMKEDDVSFLMKHKSRKRRLFCTMEPEPVQPGMLIDVCKYLGSLQYRVWKKMLASVESVPFSFDPNTAAGWLSVSDDLTSVTNHGYRVQVENPERFSSAPCLLGSRVFSQGSHAWEVALGGLQSWRVGVVRVRQDSGAEGHSHSCYHDTRSGFWYVCRTQGVEGDHCVTSDPATSPLVLAIPRRLRVELECEEGELSFYDAERHCHLYTFHARFGEVRPYFYLGGARGAGPPEPLRICPLHISVKEELDG

SEQ ID NO: 4434 - protein, 673 aa, Homo sapiens
MGGLASGGDVEPGLPVEVRGSNGAFYKGFVKDVHEDSVTIFFENNWQSERQIPFGDVRLPPPADYNKEITEGDEVEVYSRANEQEPCGWWLARVRMMKGDFYVIEYAACDATYNEIVTLERLRPVNPNPLATKGSFFKVTMAVPEDLREACSNENVHKEFKKALGANCIFLNITNSELFILSTTEAPVKRASLLGDMHFRSLRTKLLLMSRNEEATKHLETSKQLAAAFQEEFTVREDLMGLAIGTHGANIHQARKVPGVTAIELGEETCTFRIYGETPEACRQARSYLEFSEDSVQVPRNLVGKVIGKNGKVIQEIVDKSGVVRVRVEGDNDKKNPREEGMVPFIFVGTRENISNAQALLEYHLSYLQEVEQLRLERLQIDEQLRQIGLGFRPPGSGRGSGGSDKAGYSTDESSSSSLHATRTYGGSYGGRGRGRRTGGPAYGPSSDVSTASETESEKREEPNRAGPGDRDPPTRGEESRRRPTGGRGRGPPPAPRPTSRYNSSSISSVLKDPDSNPYSLLDTSEPEPPVDSEPGEPPPASARRRRSRRRRTDEDRTVMDGGLESDGPNMTENGLEDESRPQRRNRSRRRRNRGNRTDGSISGDRQPVTVADYISRAESQSRQRPPLERTKPSEDSLSGQKGDSVSKLPKGPSENGELSAPLELGSMVNGVS

SEQ ID NO: 4435 - protein, 346 aa, Homo sapiens
MAMVSEFLKQAWFIENEEQEYVQTVKSSKGGPGSAVSPYPTFNPSSDVAALHKAIMVKGVDEATIIDILTKRNNAQRQQIKAAYLQETGKPLDETLKKALTGHLEEVVLALLKTPAQFDADELRAAMKGLGTDEDTLIEILASRTNKEIRDINRVYREELKRDLAKDITSDTSGDFRNALLSLAKGDRSEDFGVNEDLADSDARALYEAGERRKGTDVNVFNTILTTRSYPQLRRVFQKYTKYSKHDMNKVLDLELKGDIEKCLTAIVKCATSKPAFFAEKLHQAMKGVGTRHKALIRIMVSRSEIDMNDIKAFYQKMYGISLCQAILDETKGDYEKILVALCGGN

SEQ ID NO: 4436 - protein, 754 aa, Homo sapiens
MNSSSRSQILLRWKSDKAQSGPYNVEKEILTSRFLRDTETCRQNFRNFPYPDLAGPRKALSQLRELCLKWLRPEIHSKEQILELLVLEQFLTILPGEVRTWVKSQYPESSEEAVTLVEDLTQILEEEAPQNSTLSQDTPEEDPRGKHAFQTGWLNDLVTKESMTFKDVAVDITQEDWELMRPVQKELYKTVTLQNYWNMVSLGLTVYRPTVIPILEEPWMVIKEILEGPSPEWETKAQACTPVEDMSKLTKEETHTIKLEDSYDYDDRLERRGKGGFWKIHTDERGFSLKSVLSQEYDPTEECLSKYDIYRNNFEKHSNLIVQFDTQLDNKTSVYNEGRATFNHVSYGIVHRKILPGEKPYKCNVCGKKFRKYPSLLKHQSTHAKEKSYECEECGKEFRHISSLIAHQRMHTGEKPYECHQCGKAFSQRAHLTIHQRIHTGEKPYKCDDCGKDFSQRAHLTIHQRTHTGEKPYKCLECGKTFSHSSSLINHQRVHTGEKPYICNECGKTFSQSTHLLQHQKIHTGKKPYKCNECWKVFSQSTYLIRHQRIHSGEKCYKCNECGKAFAHSSTLIQHQTTHTGEKSYICNICGKAFSQSANLTQHHRTHTGEKPYKCSVCGKAFSQSVHLTQHQRIHNGEKPFKCNICGKAYRQGANLTQHQRIHTGEKPYKCNECGKAFIYSSSLNQHQRTHTGERPYKCNECDKDFSQRTCLIQHQRIHTGEKPYACRICGKTFTQSTNLIQHQRVHTGAKHRN

SEQ ID NO: 4437 - protein, 213 aa, Homo sapiens
MDQEPVGGVERGEAVAASGAAAAAAFGESAGQMSNERGFENVELGVIGKKKKVPRRVIHFVSGETMEEYSTDEDEVDGLEKKDVLPTVDPTKLTWGPYLWFYMLRAATSTLSVCDFLGEKIASVLGISTPKYQYAIDEYYRMKKEEEEEEEENRMSEEAEKQYQQNKLQTDSIVQTDQPETVISSSFVNVNFEMEGDSEVIMESKQNPVSVPP

SEQ ID NO: 4438 - protein, 244 aa, Homo sapiens
MAAAAAAGEARRVLVYGGRGALGSRCVQAFRARNWWVASVDVVENEEASASIIVKMTDSFTEQADQVTAEVGKLLGEEKVDAILCVAGGWAGGNAKSKSLFKNCDLMWKQSIWTSTISSHLATKHLKEGGLLTLAGAKAALDGTPGMIGYGMAKGAVHQLCQSLAGKNSGMPPGAAAIAVLPVTLDTPMNRKSMPEADFSSWTPLEFLVETFHDWITGKNRPSSGSLIQVVTTEGRTELTPAYF

SEQ ID NO: 4439 - protein, 194 aa, Homo sapiens
MISRTPEVTCVVVDVSHEDPEVKFNWYVDGVEVHNAKTKPWEEQYNSTYHVVSVLTVVHQNWLNGKEYKCKVSNKGLQAPIEKTISKTKGQPREPQVYTLPPSQKMTKNQVTLTCLVKGFYPSDIAVEWESNGQPENNYKTTPPMLDSNGSFFLYSKLTVDKSRWQQGNVFSCSVMHEGLQNHYTQKSLSLSPG

SEQ ID NO: 4440 - protein, 264 aa, Homo sapiens
MDVCLSSAQQPGRRGEGLSSPGGWLEAEKKGAPQKDSTGGVLEESNKIEPSLHSLQKFVPTDYASYTQEHYRFAGKEIVIQESIESYGAVVWPGAMALCQYLEEHAEELNFQDAKILEIGAGPGLVSIVASILGAQVTATDLPDVLGNLQYNLLKNTLQCTAHLPEVKELVWGEDLDKNFPKSAFYYDYVLASDVVYHHYFLDKLLTTMVYLSQPGTVLLWANKFRFSTDYEFLDKFKQVFDTTLLAEYPESSVKLFKGILKWD

SEQ ID NO: 4441 - protein, 344 aa, Homo sapiens
MRVIRVGTRKSQLARIQTDSVVATLKASYPGLQFEIIAMSTTGDKILDTALSKIGEKSLFTKELEHALEKNEVDLVVHSLKDLPTVLPPGFTIGAICKRENPHDAVVFHPKFVGKTLETLPEKSVVGTSSLRRAAQLQRKFPHLEFRSIRGNLNTRLRKLDEQQEFSAIILATAGLQRMGWHNRVGQILHPEECMYAVGQGALGVEVRAKDQDILDLVGVLHDPETLLRCIAERAFLRHLEGGCSVPVAVHTAMKDGQLYLTGGVWSLDGSDSIQETMQATIHVPAQHEDGPEDDPQLVGITARNIPRGPQLAAQNLGISLANLLLSKGAKNILDVARQLNDAH

SEQ ID NO: 4442 - protein, 717 aa, Homo sapiens [sequence omitted]

(The sequence listing continues in the following parts.)

What is claimed is:

1. An antibody or antigen-binding fragment thereof capable of binding to G antigen 2A (GAGEA2) that comprises:
   1. a variable heavy chain complementarity-determining region 1 (CDR-H1), a CDR-H2 and a CDR-H3, wherein:
      1. the CDR-H1 comprises a reconstructed polypeptide consensus sequence set out in SEQ ID NO: 794,
      2. the CDR-H2 comprises a reconstructed polypeptide consensus sequence set out in SEQ ID NO: 1336, and
      3. the CDR-H3 comprises a reconstructed polypeptide consensus sequence set out in SEQ ID NO: 1878; and
   2. a variable light chain complementarity-determining region 1 (CDR-L1), a CDR-L2, and a CDR-L3, wherein:
      1. the CDR-L1 comprises a reconstructed polypeptide consensus sequence set out in SEQ ID NO: 1065,
      2. the CDR-L2 comprises a reconstructed polypeptide consensus sequence set out in SEQ ID NO: 1607, and
      3. The CDR-L3 comprises a reconstructed polypeptide consensus sequence set out in SEQ ID NO: 2149.

2. The antibody or antigen-binding fragment thereof of claim 1, wherein the antibody comprises a human antibody, a monoclonal antibody, a bispecific antibody, a multispecific antibody, a multivalent antibody, or a combination thereof.

3. The antibody or antigen-binding fragment thereof of claim 1, wherein the antigen-binding fragment comprises a Fab, Fab', Fab'-SH, Fv, scFv, F (ab')2, or a diabody.

4. The antibody or antigen-binding fragment thereof of claim 1, wherein the antibody or antigen-binding fragment thereof is cytolytic to a tumor cell or a cancer cell.

5. The antibody or antigen-binding fragment thereof of claim 1, wherein the antibody or antigen-binding fragment thereof inhibits tumor growth or cancer cell growth.

6. The antibody or antigen-binding fragment of claim 1 comprising:
   a variable heavy chain, wherein the variable heavy chain comprises a reconstructed polypeptide consensus sequence having at least 95% sequence identity to the amino acid sequence set out in SEQ ID NO: 252; and/or
   a variable light chain, wherein the variable light chain comprises a reconstructed polypeptide consensus sequence having at least 95% sequence identity to the amino acid sequence set out in SEQ ID NO: 523;
   wherein said antibody or antigen-binding fragment is capable of binding to G antigen 2A.

7. A fusion protein that comprises the antibody or antigen-binding fragment thereof of claim 1.

8. An immunoconjugate comprising the antibody or the antigen binding fragment thereof of claim 1, and a therapeutic agent.

9. A pharmaceutical composition or a medicament that comprises the antibody or antigen-binding fragment thereof of claim 1 and a pharmaceutically acceptable carrier, excipient or diluent.

* * * * *